United States Patent 7,892,730 (COMPOSITIONS AND METHODS FOR CANCER) - sequence listing, part 13

SEQ ID NO: 1330 - DNA, 102980 bp, Homo sapiens
aaggcagtttagagaatgaagtaaaccaatagatactcttttgattctccaaagaaatataattttggtttttgttcctcagagagagtttgaaagaaattttcagatgttctgttccctatagagggcctattccaggatctaaatgaatgggaatttataattcctttcatagactcaaacctgaaagcagaaatttttagtagttgagttgctttaagtgaattttaacaaatatgacacagaaaaggtcagatgctgttgtataaaattttttactagtgtgtcttatataattctttcttctcattaattcagtgcctttttcctctaagcatactcttggtccatgccccatgcagtgtcaactgatgtttaagctacagagcattgttgtagtggtgagggccctctgttgcaggggcatggggaaatgcatatattaatcaggggctggaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatcttttgttgcttatttagtttttgtttctacaggtcaaacatgattgctttctataaaagaaatgcttgagaggttgactataatggatatgtcacaggtataaaacagttgttttctaaaaacatgcatttagtatggcattctcttttagcaactgaattcccaacgagttttattaagctggatatcgaaatgaaggagctgccttaagcactttagaaaaagaatttttttacaattcattttgactctcatggctgaccatgtcattatgtctttaaattttggtaaatatgtagataccaagcattaataactaatgcacacagaaatttaatatacagcaattctttgaatgttccaggtgtacgtaaactaactgaaagtattaaggacatgcctgtctatacatgggtttcattgatggtatctgtatcatcttgacaaatcgtgaactgctgctgtatggctagactttgcctatttactctgttatgcaaacagtaatttttccctatgttatgaagagagacatattggcttgctttaatttacttatttatgaaattaaagcatgaataatatgtataatttgaattttttgtgactgatccttggcagtataaatgataaaagtaaatgtaatggaatcttttaattaggctaagatatgctatttcataacttatgtagaatgatttttatctatatactttgtccataaaattataattgtttatgtaattttattgtttcttatggaaacaattggaaaagtatatggaaaatgattatttcaaagaatatttatttaaagagggaagtgtagacttcttactgtaaaatatgtgattccaggcttaagaaattgattatattttaaaataattatttttttaaaaacgtaatttgtttttaaaagatgagtctccattcattggctaatccatacagcaaatatttgagtgtttgtgatatggcagtaaaaatgtgattactttgtatgtacattaaccaaaaccagtgaagtttgatggactgtgcatagagttttgcagcttttgagtagtgtgacagagtttgcctcttaaaattgttttgctaataagtcagaagtttaaaatgtgttatagtttgctaaaaaaaaatcaaattaactgcatataaaatggttcacttttatatagtcacatgtaatgggcctgaaaaagtttcttctttgattatgtagttactctagatacattcttttagggaagtgtatggtcaacatatatttactcagtatacagataaccacaaagttgttatttttaaccaaaatatacatttcataatgttggcactggagtattataagagatcatgaatgtttccttaattatcatggcaagattacctcacgttcagtatagtttagttttgtgtgtatcttacagtatgcatgttctgaaattatttgtgatcctgatatgtcacatataatagctttgttacctggagtatttgattaacctaaacagtttaagcattttgaattagttggagtttaaatggattacatttggtgtatattgtcttcattgaaaagatattgttggatatgccacatcagagttagcattgacttataaataaataccagaatttaccagagtacacttttctcttcagatgactcaattattaaataaaagaatatttcttatttctgggtcaatataaggtactgacttctgatgcataatcacttaagctatgtgagtttaaactggtatcttttcttagtggtacccattcaatgtaagctggtccatgggaatggacatgaagaggatttcacagtatgtagagcagaaggcacgtgaatgtgtttgctttggcttggagcttattaagttttgactacggttaaaataagtcaaatagtaagtggtaaaacacatttttgttagtattggaactttctggagaacataagggctatgagaatgcatatatatattttttaacatttcctatatatctaaggtaccaaagcactgagtctaatttacctattaagggagactctttaaaatcaactttataactaattcatactataagacagataatagctaaagttttggaataatttatattaaaagccgcaagtcttaaaaatccctggatatgacataaaaaggattttggcttcttttttgaagtatttaaaattaatcaccttagctctaccatatactagatctgtgaccgctacacaaattgtttatcatctttgggtctctattgccttctttataaaataagtgtaagttgttcagcctgcctcacagggctgttgtgaggaaataaaatgaaatggagtatgtgaaattgcttcagcaacagcaaagtgctacgtaaatgtaaagtgttgtttttagctaataatggatttaagtgtttggataattgtagatgcatttactttgataaagcgtgtgcttaaagtggtatcaccagtgatttctaacatgattttaaaaaaataaaaccccaattaaaatgttctttaatattcatttaatttgtgcatgacttgtggcctttttgtattttctcaagcctattactctagagctgtaaaagctcttgcacagcattgttgtgtcagtgtagaatagtggcataaataaatgaattaagctacatttccatgcaggcatttgcactttgaagttagggctgcccagtgccacatgcaaagagtgtatttggtctaaacagttctttccaaacaaccaaatggctgggcagcttgttgtcacggataaatgatataaaatgtaaccactgaacatttgacaactttgttgcattatcatttttaaaaaaagatgaagcatttcaaaatcttgttaacctggttatctcttggtatctctcctgacatatttgttttgctttaaattggattaaatggtttacaggttatctgaatctacagatttagtatgtctattatctggacatgattttgctatgcagttgtgataataaaaattctaattcctcaggtttggccttttaagttatggctgaagacctttaatgatacttatgatgcactcagtgccatacaatagtgttttaagaagcacatggcctcattttccttagaaacaagacaaagcctttttaaaatgtttttttttcactttaaaatagggtattcaaagtggagtaacgtgtattttgaaatgattttgtgttctatatagaatgtcccagttaagattttacagaagcacctggaatatctcattaaaaatttaaaaactcttttcctgctctcttttgcttcattgtttgattttattaacttttatttaagtataaatacaatatgctgttggggatgagaatataaaaaaagtcatagttcctttgcctaaaaagcttaacattttagagcactactgttcaacagaattttatgcaattatgaaaagttatttgtgcagtccaatacagtagtgactggccataggcagctactgagcactttatatgtggctacatagagttgcatattgctaatagccactgttttgaacagtgtacctacagatggaaaatgaaacatgctatgttagtaactataatattacttatgaatttggtttctttggatcttgctacatgttgggttacattttggtagatggtaactaagagtcagaatcagaacctaaacatttttaaaattcttgctctaacttgaaaacagtttaaaagaaaaaaaatcagtgagactggagcgcctgtaactaagaagttatgtaagaagaatgaaaggagactggatagtcttgagtcacaggaagaagaatggacaaagattgataaaccactatagaagatggagagtgaatgggtgcagcatttctggagaacaattttagcaatattaagatttttaaatgcacatgctccttaatttcctttataagtatttctcttacatatatactcacaaaaaagccaatgttccttgcagcattaccatagctaatagtagcaacctaattattaattgaagacctacaaatttggatggacttggaggtaaattccttttccttttttggtagcaaggcacagaactggttcaaaaggcccaagttgcctcaacaaaagaatgtgataacagaattttgaaggctccccttttctaacttgctgcaccagcaaactaccatataagtagtggtctagatattatatattctgcacattcccctccccaataaatgttatatagaccattatgacaattggcttaattagagccttttccttggtataccagttcatttgtgcctggctgggagttctgtggcataagagctcaggatattatgtgcactctacttttctactaaaccccattttacacttacactgcatggtgtatttgtatttatttatttttgcacaaggtcagcacaagagcagatggttagattttggtatttccatgtgatcctacacagctgttaaaggatatgctgttaatggaagtgtattcatgatattaaacaaaaaagtcatccagcaatatatacagtacgatacaacgggtgtgtgcatgcatgtatacttgggtaagaggggaccctgacctgatcaccacacagtcttgctgtgcttctcttcatgggatgaaaaattgaggagccaagggattatgcctacttggaatgcatgtttcattacccacttatatactatattattgaaacagtctttcgttgtctgagataacacctggagttcttgtccacttatatactacattattgaaacagtctttcgttgtctgagataacacctggagttcttgtcccacctccaagacgattatggagcacggacacaaaggtgaggttagagtgaaagtttaataaggtgaaagaagaaagctctctgccagcagagagggggtcccgaacgggagtgcccatcatgaggctggggtccaggtttttatggacggaaggggaaggaatgtgcttagtctgggggctgtcttggcgaatgcgtgactcggcttggcccgggaccagtcaggaggtgaaatgattcatagatgctgcttagcttggcccaggacctatcagaagctgaagtgaagtgtggccgaggaccaatcgggctgaggtgatgatacacagcagctggacttacagtcctaacaaaggaaagtagagcgcccataggaacttaccagagcccactgtgcccatgcctacaaaaggggaataaacttttcctgggaacctgctgacaatacaaaggaccaaggcatttctatgccaggccttgttcccttatctgagtgagctggaggtttgtgcaagtttttatccaaatgggccgtaggtttttccatctgtgcagtcatgggcatgtctccaggcacaacaccctgtgctagttcccttattggtgcctgcagcttttttcccaggctgctttttatattatctggggataaggcactgactcatgagccaggggctctccaggacccttctcttgttacctacctaaggtaagctaactaaccggatccccacactcttgctgtgcctctcttcatgggatgaaaaattgaggagccaagggactatgcctacttggaatccatgttcctttacccacagaattctatactatgttatcagccagaaccccaggattccttgcctcatcagcctgaagcttgcttccaggatatgtgcaggccttttgtccaaatccatcctgaaaaaagactactacagatgtatatacccctatggctggcagtttgtgggaagtacagatgaagcttggatgtgcagactgagttgtccacatgcatgcatgataggcccctgtggcaggcttaagctagaagtaaaaagagacccaggggatcagggaagggcaggccaacctagtatcactttctagtacacttctgaagaatctgcgaatcgcatatttgaacctagatttctgttccttgagaatacatgttaaagtagaagagtataacattttatttgttggttaacgctcagctatttagacactgaaaatatgtcagggttggctttcatttgtattcttggcccagaccctacaaatgttaggagtcggccaggatccttacatgtgtgcacagctgagtggtttatagaacatgaatatttacttgtaagagaggctgtttttatgcatccttgtacccactctttcagctgtatttgctatccagattaaagcatactgacttgacgtttgccatgagctgagggctcacatttgacctttcagtatgcttgataagtaacactgccaccagtttagttgtatatttaccttcagttatgtttgttcccaaacctgcttatgtaggtggtagtcactgttgtagtcatgtaagtatgtaaaccaattatataaatatataaaccaaaataaatatgaaatgagtatgaaaaggtacttataagaaaagtacgagaaccattagagatgaagagtttaaaaagttgcaaagttagttgtggccaaagtaattgtgagtgataggggaagatttttaaaaataaattccaggactccaaatttatattccttcacttgtatctttaagttcctggtccattttacagaaacagaaactacaaatgatggatgatgcattatgtctatggttttgtaagaaaaacagtgagatactctaatcagctggtccatgcttaaaatgaacttagttcaaaacagaagattggccattgtaaccctctactgaaactgcctttttgagaaggtttattcagaactagatttgttatacacttggaaagtatttatttctaagaacctgataatttttcccttttcctgttacttttaattataatttccaaatatacagaaaagtagaaagccagtgctttgtgctcatcacctaatcaattgttaacattttgccatgtttgtgctatctattttgttttaaaatgtcacctgtaagtatgctatatgcatccatgatggcttttaaaaacagccacattctgttaacattcttagcaaaattaacagtaattctgtactattatctaatggatcagtccatactaaaatttcagttgtctcagaagtatctttttacagttatcttgttcaaatcaagatctagacagggtccacacattgtactccgttacatctcttaaatatttgattttacaatagttccctctgcttttaaatgccatttatgaaaaaaactgaggaatttgtctggtagaatgtcccgttttctgaatttagttgcttctctatatcctgtattagatctagagtttgagtaaatgcaggttcaatttttaggcaagaatccttcacaggtgtggctgtgtactttctatcacatcaggaagtacataatatatgcttgtcccaaatttagtgagattaagatcagtgggtttaggtgatgccagtctattataaagttccccatcaacctttcaccttaattttatcatctattgatgttgccctttcgattattttattaggagttacaaaatcgtgattgttttatcatcctccatttattagctggaactcttataagtactttggttacactaaaattcaattcatacaagaaaggcaggataaatgcttgatgttttcccttatcaagttttagaatatttaatcttcaacttggcaatcttcaatcacgactgaattttattttttaaggagtcattataaactcaagaatttttatatttgatgtgtttcaatcaatagcaagtatgtgatgctcaagttttcccatgtcccatcacgttagcacctgtgttaatgatgccattaagctttgataacttacttcctcttggtgtaaccttccacttttttttattaacctactgagtacctacccgttctgagtgcattggatgagaggacttcaacagtaagcttgtatgtgcataggaaatttctggaaggaaaaacaaaaagttggtaaatgtcataacctgtaggaagtgaggaagattttttcttccttttctttctgtactgatagaattaaaaacaaagcttagaaaacaaatatatgatgggagtattttccgttttgtagaaataaattataattacagtaactggtttagtgaattatggttttcaaaaatttataagaagattaatatctgagccttaacaaccaccttttggattacaccgttaaaagaaccaaagtgagaggatcgcttgaggccaagagttcgagaccagcctgggcaagatggtgaggacgccctcccccccacccccgccacaccccgccctgctagcccccaacgtctctacaaaaaaagaaaagaaaaaagttaatcaggtacaaaattgtatccagccttaaactggagggcaacaggtcgctaaatcttgaatgtcataaaggcacctcaacttcatgaggaatagtgaacgcagctgctattttccactctatcccctagctctactaattgtatccaaaccaaacttcagggagttatgctgaatccctctagcaaagcacacgcactaaaaaaaccactcgtttatcagaagttcacatttaacgggcttggaaaacggctcagctgctgcctccagttcatcttccgctgtcgaaagcgtttcagaacttaaactctcagattgcctcagtgcgctgctgtagttgtcaattaggcaagagataaaaaagggctttggctaagtggctagattataaaagcgaggaatcgccagggctcagtgaacttctggcggtgaggatgcgacaagagtcacaggaaagccgaggctggggctggaccgtgggaacgtcccagcaggaaccaagccagcctccgccgctcagcacttgacggcggcttttgcggcggttgctgtgagtgccgtaaagcggagcggctgcagcctgctgttgagtgaggtaaggtacgggaggctcaggtcggtacccggggatgggtgggcgccttcagacaggtaccgctggcgactcgggtgcccttaccgggcatcctccagcattctgggcacctgcctaccccttggtgaggaggccggccacaggctgagcgcgctccgggctgggtactcctcagtcagtccacgagcatcgcgtggtagacttccacttggccagtccttcccgcacttctgggcgtgtcatcaggtgaaatcttaatcctgggacagatgaaaggttggaggacgatcgagactcttgtagtagccgggttagggtagtgacccctgacctcaggttatccgcccgcgttggcctctcaaagtgctgagattacagccgtgagccaccgcgcccggcctgaaatttacaatttctcatttaacatgaggtaagccacatttctcttggcttcagttttgtcagatgtggaaaaaaaaaaaaaaggacctagatgatatatcagattctttatgcttttgaagatagcacgtttccagtcggtaaaaatcaagctgtgaacaaatgacaaagtgaatgatagagcagtatattagaaattgggcagatggaagcccagtagaaaaggctgtgtttgagctagactctgaggataaatagggtttgaacgattggaaaccatctctgttgggccatggacaaagatatcaaatgcaggaataagcatttatattttagcgattctatttgtggacataagtttagtgagggtagaggatttgggaaggctggcattgaacggtgaaagaactcttagtggaaaggaagtgcagggtgttctgacaaggaagaagaaaggaaccggggaaatgccgaaagaacaatacgcaggacttgatttcttggatctgggtgatgatatttttaacctgcgtttctaaaaagtaagtttaagtgctgttggcaaaaatgggaattctgttgaattccagcatgcaatagtgtactgggaataaagtgatttagatcgtagagtgctgaggttgccaataactagcctcttggctgtcatttaattcttctagagcctattctccataaggtgatgttgggccagctgatctctcttctctaaagcctgtaaaactagagactgtgaggatggagagctagttactttcttctggactgggagaggacgatagttgacagagaataaaattgttaattttggggctggacgcggtggctcacgcctgtaatcccagcactttgggaggctgaggcgggtggatcacctgaggccaaggagttcgaaaccagcctggccaacatggtgaaaccctatctctactaaaaatacaacaaattagccgggtgtggtggcgggcgcctgtaatcccagctactcctgaggctgaggcaggagaatcgcttgaacttgggaggcagaggttgcagtgagccaagatcaggccactgcactccggcctgggcaacaagagcgaaactctgtctcaaaaaaaaaaaaaagttaattttgaacatgttaaatttgaggtgaggtgcaggaaatagagttgaaaatataggcagatagagtgcatggactgtaatttaaatagtgttttctctcacaggtggtagttaaaatcttgagaatggatttgctttcagggagagattgtagagagagtaactataggccatacccacagagaggaggttggagaaattattgaaggaggcatgtggatctcagagctaagagcaaggaaggagttctttttaaaaaagttacatatagttgtagattctcaggggcccagtgttgttattaagctaatttaacagcatttacagcaaataataagcacctacttctgggaattctggcagaaaataaataattcaaatagatataatctccactgcctaattgtctacccagaagtggtatcatttacatatttatttattcaacaaatatttatatgtttcaagcactgctggttctagggatataacgacgagcaaggtagacattgttcttatcctccctgcatgtaaagcccttagcatctacatcagtgcttttcaaattttaatgtacatatgaatcatctgaggattttattaaaatgtagattatgaatcagtaggtgggggctgaaaattctgtattactaacaagctccaatgtgatactgatgttcttaggaccatacttttaagtgacaagaatctagatcctgtttagcaaatatggccgttattaagccactaccactacccatcatctgtttctcctaggataaaataattttacttcttatgaaaataatatatgcttatacaaatattggaacaatatagaaaagtgtaaagaaccatgtaaaaatcactcctaattctccctacccagagataaccattattaatatttttgggaacattcatccagattttacatatgtacatacattcacaatttaagtgttgcactaagtacatgtcacactctaagccctgtgtttgattctatttgctgtatgattttattaagataaatacccaagtgtccagaaccaagcaattaagtacttgcattcttgagggagccacttaaaaataatttgggggccaggcacggtggctcacgtctgtaatctcagcactttgggaggccaaggtggatggatcacgaggtcaagagatcaagaccatcctggccagcctgatgaaaccctgtctctactgaaaatacaaaaattagctaggcttggtggcacatgcctgtagtcccagctactcgggaggctgaggtaggagaatcacttgaacctgggagcggaggttgcagtgagctgagattgtgccactgcactccagcctggcaacagagcaagaatccgtctcaaaaaacaaaaaaaaaaacaaaacaaaaaacaaactttgggagccggacagtgtctcatgcctataatcattccaggtgcccaagaggctgaggtgggaggattgcttgtgcctagcagtttgaggcagcagtgagctatgattgtgacactgcactccagcctgggtgacagagcaagactccatttcttaaaaaaataaaaacttgtgttacttcaaaaatggggagacattaacataattacatgtgggctctagtaaatgaatatttgtcatttcatttaggatgagaggagaatttttaaagttttaaaaaaaacttagtttttttcttactacaaaatcaattgatgttcacgtaagataaataaggaaaaaaaataaaagcacctacactcctcccaacccaaagacaatccttgctgtcttcaccttccttcctgctaacctgtcttatctatatctttcatttcagccactatctttccaaaaccctcttacaccatagtcattcagaaaggagtaactatgtatttatgatttttctggagcatctactggagaaactaaatttcattagctttttatcttcaagtaacagcatgtgtaggtagaagttatattgcaaaggattaagtgcatgaatggtaagcaggtaaagaaacttcttaaccctttgcagtctaatgtttacttccaagctgctgacagttgtgaaaagttagcagtcaaaggaaaagaaatggacaataagaaagaccaacagtatttagggaagatttgatagtagctgttgctactgggatatttttggcttttgagaacagctgaaaaatgtcgatttttttttttttttggtctgacctctgaattcattttcagacgcattttctctttatgcctgccaatctgctacatcatctctctaactataccttttcctaattacactactctctttcctctgtagttcagcctcctgttttattttgttcagagcatatttgaatgtcagttctgttttaatgaattgcctgaaggattcttcctgtgcgctgcacaaacgaaaccagttcactgagactgtgctactgcagtaaagaaacagcttacttaacaatgatgctggctgtgcaaaggagttattactcaaatcagtctcgccaaagacttggtggttagtttttcaaggatagtttttagtttggtggcaggggactagggaatgagggctgctggttggctggggatgtgatgataagggtgtgaaaaatggtccttgtgtgctgagtccacctctgggtggggagccacgtgactggttgggtcatgagtcactagttcacctctaggtagtgtcagttggtccagaatgcaaaggtctgaaaaatatctcaaaagaccaatcttaggttctgtagccagggaaaatataaatcctgtgtcctctggaaaaaagactggttatcatttaactacatgttaccagaattcaggtccctctcataatcctaatcttgtagtctttcattacctttataaaggcagtttagttttggaaaaggttactatcatccttgctttaggttaaactgtaaactaaattcctttcaaagttagcttggcctgcacccagaaatgaccaaggacagattggaggtcagaaacaagatggaatcaactatgagatttctcttagctgtcataattttgcaaaggcagtttcactctctgattcatactatctatgcctcactcttactccccaatatccccaaataagtcggggatcccacagcataaggatatggctaggctctcacatatcatcttatgaacctaagttaggtgtcagggaaggtttttgattccacttccccccactcctgccttctggatcatctctcttgatatatcattcattcattcattcattcaaacagacccctacctaggtgattctcaaaagagtggggtctggggctggaggaggtgtcagggtaaaccagttaccaaaagtctttcatactaataccttcaaaggacaaatgcaaatgtaaaaaggaagctgaaagaatatgcagtggggttccaagatggccgaataggaacagctccagtctacagctcccagcgtgagcgacgcagaagacgggtgatttctgcatttctaactgagatactgagttcatctcactggggattatcggacagtgggtgcaggacagtgggtgcagcgcaccgagcgtgagccgaagcagggcaaggcatcacctcacccgggaagtgcaaggggtcagggaattccctttcctagccaagggaaggggggacaaatggcacctggaaaatcgggtcactcccaccctaatactgtgcttttccgacagtcttagcaaacagcacaccaggagattatatcccacgcctggctcggagggtcctatgcccacggagcctcactcatttgtagcacagcagtctgagattgaactgcaacgtggcagcgaggctgggggggggggcacccgccattgctgaggcttgagtagataaacagaggggccgggaagctcgaactgggtggagcccaccacagctcaaggaggcctgcctgcctctgtagacttcacctctgggggcagggcatagccaaacaaaaggcagcagaaacctctgcagacttaaatgttcctgtctgacagcttggaagagagtagtggttctcccagcatggagcttgagatctgagaacggacagactgcctcctcaagtgggtccctgaccctcaagtagcctaactgggaggcaccccacagtaggggcagactgacacctcacacagccgggtacccctctgagacgaaacttccagaggaacgatcaggcagcaacatttgctgttcagcaatattcgctgttctgcagcctctgctgatacccaggcaaacaggatctggagtggacctccagcaaactccaacagacctgcatctgagggtcctgactgttagaaggaaaactaacaaacagaaaggacatccacatcaaaacccatttgtacatcaccatcatcaaagaccaaaagtagataaaaccacaaagatggggaaaaaacagagcagaaaaactgaaaattctaaaaatcagagcacctctcctcctccaaaggaacgcagctcctcaccagcaatggaacaaagctggatggagaatgactttgacaagttgagagaagaaggcttcagacgatcaaacttctccgagctaaaggaggaagttcagacccaacacaaagaagttaaaaaccttgaaaaaagattagacgaatggctaactagaataaccaatgcagagaagtccttaaaggacctgatggagctgaaaaccatagcacgagaactacatgaagaatgcacaagcttcagtagccgatttgatcaactggaagaaagggtatcagtgatggaagatcaaatgaatgaaatgaagccagaagagaagtttagagaaaaaagaataaaccgaaatgaacaaagcctccaagaaatatgggactatgtgaaaagaccaaatctgcgtccgattggtgtacctgaaagtgacagggagaatggaaccaagttggaaagtactttgcaggatattatccaggagaacttccccaacctagcaaggcaggccaacattcaaattcaggaagtacagagaatgccacaaagatactcctcgagaagagcaactccaaaacacgtaattgtcagattcaccaaagttgaaatgaaggaaaaaatgttaagggcagccagagagaaaggtcgggttacccacaaagggaagcccatcagactaacagctgatctctcggcaggaactctacaagccagaagagagtgtgggccaatattcaacattcttaaagaaaagaatcttcaacccagaatttcatatccagccaaactaagcttcataagtgaaggagaaataaaatcctttacagacaagcaaatgctgagagattttgtcaccaccaggcctgccctaaaagagctcctgaagggagcactaaacatggaaaggaacagccgataccagcctctgcaaaaacatgccagattctaaagaccatggatgctaggcagaaactgcatcaactaacgaggaaaatcagcagctaacatcataatgacaggatcaaattcacacataacaatgttaaccttaaatgtaaatgggctaaatgccccaagtaaaagacacagactggcaaattggataaagagtcaagacccaccagtgtgctgtattcaggaaacccatctcacatgcaaagacacacataggctcaaaataaagggatggaggaagatctaccaagcaaatggaaaacaaaaaaaggtaggggttgcaatcctagtctctgataaaacagactttaaaccaacaaagatcaaaagagacaaagaaggccattacataatggtaaagggatcaattcaacaagaagagctaactgtcttaaatatatatgcacccaatacaggagcacccagattcataaagcaagtcctgtgtgacctacaaagagacttagactcccatacaataataatgggagactttaacaccctactgtcaacattagacagatcaacgagacagaaagttaacaaggatatccaggaattgaactcaactctgcagcaagtggacctaatagacatctatagaactctccaccccaaatcaacagaatatacattcttctcagcaccacaccacacttactccaaagttgaccacatatatggaagtaaagcactcctcagcaaatgcaaaagaacagaaattataacaaactgtctctcagaccacagtgcaatcaaactagaactcaggattaagaaactcactcaaaaccgctcaaatacatggaaactgaacaacctgctcctgaatgactactgggtacataacaaaatgaaggcagaaataaagatgtgctttgaaaccaaggagaacaaagacacaacataccagaatctctgggacatgtttaaagcaatgtgtagagggaaatttatagcactaaatgcccacaagagaaagcaggaaagatctaaaattgacaccctaacatcacaattaaaagaactagagaagcaagagcaaacacattcaaaagctaacagaaggcaagaaataactaagatcagagcagaactgcaggagatacagacacaaaaaacccttcaaaaaatcaatgaattcaggagctggttttttgaaaaggtcaacaaaattgatagaccactagcaagactaataaagaagaaaagagagaagaatgaaatagacgcaataaaaaacgataaaggggatatcaccaccgatcccaccgaaatacaaactaccatcagagaataaacacctctacacaaataaactagaaaatctagaagaaatggataaattccttgacacacacactctcccaagactaaaccaggaagaagttgattctctgaatagaccaataacaggctctgaaattgaggcaataattaatagcttaccaaccaaaaaaagtccaggaccagatggattcacagccgaattctaccagaggtacaaggaggagctggtaccattccttctgaaattattccaatcaacagaaaaagagggaatcctccctaactcattttatgaggccagcatcatcctgataccaaagcctggcagagacataacaaaaaaagagaattttagatcaatatccctgatgaacatcgatgcaaaaatcctcaataaaatactggcaaaccgagtccagaagcacatcaaaaagcttatccaccatgatcaagtgggcttcatccccaggatgcaaggctggttcaacatacataaatcagtaaatgtaatccaacatataaacagaaccaacaacaaaagccacataagattatctcaatagatgcagaaaaggcctttgacaaaattcaacaactcttcatgctaaaaagtctcaataaattaggtattgatgggacgtatctcaaaataataggagctgtttatgacaaacccacagccaatatcatactgaatgggcaaaaactggaagcattccctttgaaaactggcacaagacagggatgccctctctcaccactcctattcagcatggtgttggaggttctggccagggcaatcaggcaggagaaagaaataaaagatatttagttaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaaataacagagagccaaatcatgagtgaactcccattcacaattgcttcaaagagaataaaatacctaggaatccaacttacaagggatgtgaaggacctctttaaggagaagtacaaaccactgctcaacgaaataaaagaggacacaaacaaatggaagaacattctatgctcatggataggaagaatcgatatcttgaaaatggccatactgcccaaggtaatttatagattcagtgccatccccatcaagctaccaatgactttcttcacagaattggaaaaaactactttagagttcatatggaagcaaaaaagagcccgccttgccaagtcaatcctaagctaaaagaacaaagctggaggcatcgcgctacctgacttcaaactatactacaaggctacagtaaccaaaacagcatggtactggtaccaaaacagagatatagaacaatggaacagaacggagccctcagaagtaataccacacatctacaactatctgatctttgacaaaactgataaaaacaagaaatggggaaaggattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaaccaaggcaataccattcaggacataggcatgggcaaggacttcatgtctgaaacaccaaaagcaatggcaacaaaagacaaaattgacaaaagggagctaattaaactgaagagcttctgcatagcaaaagaaactaccatcagagtgaacaggcaacctacagaatgggagaaaatttttgcaatctactcatctgacaaagggctaatacccagaatctacaaagaactcaaacaaatttacaagaaaaaaacaaccccatcaacaagtgggcaaaggatatgaacagacacttctcaaaagaagacatttatgcagccaacagacacatgaaaaaatgctcatcatcactggccatcagagaaatgcaaatcaaaaccatgataagataccatctcacaccagttagaatggcgatcattaaaaagtcaggaaacaacaggtgctggagaggatgtggagaaataggaacactttcacactgttggtgggagagtaaactggttcaaccattgtggaagacagtgtggcgattcctctgggatctagaactagaaataccatttgacccagtgatcccattactgggtatatacccaaaggattataagtcatgctgctataaagacacatgcacatgtatgtttattgtggcactattcacaatagcaaagacctggaaccaacccagatgtccatcagtgatagaccggattaagaaaatgtagcacatatacaccatgaaatattatgcagccataaaaaaggatgagttcatgtcctttgtagggacatggatgaagctggaaaccatcattctcagcaaactatctcaaggacagaaaaccaaacatcgcatgttctcactcataggtgggaactgaacaatgagaacacttggtcacaggaagggggacatcacacaccggggcctgttgtgggatgggagcaagggggaggcgtagcattggtagatatacctaatgtaaatgatgagttaatgggtacagcacaccaacatggcacatgtatacatatgtaacaaacctgcatgttgtgcacatgtaccctagagcttaaaatataataataaaaaaaataagtaaataaaaaagaatatgcagtgctgctcttcactgtagaaagagcctgagaattatcttgaactccaaatcctgtaccttttttcatcacagttgtgtatgggttttatctactactagtttttttccaagccttttcacatcttgacacatagtaaatttgaccaagaaaagatgaaaggaaacataaaagaatgtgttcttggctggagatgacctactcttggggtctagctgccccaaagactgagaggattgttaactctgacacctataacccattcatgatttagttggtaagcagatctgcccatttctttcttcttcattgccagatctcagttcatgcactagttatgccctgcttccacttcatctaagaataattctgtgtcgcaatataccataattatatattaatcttctcatatttgcattagaactttaagattattgggctacttaaacttcgtaactcccctcgttacatcttttttttccctgaaaacatttgtcatttctctcccaaccactgcctcattttaatttactatctctgcaatactttttcttttcttttccattagagatgatatgctgtcttctttaggaaactttacctaagtgtaagtaaggaaatgaatgctatcctccctagtgtttttattatgatagctaaaatgtaacatataaaaagaagtgtatatagaaacaatatttttgttttagttctatgccatatctctctataggttattttttatatttttaaacgtttattttttgaaggttggaaccagatatgtgagtttaaggggctttaaactcttttaaaaatcttttttttttatatttcaaattctgttttattgtaaaagttcctgcagaacagaaaagttttatttaaatagttttctgttttcttgagcattgtgcagtgtatttttagtatacttagcatacttactattacttgatgttaattcagccaattttaggctggtggggaagatgattcatgtacactaacagttataatgcaaaatagaaactagtaaaagcctcaaggttagttgcctctccttgtgcttccatagtaacccgtgcttattccttcattgcaactatactgtattgttattgcctctatatttatctctgatagagtccatcataaactagaacagtggttcttaattgatgtgggggtggtaaggaatggggcttgcgcattttggaaaacatcttctcatattctttttcaggtacatcactctctccaccactatcactactgcccttcttcttttgaaaactcctgtactcacctttaagcccttcaaaattagggaagtgtatcttatttgtcattttatctctagtgcttagcatttttttttggcatctgtgcccattaaggtagacagtaactgtttatttgttgcaggaaggtaaaactaggttggaggtggagggagcacttctaacctggaagaatattgaagacttccttgaagaagtgtcatttgagaggagctatgaaaagaaagtaaactggttttatggaagtaaatgagaacattgcagacaagaggtaatgggcaaaaacacagaggcaggaaagtgtaggatgtattccaggaatactcatgcaaaaaccatagactatgtgaagtgtgagaaagcttatagtaaatttgcctgtattcagtcagattgtgaatacccctttataccattatatgtaatttgaactatttgtaggtggtagggaactattgaaaagttttgattgtggtgtaacttgatttatctgtcagcaacttgatacatctgtcagtgtataggtaagattgtggatacagagaaagtggagacagggacatcagttaaaattaggacattaggtacaattagagtttagaatgacagtgaagaaggaaggaattgatgcaagaggtattttaaaggtaaaatcaacatactatggcttctttttttcagtatcacattattcatttttaagtggttactgaatattcctaatgaagcggtagtgctagtgaaaaggaacattttgataggcgaatctttctcttttgtgactgaattgccttggcatttatagaaaataaataatgaagttaattggatatcatcttgataataaaaatgtaattaagtttttgatattatggtttggaggtttattttataagaattagttgtaaactagagaagaaagaacaagatattaatttagattttatgcctgtagtagcttatataggcaggcctattatgtgttctttcccatttattaatttgggcttagaagaagctgagttatggcctactctgagtgccactttagatttcactaggaatcagcatagaatacattaatgcactgtttaatacaagtacaagaacttgagttgaaatcttgaaaatgaagggcagtctccttgttaatcttgtgagctgccctcatcagagtataggttgagcatcccaaatctgaaaattcaaaatctgaaatgctccaaaatctgcaacttttgcgtgctaatatgatgctgaaaggaatgttcattggagcatttcagaattttggattagggatgttcaactggtaagtgtaatccaaatattctggaatcctaagaagtccaaaatacttttggtcccaagcattttggataagggatactaaacctctatttgataattgtatttccatgggttttaactgaatacaaaaactaataccatcatcaatgttgattgatattgttttcacagttttgggagatacaaaataattatgatttattaggttatctttgcttaatatacattactgatcaggtgaattgttcacatcactattggtattatttctcttaagtagtttcttgagactgtatatatatatatatatattttagtgtttgctttatatagtcatcagctctggcagctcatttggattgttttaaaaccccaaaccaagacttgattttaagatggtaaagacatttgtgccctattctatctgaaattaccatgaaacaacaaggaaactgagagaaagagatgtaattacatctttgctgagactagaagacctgtaactccaaactgaaatatttgagaaatggcagccacatgtaagcaggaagaggttaaaagagaatgctggtagaaagagatctcagatagagctggcagagcaaagagtcctcttctgtttgcagtgggatcaggatgcatagaaaggcaatgggaatttccttggattgtttggcaacatgaactagcaagaaaggaagagtgaatgaggaagtgcacagataccccatctttgcaggaagcactctcttgctgaggcaaagtagaggagagatagtgagtggccctttgctgcctgtctctgacatctggaagaagtaatgtttaaatgcttttcccacttgttctcatacacattctctgcctttctcacatatacacatgtacaaaatactctgtcagaaagagttttcttgtataccagagactaccctctagtctagaatacacccttatttctttcttccatagttaaggcgtaaattatattcccgtttagaaaagtagatgaggactgggtgccgtggctcatgcctgtaatcccagcactttgggaggctgaggcaggtgggttgcttgaggtgaggagttcgtgaccagcctgaccaccacagaaaaaccccgtctaaactaaatatacaaaaattagccgagtgtggtggcaggcacctgtaatcccagttactcgggaggctgagataggagaattgcttgaacccaggaggtgaaggttgcagtgaactgagatcgtgccactgcactccatccagcctgagtgacagagggagactctgtctcaaaaaaaaaaaatgcttaattgtagttctgaaaatagagaattcaatgttataacagaaaaaatatttaagaaaaccttctgcaaagaaaagacatctttaggtcaggctcagtagtagctcacacctgtaattccagcactttgggaggctaaggcaggaggttctcttgaggctgggagtttaagaccagcttgggcaacatagcaagaccctgtctttacaaataaatttttaaaaaattagctgggcatggtggcacatacttttactcatggctactcaggaggctgagataggaagatcacttaagtgtgggagtttcgggttacaatgagctatgattgcaccattatacttcagcctggacgacaaagtgagaccctgtctcaaaaaaaaaaaaatctttattctacagattgaaaggaaacacactgaatgaggaaaaactaacatacggtcatcaacatccttgtataacctagtttttaaaaaaattggatttcaaaggtaaggaatgcattctttgctcatcccaataaaaagattaaactacctatcaggagttggtttgggaaatcagatattgtcaagggaatatttagcactacaggacaatggtacaaagtgtgtaagtcattggggaaagacagtgtaacctcaaagccaaattgacaactatttttgaacaaggcaaaagctcaaggtaagtggtacccctaagttctttttgataaactgcaagaagatgaatatcagtcatacagtagatgaacagagatgatatagcaaatggattggcagggaacattgtaggaataagaccaaaataactatgagatttgtagttatagaatacaatagaactgtaacatgtagaaataattaataaaagtcaagattgaaagaggagagaagacagaatgtagtataaatttgttggtttcttcttattttatagctggagaacaaaagacatataaaccttagatatcaagcataagagaggtgtcagtatatttgaaggattgaaggaataaatgtaagcatttgaagaactaaatgtgtttaaccaaaatcaaacagtggagacaaggtaggaagaagtagaactgtattaaatttcttatcctaaaggaataatcagagatgagacctaagatgaaagaacaaaatgtttattgtggcattctttacagttgaaaaaactgaaaacatacatggagtataaataaaaactgaccacatcctagatcacacacaaacttgaaaagcaacaaagagctgtcttacaggccatgttccttgactaaaaacggtctcagtttctcctttggaagtggttctcagcattgtcagcagcaccagcatcatttgggaacttgtcagaaatgaaaattctgaggtctcataccggatttactgaatcagaaactggaggagaaaagcacctctcaaccttgttggtcagtttttataaatatcctatttatgttttcagttatttacagttataaaaaaaagtgataataaacatttttgttttttcatcattggtctcatatttgattatttctttagcatagacaatgaccagatcaaagaatgcctgtggaaatttaattttttctttgttctattgttggttattacaggtacaaaattaaagaggtttttgtttctttaaaaatatcttttttgttcacagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaaggtaattttattccttctttcttatcattcctcctttcttatcattgtatattttctgatcacacttctctttgcaatacataatattaatcatgggtattcaaattcttgcatctttgcgaggtgtggcaaacaattaaaaattcagttaaatatacttgtaatagcacactaaagacaggtgctaagtttcaaggatgtttaatctattggaatttcctgagctagttatttaaaaattattattttgttaaacagattatccttcatttaaatgaactcaatgataaataattttgataaaatgtcaaaattagtttattttagtacagcatatattttaatttagtacctactggggaagtataatggtatgacttacctttatctgtatgtataggaataaagtagagacaatgatgtggaaatcaatagcttctgaagattccgtagaatataccagataaggaattccaaagttgagatggtgttgttacattgtgaaaagttgccaaacactccctctggggtgtattataataattactaccatcactgataattgtactagatgctttccatgctcagtttagtcctaaaaacaatcatggggaagaaaaaaaattttttttgtttttatgtttttatcctcatgtcttaattagaactattcatcagaattaatcactttgcgcccctcctcaactagaatggagtatacttccctgccttttttatgttgggcttgaccagtagaatgttaacagacatgtgcagaagctttgaataggctgttgtgatttgacttagtttttatgctcccctgacctataggagaagagaaaaatgtatggagcagaccaaagcatagctgcccagctgactcacagatttgtgagggaggaaatagatgcttataagccataagactgggggaagtttattatgcagcattgttacatggagttattagacctaattttgacagataagaaaactgaaacttttcttttttttttttttttaattaatttattttttttattatactttaagttttagggtacatttgcacattgtgcaggttagttacatatgtatacatttgccgtgctggtgtgctgcacccactaactcgtcatctagcattaggtatatctcccaatgctatccctccccactcccaccaccccacaacagtccccagagtgtgatattccccttcctgtgtccatgtgatctcattgttcatttcccacctatgagtgagaatatgcggtgtttggttttttgttcttacgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttattttaattagatcccatttgtcaattttgtcttttgttgctattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccctatgaactttaaagtagttttttcgaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattatgaatgggagttcacttatgatttggctctctgtttgtgtgttgttggtgtataagaatgcttgtgatttttgcacattgattttgtatcttgagactttgctgaagttgcttatcagcttaaggagattttaggctgagacaatggggttttctagatatacaatcatgtcgtctgcaaacagggacagtttgacttcctcttttcctaattgaataccctttatttccttctcctgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaagaatattggtctaaaattctctttttttgttgagtctctgcccggctttggtatcagaatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatatcagagcctgttattggtctattcagagattcaacttcttcctggtttagtcttgggagagtgtatgtgtcaaggaatttatccatttcttctagattttctagtttatttgtgtagaggtgtttattctctgatggtagtttgtatttcagtgggatcggtggtgatatcccctttatcgttttttattgtgtctatttcattcttctctcttttcttctttattagtcttgctagtggtctatcaattttgttgaccttttcaaaaaaccagctcctggattcattgattttttgaagggttttttgtgtctgtatctcctgcagttctgctctgatcttagttatttcttgccttctgttagcttttgaatgtgtttgctcttgcttctctagttctcttaattgtgatgttagggtgtcaattttagatctttcctgctttctcttgtgggcatttagtgctataaatttccctctacacattgctttaaacatgtcccagagattctggtatgtcgtgtctttgttctcgttggtttcaaagaacatctttatttctgccttcatttcgttatgtacccagtagtcattcaggagcaggttgttcagtttccatgtagttgagcggctttgagtgagtttcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcacataggacttgctttatgaatctgggtgctcctgtattgggtgcatatatatttaggctagttagctcttcttgttgaattgatccctttaccattatgtaatggccttctttgtctcttttgatctttgttggtttaaagtctgttttatcagaaactaggattgcaacccctgcctttttttgttttccatttgcttggtagatcttcctccatccttttattttgagcctatgtgtgtctctgcacgtgagatgggtttcctgaatacagcatactggtgggtcttgactctttatccaatttgccagtctgtgtcttttaattggagaatttagtccatttacatttaaagttaatattgttatgtgtgaatttgatcctgtcattatgatgttagctgctgattttcctcgttagttgacgcagtttcttcctagtctcgacggtctttacattttggcatgattttgcagcagctggtaccggttgttcctttccatgtttagtgcttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccaagagatccgctgttggtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagtacttctctgtattggttattctagttatacattcttctcaatttttttcaaagtttttaacttctttgcctttggtttgaatgtcctcccgtagctcagagtaatttgatcttctgaagccttcttctctcagctcatcaaagtcattctccatccagctttgttccgttgctggtgaggaactgcgttcctttgtaggaggagaggcactctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggagtaccctgccttgtgaggtgtcagtgtgcccctgctgcggggtgcctcccagttaggctgctcgggggtcaggggtcagggacccacttgaggaggcagtctgccggttctcagatctccagctgcgtgctgggagaaccactgctctcttcaaagctgtcagacagggacattgaagtctgcagaggttactgctgtctttttgtttgtctgtgccctgcccccagaggtggagcctacagaggcaggcaggcctccttgaactgtggtgggctccatgcagttcgagcttcccggctgctttgtttacctaagcaagcctgggcaatggcgggcgcccctcccccagcctcgctgccgccttgcagtttgatctcagactgctgggctagcaatcagcgagattccgtgggcgtaggaccctccgagccaggtgtgggatatagtctcgtggtgcactgttttttaagccggtctgaaaagcgcaatattcgggtgggagtgacccgattttccaggtgtgtccgtcacccctttctttgactcagaaagggaactccctgacaccttgcgcttcccaggtgaggcaatgcctcgccctgcttcggctcgcgcacggtgcgcgcacccactagcctgcgcccactgtctggcactccctagtgagatgaacccggtacctcagatggaaatgcagaaatcacccgtcttctgcgtcgctcatgctgggagctgtagaccggagctgttcctattcggccatcttggctcctacccgaaacttttctttttttaagagaggatctcgcttcgtcacccaggctgaagtacagtggcataatcatagctcactgtaaccttgaatctggggctcaagcagtactcctgcctcaatctcctgagttgttaggaggactacaggcacatgccatcacgcctgactaattaaaaaaaattttttgtagagacggggtctcgctgtgttgcccaggctggtcttgaactcctggcctcaggcagttctgtcacctcaggctcccaaagtgctgggattacaagtatgggctactgcaactggcctggaaaaccaaaattgttaacagagatgtgaaataatttacccatacaaaccacccaatatctaatgtgtatagctgacctctaatgtccctagctccattttttccaggctatataattttaaaaataacagactatactgattctacttttgatcttggctgtttatccaatgaatgtctttctgtgacatcttcaaccctttcctcattattttcttaggataaagtcctagagtagaaattctagatctaatatgcacattttagatttttgttatatattacaaagttatccttcataaggataagcagtatacctgatttctcatatcttttcataaataggaataacaataataatggcatctgtttcagttagagatggctggctaatagtagcttaaacaaatagaggaattatctgtccatatctataagtctagagcctctaaaattctcttggtatttcctgtgttacagtcaaggctagaaggaataatagtgtgatctagcaggcttctagttttgtgacagtggccagcagattcccaaatataagagaatctggggaagtaaggttttactattgttatttagcttttctagcctctataatagagattgcaaaagagaaggggtttgggaatgggtgtcaggtcagcttacctatagtgcctgccatagcagctaacattttttgatgtgcttgattgagcaggccctatgcgaagcactttaccaacatttaattcttaaaacaagttgagtagatcttgttcttcctgtttttccagcaaaaacattgaggttttgagagacttactaattttcccaatatcacatagttattaagtgggggagatgaacctgaggagtctaccccaaaacctcattcattaatttttagtgttcgtaatattcagaaactgaaagctattcaactccattagaggtcgtttctttgattactagtggggttaaacatctttccatatgtatattggttctttttagttgtattcttacttcttcttatttgtgtctttcatatatgttcctgatgatgttgtctttttctgtagctgttctttatagtttgaagaatattaaaccttcatcatatatatttcaaatatttttcctgacttgtaatttgccttttaactttatattcatgatgtactccctcaataaattagtacttaatgtataaatagacagatgtcaaaatctgttttccttagggcatctgttttttatgttataagtagcccaagattatgggaatatttaactgtatttttgtctatttaatgtttaaattttttcactaaaatgaatttattttagtatgaggtatgaattagacatctaacttacatttttccacaatgattaaccaattgtcccaatatcccttattgaattacccattactttaaaaatcccatcttaattatatattaaattctaataaagaactgctgtctcaacccttttcccttggtggcagtgtaacatagttgttgagagcatgaacatcagtttgagattaaacctcatctatactgcttattagctgtgggatcttgagttaattacttgacttctaaatgcctttgtttccttatctacaaaatgggaggcaataacagtaccacctcatagacttgtgaagcttaaatgaattgatatacataaactatttggaacaatgcatgttatacagaaagaaaccagtaaaaattggctattattattattttttaattttataatgaaaaatagtatttgttgtattgtgtccataccatacaaactgccttagtaataatgccttattcattaaagaaaatataatctttgaacagaagtggtatgtaattaaagttcaggtaacctttatataccattaattttgtaaagttcattattcatactagattcttgttttttatgtttacttttgataataggtagacattataacatctaagttctaaaatatcacagattatttttattttattgaaatatatggagtgggtgcagtggctcacacctgtagtcccagaatttggggacactgaggtgtgcagattgcttgagcccaagagtttgaaaccagccatggcaccatggcaaaaccccatttctacaaaaaatacaaatattagcccagcatggtggcgtgtgcctgtagtcccagctattcaagaggctgaggtgagaggatcacttgagcttgggagattcaaggctgcagtgagctgtcattgcgccactgcactccagcctgggtgacggggagatcgtgtcttaaaattttttttttttaacatatggaaattatattaaaccgtttgtagcccagtaattgtatcctttaaaatggaatttttaaatttactcatgagttcagaaactgttatttaaaagtcacaatttgtagagtattttgccaaggcaatagaaacaatgaggtggtttcttcctgcccaatatttataatttaatttgggacagatgctgatgagagtatagatgcttcctgtatgttatagtgtgaaaacaggatactgtctgtaaggaatacaagcagtttctctatgccagtaggaaaaaaaaatgctttatttaaaaatagtaaggagaccaggtgcctgcctgtaatcccagcactttgggaggcttaggcgagaggatcgcttgagcccaggaattcaagaccagcctgggcaacatagtaagatctcatctctgctaaaaataagaaaattagctggttgtggtggtgcacgcctgtagtcctagctacttgggacactgaggtgagagaatccctctgagcccaggagtttgagtttacagtgagctaagatctgcactccaggatggacaagagagggagaccctgtctcaaaaaataaataaataaatatgtacatatgtaaaataaaaatagtaaggatagttagactaattagatgctaaagataccaacttttaaatttatttcagtgtcattgtggaaaattttgaagcttttgggtttttgttaaacttataaatctcacttacacgcagcgtttttgaactcaaagtttagtgaagtatagatgcatcctcagttttctaatggttttcttctgacataggaagagaacctgaactattgttaactttgtttaccgattacatctgaattgcattcctctgttgttcaatgagcagtgttttgtgggatatgcttagataaataaattcatgtaaaaattacttatagttcaattaaatgtttgatttggtagccaaagagtatggaatcatagtcttgatcagtgtgaaattataggttagcgtcatcaacataaaaaccaagattctaagtcatccttgaacttcaaggtaattttcagagacccttgagattatgtgttagagatagggatgaaaaattgattttatcttttattccaacccaaatttagtagcagtaaatgcctgcagcaccatggtaagaaggactgcaaagctttcaggcttttcaggaaagaacactctagtactggctaccttggagtttaaggagacttacttttgaccattttgagggccttagcacagaactactcttggtcctagctggttagacaagcctagcttttctatgatcctccaaatgggatctgaataatccagttatcatgttagcattgaagataaagaactagtatattatatttattgggtctactaaaatttcatagacgggtagaattgactcttcagattccagaacaacccttcaggtcttggatatacaaactcctttagtgtagtgtccttgtgagcattgtctgtgggcgccaactttcaagtagttggcttgcagctcacaccagaatggaaaggacatgtttctaggaccctgaagagaattttcattgttcactgtttttatgcaaccaacaggatagtatgataattgtgtgtgttcatttaatccgtatttattgatcactcgtcttacacagtgtacttaggaatacagagataaatagaacacaggccctactcatgaaactcataatttgatagacatggcagtatcaataatttttgagtttgggcactacatagtcctcatgcaattgtttggctttcagcaagtcactttgagcaccagtttctttaaatgggtctaatggcaacattgctggttgagataatgtatgtgatatgtctcacttagtgtctgatacatggtagatgataactatcagtagcttacattttctagtacttttaaggtttacattgcagtttgacaagtaaaattgtattaaattcttatagtgtccctataagcttatattttttactttttcataaaccaagttaactggggtccagatatgttaagtttcttaagttcaagattgccaatcaggtcctaaaacttgtatttattcatacagctattccaacatgtaaatataaatttgttcaaaagaaatgagtgataagatatgaaatgagatggctttaaggaatgccgtagcacaacagaaaatcgtcaaatattgatgcctatgtggagggaagacaaagccaatgaactatgtttgtattaggcactgagtgatccaagcctttttattgttcttgacttagtccaatgagcagcaccagtgcctgcagtaatcagctgtttgtattatctaggagcccacttatagaattgggtgctgagatatcttattttgcattctatttagtagcctatgtatgtttggttagaaggagggaggagggagttgaaaggggagtttggatttcaagtttggcagtagtcattcacagtgagcaattttatatgccattattagaaatggaaatcagtcttgtagccatttagatcatgtgcaacaaaggcttttgaatatttttagttggttagttacttgctaaaattatgcaagaaatatgattttccctttatcttttttcacttttgggcttcttccattttgccttcaaggataacatataggtcatttctggaggaagaatattatatttgatagcttgatccaatgtggtaaactttaataaatactactgccccacttcttctatcaccctctcactcctgctattatccaggagaaatgtgatataatttctttcattagaattgaagggtgtttttatagtctttccattttttcatttattctcaaacattaggctgtgtaggtttgtaggttttctggccagttttgattattaagaatcacagcttttctaccatttaaggtcacatttatgagtgattcactaataaatctaagaactgcagtggcttgggagtaaatataagagaaatgtttctactgaaaagagaaacactgagaggcagaagtggaaggctatctggagggttgtggaattggcaatggtcagtgtttctgatccttaggtttgcaagcttataagcaattgaaaaagacagttattgaagacttaattttttctgaaagtactactgtttgattctatatgagcataattaatgatcatgctgaattaggaatttggtttgagggtttctataagaaacactgttggatactgcatttcaaaaatgatagaattttttcttaaatcttcacctcctactttctggatgctttttctttgataatatatctttatttgacccagttatcactagagttcagttgctaccagacttttcctaccagttgttgttggcatctgattccatctgtttactcatttattcatttcccgtaaatttttactccaaatatcccataggcagtgtgtcagaatatttttttttaaccagttgactttacatggcatttctttcagaacattctgccattcatttgtcaagtatttgttgaaagcttactgtgtgccaagcacagtaataggctatgaaacaaatgatcagtgaagttcaatccttatgtctaggaactcacaaattgggaaatttgggggatgaaggggagagaggttaagaaacataaagagacatataagcaaacaataacaatacatgttacctcttttttcaaagcacacttcataacttttctgttctctagtatctagcctttgtaatctttcttctgtactgttgtcagagatatttttcttagatgcagatctgatccaagttattctctgcatagtatacctatggaataagaaccaaacttcttagcatagcatgctggatatactgtttgctctccaaattctctctttaccatactctgttcttggggaggcagacctttatggattatattagctgagctcccttgccctttggtttcctgttgggtttagccaatgggatacggctggagattgcaaactggaaagaaagagaggtcagattatttattctcttggttctctacttgtagggtcattggttgacagtgactgcatcttcctgtatagctacagttgcagccactgtagctgccactgagtgccaataactcttgctctccagagacggattaaacgttaagataatgaaatttaaacttcagggcccctcacttgcaggggacttgcagaggccttaggaatctgtttacaaagctatttatttttgtaacatttgcaaaagttatttttacattctttctgaagaagggccgacggctgggcacagtggcttatgcttgtaatcccagcatttttggaggccgaggtgggtggatcacctgaggtcaggagttcgagaccagcctggctaacatggtgaaaccctgtctctaccccaaataccaaaattagctgggtgttgtggcatatgcctgcctgtaatcccagctattcaggaagctgaggcacgagaatcgcttgaacccaggaggcggaggttgcagtgagccaaaatcacgccagtgcactccagcctgggtgacagaatgagactccatctcaaaaaaaaactggggggggcgggtactaacaaaatggtataatcttcaggccctataaaactggaccctccaatgtccttaaccttgacccttcaagcttaggtaagtataaggtttacagggaagagagactactgaataacatacttgggaaggctattaatgaatatttcatggatgaaataataatttgagttggtgttgtaggatgaggagttcttcaggtgaagaaggatagaaaggtcattacaaatagaagacacagcctgttcaaagggaatgagtattttgatgtctacagtgaagcatactaggtagaaaacaaagaaaatacaaaagtcctgcggcaggaatatgtctgtcagttttgagaacagcatagagatcaatgtggctgtagacaaatgagtgatggggagaatagtaggtaaggttagagtttcctgttacttagggtcttgtaagccgttgtaaggactttgaccttttatcctgagtgagactgggaaacaggaaggttttgagctatgtggacatgatctgactattgttttaaaacaagtagtctggccactttgatgagaatagattggctgtgttgccacccaaatctcatctttaattgtagctcccataattcccatgtgctggggggggacctggtgggagataattgaatcatgggggtggcttcccccatactgttcttgtggtagcaaataagtctcatgagagctgatgattttataaggggagatctgatgatttctccttttgcttgattctgattttctcttgtctgctgccatgtaagatatacctttcaccttctgccatgattgtgaggcctccccagctacttggaactgtgagttcattaaacttcttttgtaagttgcccagtctcaggtatgtctttatcagcaacgtgaaaatggactaatacacagagagaccagttagaaggctattctagtaatttacacaagagatgataatgatttggacaagagagttgatggtagagttggtgagaaatggaaagtacagtattcaggatttgttgatggattcgatgtagggtattagagtgacagaagcgagtcaaggataactctagtatttttgtcctaagtaattgcaatggcaaattgctgtttactgagatggatgagactgggaagagcaagtttgaggaatggtgaaaatcaggagtttttttgtacgtgttaagtttaaggtgctatgttaatctgttctttcattgctgtaaagaaatatctgaggcagggtaatttataaagaaaagaggtttaattggctcatggttctgcaggctgtagaggaagcatgatgctagcatctgctcaacttctggggaggcctcaggaaacttacaatcgtggcagcaggtgaagggggagcccgcacctcacatggccagagcaggaggaaaagagagagtggggagatgctacacacttttaaacaaccagatcttaggggaactcactcactccctatcacaagaatagcaccaagaggatggtgctaaaccattcatgacaaactgtccccacaatccaattacctcccaccaggccccatttccaacactggggattacaatttgacatgagatttggtggggacacagatctaaaccatattattctgcccctggcccctcacacctcatgatcctttcacattgcgaaatacaatcatgccttcccaacagtccttcaaagtcttaacttattccaacattaactcaatagttcaaagtctcatctgagacaaggcaagccccttccacctatgagcctgtaaaataaaaaattagttagttactcccaagattcgatgggggtatagtcattgggtaaatactcctgttccaaaagggagaaattggccaaaagaaaggggctacaggccccatgcaagccccaaacccagcaggttactcattaagtcttaaaaccccaaaatttgactccatgtctcatgtccagggcacacgggggtgggctcccaaggccttgggcagctcagaccctgtggctttgcagggttcagcccccacaactgctctcatgggctgacattgagtgcctgcagcttttcctggtgtaccatgcaggttactggtggatctaccactttggggtctggaggactgtggccctcttctcacagctccagtaggcagtgccccagtgggggctctctgtgggagcttcaaccctgcatttcccttccacactattctagtagagttctccatgagggctccattagcagcaagcttctgcctggacatccaggcttttccatacatcctctgaaatctaggcagaggctcttaagcctcaactcttgcactgtgtgcacctgcttacagcttgcaccctctgaagcagcctcagctatacctgtgcccccttgagccatggctggaactagagcagctggaatgcagggagcagtgtcttgaggctactcagggtggcaggcactgggcgtagcccaccaaactattcttccctcctacgtctccaggcctgtgatgggaggggctacctccaaggtctttgaaatgccttcaaagccttttccccattttcttggcgaatgcaaatttctgcagcctgcttgaattcctcccctgaaaatagacttttcttttctatcacatggccaggctgcaaattttccaaacatgtatgccctgcttccctattaaatatgttccaattttatgtcatttctttgctcacacatatgagcataggttgttagaagcagccaggccagatcttgaactctttgctgcttagaaatttcttctgggttgggcatggtggctcatgcctataatctcagcactttggtaggccgagttgggtggatcacaaggtcaggagttcgagatcagcctggccaatatggtgaaaccctgtctctactaaaaatacaaaaattagctgggtgtggtgatgggtgcctgtaatcctagctactcagaaggctgaggcaggaaaattgcttgaaactggatagcagaggttgcagtgagccacgatcataccactgcaatccagcttgggcaacaagagtgaactctgtctcaaaaaaaagaaaaaaagaaatttcttcttccaggtaccctaaactatcactctcgagttcagagtttcacagatctctagggccagggcacaatgcagccaggttgtttgctaaggcataacaaaagtgactttttgcttcacctcccaatacattcctgatttccatctgagacttccttagcctgggcttcattgtccatatcactataagcatcttgatcacaaccattcaacaagtctctaggaagtttcaaattttccctcatcttcctgtcttcttctgagccctccaaactttccctttgcctattacccagttccaaagttacttccacattttcagacaccttacagcaacactgctttcctggtaccaattttctgtagttagtctgttctcgaattgctataaagaaacacctaagactgggtaatttataaaggaaagtttaattgtctcattgttctagaggctgtacaggaagcatgatactggcatctgcttggcttctgtggaggcctcaggaaacttagaatcatggcagaaggtgaaggcggaaccagcacttcatatggctggagcaggaagaagagagagagggaggaggtgctacagtcttttaaacagttagatctcaggataactcactcactcattatcacaagaacagcaccaaagggatggtgctaaatccgtcacgagaaactgtttacatgatacagtcacctcccaccaggtactgcctccaacactggggattacaattcagtatgagatttggtggggcacagatccaaagcacatcaggtgcctatttgacattcaaatgaagaaggtgaatagacaattggctatataagtctgggtagagtgggttgggagtacaaatggagtgttgtaagcatatagatggtgtctaaagccatatgactagatgagatactaaggaagtgaatatagatttttaaagggggagaaagaaagtgccaacatctgaggtttgggaccctccaacacatcagggaagtaggaagaactgacaagttaaagaagcagccagagagaaacagagaaaaaacagaaatatggtgatacagagagctaagtgaatgaagtgtttcagtgaggcagaggttgtcaacaattcttggtatatcaaataagataagtattgataattgaccgttggatttagcaatgttcaggtcattggtgatcttgatgatgctcagcagagtgaatttaaaatgaagtgagttcatgggaggagaggaattggaggcaatgagaagagacaacccattaggagttttgctgtaatgggggacagaaagttgttctttgggaaaagaggagttgagaagtttttgtgttttgttttaattattagtgttttaagatggaataaataatagtcatgtttgtatactgatgggaatgatccatcagagaaagaaaaattgctggagcaatgtctttgtccagtcaaggggggatgggatttagtgcataagtggagaggctggccttagataggaacatagacaattcatctgttatgacagaagggaaggtgtattatatggatataattcttgtacagtaggtgggaagatgtggtgggggtttttgaaaattattttcaaatttcttttttctcagtgaaatagaaagcaatgccataagttgaaagataggatagggaggtgttagaaaaaagggggaaaagtcatctaggagaatgagacagttaatacacaaggggaatgtagtatgatttctgggcagaattaaagccccacttgggattagtagtcatgaatttaaattgacatcagccagatatggtgtctcacacctggaatcccagcactttgggaggcggaagcaagtggatcacttgagatcagcctaggcaatatggtgacaacctgtctttatgaaaaatacaaaaattagccaggtgtggtagtgcatgcctctatagtttcagctgctaggaagactgaggtaggagtatcacttgagtctgggaggttgaggctgcagtgagccgtgatcacgccactgcactccagcctgggcaacagagacccctgtctcattaataatagtaataataataaagtgatatcagtcagcagccacattagctgcacagttgcaggtgcagaataagtagaaagttggcctttgctgagcaaataaaatgaagtcagatggaggaaagttgtcagtgtatacaagagaatgattgtgaaacatgaatatttccgattgcatttttcataatagccaaaagctggaaataacctaaatgttcatcaactaatgaatgaatatacaatggaatattagccataaaaggaaatgaagtactgatacatgccacagcatgaatgaactttgaaaacatcatgcttagtgaaaaaccagatgtaaaaggccacatatatgattccatttttatgtagtgtccataatgggcaaatccacagagaagataattagtgttatgattggggctgagtggaggaggaaaggggagtggctgttaataggaacatagtttctttttggagtgattaaaatattctggaattagatagtggtaatagttgcacaactctaaacatactaaaaatcactttagaaaggcagattttatggtatgtgaattatatctcaataaagctatataaaaataacatgctagctcactagaaatttgcttatcccaaactcaacaaattgaacagctcagaaatatagctgagctgtatttgtaatcaactaatgtaggactaaggtgaacaagtagctgtattacaatgtttgcagtctcttttcaggtttcaagattacagttgtttttttctcagacatcccttagtattaaaatgttattggctaagttgcagagcttgtgaggagagaccaattctggctcagtcttaattacttagtatcttcatctctccatcccttcctctccccttccaattaacaaacctttactaagctataaaaatcatcaagcactatcctaggtgctactggttatacaaagatggattggactttgtccctccccttgaatgtgaggtttaatggggaaatgaggtttaggaacttggagcacatttcatttttagggtgagactactctaatcgttcttcagcatcctcccatctatagcttatagataacgtatgcactcaaggcataagaaacttatttggatcttcattacgcttgaaacattcttccttttgtctctagaacatcagacattctttctcctcttactctaaagtattttggggctaccagatgaaaactcataataattttcttctgatgctctagacctgaaatatcttttataaaaacttcaacattcaaaattacgatgtatgttaggcaaagcgtgcatactggtgctatctgcaaaacaaataataatgtttaccttgcaggattgttgtgagggatcaatgagtatacataattgatatatggaagtgtcaaacacacgagctcttcaataaacattagtatactttatcactttgccaaagtctacaaacactaattttatatatggcaatatgttgagattgcagatatagacatagaccttaacagacaaaccctaattccaaagagtttgccattcattgatggaaattaattggttcagagatgttgaccatgtctaccttattatttaataacttaattaacttactacaaatctatcgatgttttccatcttggatttttatatcataaaaatgtagaattcttagctcatgactatatgaaaaatagatatttgataatgctttttaatgattataagctaattatattttgaatctcatgcctaactgaaatgtaatgttgcatgctggactttgaatttactaaaaagttcttttgttgtcttcctagaatggagctggtttgtcaaaatccaaaggaagccgaattggatttgatagcacacagtgggtatgtagaataaacaagaaatttctcaattataatgttcatttagttcattcatttactccgtaagtatttgttgaatgatggcaataataatagctaccttgtgtggtgggtggccggttggtagtggcaggtaagggacaggccctttaccaagtgctttatgcaatgtcttatttagtccctatagaaagtttaagaagtgagtaaatattgttactctcaattcacttagagagattaaacttagttggctgataatttggtaagaccagattctgtctgcctctaaaacccacattcactgagctatggtgtttccctaaatgaatgaatatatgaatcagatttatttgaataagggaaaagtaatgatcaggaataaaaatctattcaacctattcctttataagatgaggggaaaccagcaatatatacaatatatccttgttttgttttagaaatttcagaacctacacattgataaaatatattttcctatgttttaaaactaaatttagaaagaaaaacattgctgggttactaataaaacacaacatttattctgttagcatacattatgggaatgaccagatatttcttgatacacttcaatctttggcttctctataactagagatgtggaacactttaaattagaagtggattttcagatcaccaagcagtggtcattttagatcattgctaacaccaagtagattttgaactactgtttaaaagtaaagtctgggatatcctattatcaggctccccagctctctagtctataagtgtcaatgtaaacttttaatttattaaaaatagcaattgttttgctctgtgaatttagggtattctgaggataaaggtaagcatgatatacttggaagttatactacccagtcacagttataaagattttagattaaattaaaaagaggtattttgtatgcttctctgtaacacttctctacctccatcccacccttaggaaacacatacacctaatacttggacctgatttatcatcttgtggttgaagtaatttgctgagatttaaaattcagtattttaacagccaaaggcaacaggggtgatctttcatacattttaacattataagatgtgatgatacttagagaaacatatatttttcagatttgccatttattaggagtcttcatctgtacactgtaaagcaatttcagcaaaaaatttaaagccgtagtagcttcagttggataaaaggttttcctttatcggtattaaccaacaacattctgacaacattcccaaaccttttagtaaatagagagagcagtcagagaaagtacaggttcactgatacattttaaaatggaatttgtgaaaaatttaaagcttaaaataatagaaaaaagtagcgtgactctatccttttcattcaagaaatgatccttgaggtgggagaaaataatggatttttttcaaagtctttacttccacggtacgcaagcaaaaagttgaagagcagcttaccacattcagtgagttctctttatactcttttacattgaggggactaaaaaaaattgtaaatgtggtcactgaatgactatatttgcaaaatcacaggaaaggagaagtactaacatacttctaaacttttagaaggaataaaaggtgaaatctcatcaatagtgtgatattgagccctggtaaaattctagggctcaatgtttatggagttattaaacagatgacttgggagcacttagaaaagaaaatgatcataattaggaactaggcttttactaagaacaagtcctgccaagactttttaggttttaataaaattttaatacacaggcagatgaatgggctattatggtctcagcataatctcttttcaacaagatgtttttcagtcttataaacaaaatgagttactgaaggtcagatgataatagtgatttagaattaattggatttagaatcaactggacacgtttccaaggagcgttaatgattgtattgataacaacttggaggatgtgtttagaaggtgagttatagaatctctgcttgaccctgacctaatctgtatttatattaataatggtaatgaagctataagtgtgttcatcatatttgtatttaacaccaacctgagatccattcaacaaacattaaagtaccttttatgtagtagttctgttatctcatctttcttccaaaaccatttctttcttgtttttttcctagtataaagcacagaaagtaataaccctaaaagacacacacacacacacacacaaaatagctaaattggactattaaaattttaaacttctagtcatcaaaaaacactattaagaaaatgaataagcatgccacagagtagcaaatatttgtaaaacatgtatctcacaaaggaatggtatcaaagatatatgaagaactcccacacgactcagtaatagattttttgttcatgcctttcatcaagttgaggatgtattttattcctggtttgctgaaagttttaaatcatgaatagatactgaattttgtcaaatgcttttttctatattgaaattatcatagtttttcacttttttctgttgatttgtcaaattttattgattgattttcaaatgctaaagtaagctttcattcctaggataaatactacttggtcatgatatttactttccttttttatctttttttagttactggaattgattttctaatattttattaagtatttttgcatctgtgttcatgagggatggtggactatacttttttttgtaaggtctttgtcaggttttgctttttttttttttttttttgagatgaagtctctctgtcgcccaggctggagtgcagccatgtgatctcggctcactgcaacctccaccttgtgatctcggctcactgcaacctccacctcccgggttcaagtgattctcctgcctcagcctcctgagttgctgggactacaggcacacaccaccacgcccggctaatttttgtatttttagtagagacagggtttcaccatgttggccaggctggtcctgaactcctgacctcaggtgatccacctgccttgacctcccacagtgctgggattacaggcgtgagaagttttgctgttgagtatggcactggcctcttaaaatcagataggaagtattttctcctgctccattttctcagaaagtttttgtagaattggtattcttccttaaaaatgatagaattcaccagtgaactgtctaagtctgaagtttttccttgttgttttgagggcagtttttttttttcctaacaaattcagtttctttaataggtatagggcaattcagattttgtttcatcttgtggcagttttgttaaattgtatttttaaagaaatttgtgtcatctaagttgaattttttggtgtaacattgtttatcctaactttttacttagctgtttctcacactgaggtaataaacccctataaggcagagattattgtattcttggcatttgcataatactctacactaaaaacaaataatgagactgattcttagctttatctcatcctttatccttacaattgatattttgtctatttatttatcttgtatatatttttatgagttccttcagattttctgaataagaatttattcttaatttcatgaagcacctttttgataggcaaacattcctataagtcttgctttcattgaagtaggcttttaagcaatagtgtatgccagatattctgtttatccttgctgttcttagatattacttattcctaagtgtgatttagtccattttcattctactgttgaatttttgtttttttcagtaggggaccctacttactacccagcagagttatattttgaaatattgcagtattagaaaagcacattatatatggcagtcatcaagcaggcagtgtattttggtctgagtcttttgcttagaaagattattaagcagcattacagatatgaagaaaaatggtacaaacaactgaattttgtttttgaaagattaacaagactgatttttaaaagctgacggatagttctctcaattttgcttgaaaagatttagctaatactaagagaataattttttaagcaccacattttcatgtcagataccacttcctctgtgaaatttcttatccttttgatgtatggtaaatttgtagcttactggtctgtacttttataatatgttgtatatgtttttcttgtagcatatttcaccttatattgaaaatgttcatctttcttagaagactgcttattgagagcagagaccatatgtgctatttaatcatttgtattttttagcacaatgataagcatggtatctattgggtaactactctgcattcttatacaattaatgaattaaaatgttataaaatagactgttgtgttggcttactggaattacgagaattctttttctctcaaacagcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggtaagtgacttgctttcagataatggaatgtgtctctttttacaaaatagtataggtttaggctagtttaaaatgtaaaacattaaaaatttttcctgaaacactttataaattgtatcaggaatattttcagctataaataacaatacaactaatcactaaggcaaataggggatttctttttcttatataatgagaggttaaaaggttagtggctattgatattagtttagctagccactgatgtcaggacttgtgtctctgaaattctttattcatttacctcattatcacaggatagctgtcgtagctccacatatcacatccatgttcacaacaggaagatgagaggaaagattctgcttttttgctgggggaaacttctcaatatcggtatttttaggtcatttctgttgaactgtttgatatctcatagaaaaagcctacaaggcttatttttacaaagaatattttataatgtccctttatattccccaaatgaagttcatagaaattataaccctcctatatacataattccccaaatcaatataatgtattaactataatataacctagaaataaaaggaaatgatatgtattgctgtgtgcagatgctccagaatgactacactggaagacataataaagtaattcagatgcttgtatttagaagtaggatcacagaatgtggtagctacaaatataaacccatactatgaatgatattgttgttggcaatatgattttccaaaatagtgagcaagtttccaacaacaaaaaaagtaaaattgtctcttcattgacatgactattgtattcctgagaaataaaagctcagacaattataaacaagtttttcactatgtgattatgtgacaggacatttgaaattacatagtacacaggatagattttcatattttggattgtaggatatctaatgttcttggcctaggactctaaatgccagtttgtcattatgataaaccaaaaatatccccccaaatttctgaagtatctgttgggtacagtcccacttgccttgagaaccactattttagaagaaggggagtatgccaccattggcaaaactgatactaccatagtcaagaggaagaagcaaaagctcagccatacccagaatcagcacatgggttcaagtttattcttcgtttgtttttgtttgtttgtgttgggttttttgtttttgtttttgttttttgagacggagtctcgctgtgtcacccaggctggagtgcagtggtgcaatctctgttcactgcaatctccgcctcccaggctcaagggattctcctgcctcagcctcctgagtagctgggattacaggcgtgtgccaccacgtgtgactgatttttgtatttttttttagtagggacggggtttcaccatattggccaggctggtcttgaactcctgacctcaaatgatccacctgcctcagcctcccaaaagtttctccttttgtacatatgacatcctactattcaagagattcaagagcccttggatagtcccccctaaaacatcccccaatgtggagctaatcagattgttagatctaataatgaaagactccatttgcatgtgatttttctttattaatgccattaccataaagtgagcaaacctctgccaaggctactgggagtggacttttctagcaaaaccttgacctaggcctttacaccaattgatcagagcaactattttgttctttacttctcttgttgatggttataagaaagcaaaccatatcataattctgcctattttgtctgtcagtctttcctcctataacccaaggtcacgttcttctcaagttctggccggccttttaaatatttcctgaatttgtcagctgataatgcctttcttttattctattcagtagtgtctttctctgaattggctaccctccccctcagtcagtgctttctacttctaaggtgtaccaagaaagaaaagggaagaagggaatgttacagttgataatgaaacaaatgatgttggaaaatgaaccttgtcttacagtatgtttgttaatttctaatgatttgcattatgatggtgttctattatggtagtattttaagatgttgggatgtaaactatgagatgaaagaactacttttttgaagtacttttgaagataaaggttattaaaagttaaattaagaattacaagtttaattttaagtgctgtccttaaatcaacatttactttatagaaactaactggaaaacactaacatgagcattctcattccaaggaagggatttgtattaattttcatagagttttttttgttttttttttttgagacagggtctcactttgtcacccaggcttgagtgcagtggcacaatcttggctcactgcagccttgatctctcaggttcaagtgatcctcctggctcagacccccaagtagctgggactacaggtacatgccaccacaccttggcaaatttttgtttgtattttttgtagagacaggttgcccaggctggtctcaaactcctgagctcaagtgatccacctgcctcagcctcccaaagcgctgggattacaggggtgagctatggtgcccaacctataaagagagtctttggctatatctttcctgctacatactttgtatttttgctgctttcctttattctcccaccactaccttctgcccatcaccctcattaaaaaatgttcttacagagcagattagcacaaaaatatggctcaagttcaatataagaatcactttagttttgctactagtatttggctttaaatattcaatgtttaagtgttgtttcttgatgtttgatgcttctttggttctaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggtaagttcagagtcaaaacgtgaaatgtgaaatgagtgttgttcagtcataattcttgcagtgtttttacatttgagtattgaaatctaatatataatttatataagtatttacagtaacattattcttaatgactccaaattagaagccacccaaatgtccttcaacaataaaaggattggctgggcactgtggctcatgcatgtaatcccagcactttgggaggccgaggtgggcagatcacctgaggtcaggagttcgagaccagcctggccaacatggtgaaacctcgtctctacaaaaaaatacaaaaattatccatgcattgtggtgggtgcctgtaatcccagctactggggaggctgaggaaggagaattgcttgagccctggaggtggaggttgtagtgagccgagattgtgataccacactctaggctgggcaacagagcaggactttgtctcaaaaaaaaaaaaaaaactgtaaaggaataaataatttttgatatatgtgttcatacaatgaagtattacacagcagggaaaaataaactaggggtctgtgcacattgtggatgaatcctacaatgctgaatgacacaaggcacaaaagaatctaaattctattattattattatttttttccattcaaaagtttcttttattcattaataaacaatgatatatatgtatacacagcttcataatcataccaaaaaagtttaagtgaactatcctttaaaggctgagaccataactttttgaacagaaataatatggattataagacagtatattgatttttgctgtctttattttaatataaagaacaaattgtgtggtaagactaatttattttcccactttgaaattaaacctctctagaaacatttagataaattatgaactaatctttaaaataccgtattacttcagcatttcaaaatcagtaagtttggaaactgtatttaagttaatattaggaataatataaccactgttgataactaacaatatagccaaaagaaaatgtggtacatacacacaatggagtactattcagccataaaaaagaatgagatcctgtcatttgcaacaacatggatagaactggagatcattatattaagtgaaataagccaggcacagaaagacaaactttccatgttctcacttatttgtgggagtgaaaaatgaaaataactgaactcatggagatagagagtagaatgatggttatcagaggctaggaagcatagtgggagaaagaggggaagagggggatggttaatgggtacaaaaaaatagttagaaataatgaataagactgagtatttgctaggacaacaaggtgactatagtaaaaaataattgtacattttaaaataactaaaagtatacttggattgtttaatacaaaggataaatgcttgaggtgatagataccccatttactctgatgtgattattatgcattgcatgcttgtatcaaaatattgcatgtaacccataagtatacacacctactatgtacctacaaaaattgaaaatacaaaagtgaaagtaaattctattattacttttataaaaagttcaaacacatgctaaattatgttcatggatgtatacccttatagtaaaagtattaagaaggctaagcaagacgtaccaaaaaagactagatagaggacacagagaactacagggaaactggaagaattttatttctgtggtggagactttggtgtttactttataattcattattttgtgcctttatgttatgcactttcctatatattttttaaaaccatgtgcaaaaatttatctttggctatctcaataataaaaatatttcttgtgagaaacagttatttgaaggaactcatgtaaaatttgattagctatagtttataatattaacaattacaggattaaaaacattcttgaagttatacttggagtatgaagtttctaacctagaattgttccttttattctccttttgaaatcagcgataatgatgttacagtctactttgaatagcagaatctgatgtaaaggtagcagtaaatatttgtaaggattttcacattaaaaactccttcttagtaacttccagtgagataattcttatctgttacacttgagaagtgtaagagtatgtttattcttgccttcttttaaaaatatatatatatattatatatatatgttttctctctctctatctggaatcatgtgagattgccttcttattagtacttaaagtcacatatttgagaatgactgaaaaaggtattcgaaactgaagtcttctatattttttgtgtatgaaaagtcggaacttttctgaaccaagccatattttcaaaatgaccaaaaaaaatgagtagagatggagaacaatactttgtttttattattggcttctcttattttaatcaaaaatcttaatactcactgttctcttaccacttttttgcctgtttttttcttattctgtatttcaaatgaccttctttagggagacattatcttttagttttttaaagctttgtgaatttatttcaaaatttaataacttagtaaagttcaaaattgtcagttacttattaaacataaacatgtgacaatagataaaagctatctctacattgtaaaattttatatgagtaggaatggaaaactctcaaataatatttttagagtatgggatccaaaatacataagatagatttgcagattagcattttacccattaatgagattctcaggccattgtaattaacttgtgtgtcttaagtgttaaaaacatttacttctctaaaagtaaactgataattaaaaattatgtcacaaaatttttgtttctgcttaaaatgccaagtgtgtatgaacaagtacaaatatattaatatataaatacattaaccaaaataattaaaactcaactgtttgatgtcagatttttcaaggtcttattaaaattgctaattgatatctgacataattgatgaaactatgcttgatgtttaggtattttgctaatgtttgatatttgtaagaggctgccagtattctgggttaaatccttttaataaatcttttattattattattattatttttaaattttactttaagtagtgggacacatgtactgaacgtgcaggtttgttacataggtatacatgtgccatggtagtttgctgcacctatcaacctgttatctaggttttaagctctgcacgcattaggtatttgtcctaatgttctccctccctgtttcccccacccctcattaataaatcttaacttttgttttcaggccagagttacagcaagttactgttgatggactggaagttctcattccaaaggatccaatgcactttgtagaagaagtaccacactctaggtttattgagtgtaggtataaagaagctcgagcattctttcaggttagagacaaccaaatgtgtacttttaaattaaagaaaatgttgggattatttttaatatttgagggtggtaagatgaaggggcttatggaaaatagaaaagtaaacatccttttttgatatgtctcttttcttctagattgttttctttcagttttttttagaagtagattaaaaattaaccttaagaaactattttctaagtcaataggttgatatttatttattgttttatttgaataactttaatagatttagcactggcttctgccttaagatagcccattaactttgtgaaaggtggtgtattctcagtccaagtaggataaagccactatagaagatggaccatgtagatttagaaaagacttcatgaaaatacagtttgtttcagagttggcattgaatataattttttttgcatttatgaaggtttttgaagataaatgctacacaaagaccaggtgcttttaaaactttattctcttgctgcagctttcaattcaatacacatttattgtgttccgcaggcttctggccctggggatataaagatgattttgaaaggcatgaaagttcagctctaagagatgacatgaaacacagagatacagtgaaaacaggcaaatttacagtggggttttggtacctgaattctttcacttgccctttattttctggggttccctgccaagaaagctgtgtccacgagggatacgaaaatgaagtatataactgtcaagtgcccaagacccacaaatctgaggtttctctaatacagtgtactggcacctaaagctgaggcctgacagcccaagtgggccttcgtagccctatttccttaagtcattgtggagctgtgaaatttatgcagccagcctcatgaataaaaagctgaaaaaccacatgtgtggatgggcctactctagtagaaaagtgctgcctgacatatgcctaccacataataacaggaagtagaagagatggagttttgtgcttaaacttgaccgctcttcctgtcctaagggagtttgctgtggttgtcatctctattatagcaattatcacagtgaattatgaatatctgtcttgtcctcttatcaaattttatgaacttcttgataacaggagtgttcttttatttacctgtgttggcccagtatctactgtacctggcataaagaaaagatccagtagggtcagttttcaaattaaagtgaacatacatgtatttgaacacttgatggcgccaaacagtcttaaatgtaatgcttggtgtaaagcaataaattaatctaatagacctcatcaagcagccgcctttctttttttaaaataatttttaaaaagcaattttaaatacataaaagctgcaagtacagtaccgataacttttttttttctgaaccacttgggagtaagatgttgaccacaacttcaaaaaatttagtatttttttaaaaataggaacattctctacatgtcctaatatgaaagttaggaaattagcacatacatttttaccatttaatccctattcaatttttgtcagttgtcccaataataacctttgtaataaaaagattcgattcagaatcacatgttgtcttaattttcctgtctctttagtcttcttcagtctgggacagtttctcagttcttttattactttcatgactaatactttggaagattacaagccagatgttttgtgcagtgtccctcatttggggtttgtccgggggttcctcatgttagatttaggttatacttctttagaaggtatagaagtggtgctgtgttctcattacatctcactgggcactgcataattttgatttatcccattactgttgatattcacattgttcacctgattaaagtgctgtctgaaacttcgtatctttaccactatgaagtttctgtttttccctttataataataagcatctggcaagaagttactttaaaactatgtaaatattgttttcctcattacattttcaatttatttgttcatatcaatataaataaattcatggtttcctattttaccctatgggttatagtcaattattttcattatttattttgatcttcagattgttccatatttggccagtagaaactccttcataatgctttctgtgtccttttgacttgtctccgttgttttttgaacactttagtactttttggcactataaaatattctgggttcatcttacaattttcatacctccaccctgggatcagccatttctttaagtcctgtttccttttagaagccaagacctggatgccaggtgtacccattgctatttgggttttgctgcagagagtttctctcagtgaacaggggtagggtgtatatgtctgtgtgtatttatttctgtatctatctattgaaacctctgaattcacattgacatctccagtccggttaaaagttccaattaaacaacagagttcatttccatatttgcgactcccttttcaaatcgtgagaaatctgactcccattgaccttaatgtttacttagttgttcagtctccctgtatgtaacctatcttccaacacatgtcctcccctccctaccccctgttcttctcaccctacctgggcactgctatcctctgctgggctgcacacacgtagaggcattcttcttaccctgttcaggctctgacttcccacacctggctgctgttctgcagagaggctttcctcaccctgcttgggctctgactccccacactggacactctcctactctcttcatgtggatgtcctcattacctgcctaggctctgataccccatatcaggcaatccctttgcacaaaaacctttcttgctctgccccatctaatggttttagtatcgaatagttcaggaagggcgggagactttatttacttttaattattttctcaatctaccatgaagttcaaaaactagaataatataccttttcctgaatttgattttgttttagcaaaaaccatcacaagataattaatgagctccaggctgttgaatatcagtgaaaaaccaaaaggaaagttggaaatacctgtacacctggcctaggaatatctagataacaatatttttattttatttctactaatttgctctaagattttgggcaaatttctgagccttggtttcctcatctacaataagagttggtaccttctgtcatcttattctttgatataaggtttgtgcttttggattccacgattcttcttgggctttgtgtccccgttcattggctgaacaggaaaaattaaataaacatgatatttaaagtaggatattaattttgtctttttttagaggtatagtaatcctgagatttgtacttgggatttatttttatttgtttacttatttattttatttttaacttgtaagttcaggggtacaagtgcaagtttgttacataggtaaacttgtgttgtgggggtttgttgtacagattatttcaccacccaagtattaagcctagtacctattagttatttttcctggtcctctttctcctcccaccctccaaaagaacccattgtgtgttgttcccctctatgcgtccatgtgttctcatcatttagctcccacttataaaaacatgaagtattaggttttctgttcctgtgttagtttgctaaagataatggccttcagctccatccatgtccctgcaaagaacatgatcttgttcttttttatggctgcatagtattccatggtgtatatatactacattttatttatccagtctatcattgatgagcatttagattgattccatgcctttgctattgtgaatagtgctgcagggaacacacacatgtatgtgtctttataagagaatgaatgatttatattcctttcagtatatacctgataatggaattgctgggtcaaacagtatttctgtctttaggtcattgaggaatcaccacactgtcttccacaatggttgaactaatttacactcccaccaaccgtgtataagtgttcctttttctccacaacctcaccaatatctggggtttattttattttattttattttattttattagtttttttttacttgttatagtagccactctgactggtattagatagtatcgtattgttttttattgcattttctaatgatcagtgatgttgaacttttttcatatgattgttggccacatgtatgtcttttgaaaagtgtctgttcgtgtccttcacccactttttaatggggttgtttggttttttccttgaaaatttgtttaagttcctgatagatgctggatattagacctaatagttaaggtttgcaaaccatagtttgcaaaaatgctctcccattccataggttatatgtttactctgttgatagtttcttttgctgtgcagaagctctttattttaattagatcctatttgtcagtttttgcttttgttgcaatttcttttggcatcttcatgaaatttttgcctgtgcctgtgtcctaaatggtattgcctgggttatcttccagggttttatagttttgggttttacatttaagtctttaatctatcttgtacaggatatttttaaatgaaaaaagtatgtatactataatttttaaaatttatagcagatgtttaaggtatatagctctatgcatgtatgcactttaacacatacaaggatcagttctgagaaatggaatttctggctgggcgccatggctcacgcctgtaatcctagcactttgggaggccaaggcgggtggattgcctgagctcaggagtttgagaccagcctgggcaacatggcgaaaccccggctctacaaaacacacaaaaattagctggacatggtggtgtgcacttgtaatcccagctacttggaaggctgaggtagaagaatcacttgaacccaggaggtggaggttgcagtgagccaagatcatgcccctaaattccagcctgggcaacagagagaggagactttgtctccaaaaaaaaaaagaaatggaatttctgagagtgtcatgttaagaaaagtagattggggtgggaatatgtccatatgggagcagtaccagcagcaggtaactatcagacctgatgtttttgtagagcacaaatttttcatatttgctgtttagtcctttcagtcactctgtgtaataaggcaaggattcttttaacaggtaagaaaattgatgtttcaagatgtcagttacatggtcatcattggttgagcatggactaaatcctaggtctccacctcttaactccaggcttttcctactacaacaagcattataacatgtatctctcattccagtcatttattgtaagagcacttatggctttgaggaaagggatgtattcaaattgaagggatcctgtgtaatttgtatattctgtagacagtgacttatctgcaagaaattcttcttactgaaggtagggtactttttgcttaagattcatatagtccatccaggatctatattctttcctactatattgtaaaagaattacaggatattttaggatgttgcaggcctgggaggggcttagtcaatcatttattcatttgcccattcatcagtatgtgtttttcagatattatgtgccaggcaccattctaaacctgtagatacagtgatgaagagatgtagtacttgccctcagggaactatctttacagtctagtggagggaatataaaattgatgattaggaataaatatgatatgaattatagtaaaagtatttacaagtggtaactattataagcttgttaaggaaaaagataattcatttgtctttgtatatctagaaccaaacataattctttgctctataaatgttgaatagaaacacttcctgaataggaacattggaagaataaatacatatgtcttcctgggaaaactggggaatgttttgcagaggttggagctgagacttgaaagattttattgatcagggccatatcagacaaaggaaacaagtgcggaggcttgaaaagttgtggtgtatttgaggagttacaagttattgtggtatatttgggggtttacaagttataagatgaagtgtgaggagatgcagatgaggctggaccccagtagtcaggaaccagaacacagtgtttatgtccaccaggacaagaagtttagattttgtcccacaggtagcgaagcaacactatagaatttatagtgctttcctcagctccagaacactctaaaaacgaagagaatcagaaaaccaagatgactaaatgatatatatgacctgacaatttgcaagacatttttctccttcaatcttcacagcagtcctgtgaagtataataattatctttaaactacaaatgagaaaagtagatacaagagagatttgtttattacattctttcattcattcagcaaatactcaggcactactctacccactggagatataatgataaaatgaatgcactttcctcatagaaagtgaggatgatatgtacatggtcaaagctaaaaagaagtgcactagatttgataatctgattcaaaatctcaggctttttctactatactacacagtctctaaagaccaatagaatcactgaatggtgaaaacattattaaattctttttgtttcagctatgtttgtagctctcataattagctttattttatcctgattgtccagctactaaattgtgatgtaaaggagggagctgataaaaggatgtctcatcctttgggaatcctggttctattctttcccttttaatttatctctccaagaatctgctcttaagtgttcattttaatgtgggacaaacaagtaactgtaaaatgtggtttttataatataaaaagattatatggggttagttttcttttttttctcctttctttctttttttttttttcttttttgagacagtctcattctgtcgcccaggctggagtatagtggtgtgatctttgcttactgcaacctccacctcccgggttcaagtgattctcttgcctcaacctctcgagtagctggaactataggcgcgggccaccactctcagctaatttttatgtttttagtagagatggggttttgccatgtgggccaggccagttttgaactcctgaccccaagtgatccacctgccttggcttcccaaagttctggggttacaggcgtgagccactgtgcccagcctggggttaattttcaaatttaattcagatgccacagaaaggttcctagcaatttagaaatggctgtaatagctgactatttattatatctgtagcagtaccttgatgataacactgtggaagctgtggcctttcggaagagtgcaaaggaattactgcaactagcagcgaaaacattaaacaaattgggagtaccattctggctgagcagtggaacttgtctaggtaaaattcttacgactttccatttgtctttctgtcattttgtcctctggctttagggattactgcttgagatgacaaaatatcagtgacatttgaagtgtcatgtgtatagacagaataaacatgagtgcatgcagcaaggatctattgatttccttaaagaaattaatttgagaattataaaaaagaatgttagaaaggccatggttgtgtttactcataattataaataatatgtataaaatgtatatcagaacatgtagactatacaatagtccccccttatccatggacaatacattccaagaccaccagtggatgcctgaaatctccgatagtactgaaccctatatacgctgctctttccctatacatacatatgatgtttaatttataaattaggcacagtaagagatgaacaacaataaataataaaatggaacaattttaacaatactataataaaagttgtgtgtgatctctgtctctcagagtatcttattttactgtactcactgttattcttcttacgatggtgtgagatgataaaatgcctacatgatgagatgaagggagatgaaggatgtaggcattgtgatgtagtgttagtctactattgaaaatttcctgggaaaatcaaggaatgtgtcacagaggctaaatctgagccctgaaagatttgatttaacacttctgaattgtttatttctggaatttaccatttaatatcttcagatcgtggttgtccacaggtaactgaaactgctaaaagcaaaaccacggatatggcaggactactatagttgattctcagataatccttaaattagcattttattatttctatcccaaagattgttattgcctttttttataattataaaaaaccctctatttctttacttatataccattcaaacagcttgcattgcaccaaatgtttctactgagaggaacattaaagacagtgtcataaggtcttccatcagcctttcctaggtcattggtagtatcactaactagacatcactgttcatctgacatggacatacagacttttctacagtccttaagcaggttgctattagaatctgtgagtgatttctgggtctctgtccactgtccattaaatcaaacttctttggaatttagaattatttagaatcttaaattttgttttgtgtttatttgttgtctcttgattatcatgatagttaattatagctgtatttgctttttctttatagtaaccatatctgtacaaaagttaattcaactcctgcctttatagggatagggttgccatccaatttattgttcaattcaagagacttgagagtgaaaggaagcaccattaataattatgttggtacaacaggcataaactgggatatacggttatcctatctattagcctttgttgaaaatttacatggttcttcctgccaaggagcttactactagaataagccaaaaaaaaaaaaaaagtacatctcacacatttatgtgatatttgctttaaggtttaattttttagaaacaagattgttttataatgtgtgtcatcaaagacacttcatagtcatttgacatgatttgttttgagttttcagtcccatggttttctgtctgatttaagggcacttatgagggagttgtattagatgatatttaagaaaacttttatttttaattgtttataattctttaatagaattattttagaattccaaacaatattatccaacagcaatgcctataaggataatcgcagtcatttatttacttttgaaataattggaatgaaatgattagaaagatcataggggagacccaggagtccttaataatattaaggtacatgttttatttcttcagaacagtgctatagcaatgaattagagcacatacgtggtaaacacttagaaatatcatttggcagtgtgttgaacattgaagctgctactgcttttctttttcatacggcccatcaggtggtcactgttgagagctgttaggttctacaaattattgctcaagaaaaatatattggttaagcaaaagaattaaatattttttgcatatcttaacagccccctctatcactagagattaatgattaaacattcttatcagcaacttagtgttattaaagctaatggtttattcagaaactaaaatatatcatgaaagtttttgaggaagctgagagtgctcagacagtaaaaatagatacatagatagatagaaggttcaggtgactgctcaaacaaagtcatttagtttgaggtttaatttttaaaaataattttggtgaagcatcttaagtctaatcctgtgaaataaaatccattctatagccccagccactcaagaggccaaggcaggaggatcacttgagccaggagtttgcgtacagcctgggcaatatagtgagactctgtctctttaaaaaaaaagaaaaaaaatccttgttacaaatataatttgttataataactaattttttccaaacctaaattttgttaaaaaaatttaatcttctttttaggatggtatcgacaatgcaacattattccttatagcaaagatgttgacctaggaatttttatacaagattacaaatctgatattattttagcatttcaggatgcaggacttccgctcaaacacaaatttgggaaggtcagtaacaaaagtcggcttcatttcataagtaacatatctcacttgtaaagtttacattaagcaactcagatatggttaagaatgctacatacataattttatcactcagtattgactaggatgagttcagcagaagcctgttaccacttgtaatttctgcactgtctaggcaaaagcaagaaaatctggctttctactgggttggtgcaaaagtaattgtggtttttgccattacttttgcaccaataatgataagaaaagaaggatcttgaactcttataggtgaatgtattgctattatattaggcaacaatgtaatataaaatcaatataatgtataatatacaattaataagtaagaatcccacccgccgtacctgattgtttctcatgagtcatttaatttacagatgtcattatcaacataaaatattccattgattgctaagggatagaaatatagaatcatttcaaataagtacttcaatttcttgtttatcttatatgtcctaggctatagcagtttgctcagacatcaactagggataggtcattggggcctagatgaaatctccctctagacaatttgattcctatgccctaagcccatgatctcttgcaatcatcttgttcttaatttgcttgtcccctcggaggtgttaccctacaagcaagtaaaaatatgtttagtcggctgggcgcggtggctcacgcctgtaatcccagcactatgggaggccgaggcgggtggatcatgaggtcaggagatcgagaccacagtgaaaccccatctctactaaaaatacaaaaaaaattagccgggcgcggtggcgggcgcctgtagtcccagctactggggaggctgaggcaggagaatggcgtgaacctgggaggcggagcttgcagtgagctgagatcgcgccactgcactccagcctgggcgacagagcaagactccgtcttaaaaaaaaaaaaaaaaagtttagtcaccagaaaattattttttccatcataaatagttattttatgttactaaaaaatataaataaaatattttactgaggtcaaagtcaaataacagagctctagttattcagcaaacatttaccaaacattcactataagtatggcactgtcctctgcacctgggagacaaagatgaataaatgatagttcttacccttgagaagctcactgtctaattgggagggggaaaggctgcataaataattctgtgatgagtgctgtggcggacagatgtaccaagtccaatgggaacgtaattatttgtatgataagttttctttagggaaatgttctcagaattatttatttttttaccttaacttttatttttttcttttttccatgtgtgtagtataatgagctagactatttatgtatgtggctatgaggaatgccactttacttaagtacttattgattgttatgagagacttatttcctgatagttttatttggattattaaaggaaataatatttctttggttcttttccttttttagtcagaaagctgctctggaataggatatttctattttttttctgcagtgataattaccataagtcatttactctgagttatcatcaattgtaagaaacattattttagatgcagttaagaaattaaatgatatgttactgatgcatcccaatttcagaggtgccttaacttgaaaaaatgtgcatcttagaatgaatactctatgtatgtaaaacttaagaatctgtttctttatttttattttttaaaaaaaggtttttaaaaatgtatttcctttgtttcagtgtgtgaaggttttcatcttccccataggtagaagacagcttggaactatccttccagggaaaagatgatgtaaaacttgatgtttttttcttctatgaagaaactgatcacatgtggaatggaggcactcaggccaaaacaggaaaaaaattcaagtatgaatcaaataagtacttatttataaaggtactacagaaataatttcaggaggtagaaataaagaagtaactgaaaagaaaaccaaaaatctctttcaagactccattattagctaacactttcttagcttacccatagagtccagttatgcctgtgaagtaagaatacctgtaaggacggtttgtgaggaggaagtgtccctgggtttgtcagtccaagttgatgatacagctggtctattctcagttctgagagagagaatgagaatgagaacctgaagagcatgggttttagagtcaggctgacctgggaaaccttagctccaccctaatttgtggcctttagattttctgaacgtaatcattttatccattacattgagtaatactactgtgtgtcaggcactattctgaacgttttacatatattaacccatctagtcctcaaaataaccttcagaggtagatattctgaagccagtgtgattgctgttgaatctcagctctttattttaccagctatattaccttgagcaagttatttaacctctctgcctaagtttcctcagctgtaaaatggaaattatagtagaaattgccacatagagtggttttaaggattaaaagaattaatacacaaaaagagctttgaggtgtgtcaggaggtcctgggtgctaagtaattattacctgctgttactaatactactatagtagtagtagtagtagtagtagtagtagtagtagtagtagtagtaaagaaaactatttctcttcttattctcatgagaaatttacagattagagacatgtataattatctcaatattaaactgttacatctattcttagagaacttctgtaagagtgtcaccttttttctaagaaagataatttctagagccagtattagagtcctgttattcttaaattactttctaaggcttgaattttttctctcactgacatgatccgaaacctgcaaacctcaaaagaactgttcatttccaactactacatttctggagagaaaaagcttctttcattctgctttaacagctctttatagtagcagtgtttgggaagtgtgaagtgttctgattatttaacaagagaaatgagcagtgatagaactgtctggacagatggtgtgagtcccagattttctatcatgttactgtgaccttaaaaggcagagaaaagaacaggagatggctgagtagagtagtttctttggaagattcccccagccatatgccatttttattcttttcggcactatttactttaagaaaatgtagtatttttaacactactattccttggggatgaagaaaaacaaaatgtttaaagctagttcaagggtctttttaatgtattttaaatttttgaatagattatacattacatagttaaaatattcaaagaatataaaggatgtgtatgaaaagtaaacctttctccatcctctgcccctcattttcccgtttctagttgccctttacagagataaccatgattactcatttcttatgtatcctttccgagacaaacatatgctcgtatacatatagtatttacgttcatctctccccctttacacaaatagtattatggcatattacacactgtctgtatgttcttttcctcacatagctatgtatcttggaaaatgttccaaatgagtatgtatagaaatagctgcattttattccattgtatggcaataccataatttattcaaccaattccctattgatgaatatttaggctgtttccagtagtttactgtgaccctcagttctgcagtcactatctctgtccatatgtctttatgcacacgtgtgaaaccctgtgcaggataaagtattagactcaaattttggggctaaagggaatataagcatatttcaattttgatagatattgccaaattgccctccaaagatgtttccccaatttatattctcaaccacatggtttgagaatatgggtttattttttaaaagtgcactatctgtaaagagaggtaaacttgctcaatatttgccactaatcagtaacttatcaattacttgtaatcagtaactaaatctaccatacaccaaatataattgggagcacattagaattactgttcaaactagtcagtataatgtatcatctcaccttctccaaaggtctttttgtctttataataacctattttttattttatatatagttcattctgagaaaagcttaataatatagaatgcttactattttttaaaaggcagaagaggaactcaagaaggaagaaaaaagattttctttctaaactactctgcaggactatagaatgatatctttggtcctaagatttaacagtatattaagagtaataaaaaagataaagcttccaggatatctgctacctatcaggcactgtgataggtagttcatatatatatttatatatataatctggttaatcctcatactatccctgtgggttcggtattctcacctccagttagacattaggaaactaaagctcagagtgaagtaacttactcgaggcttttgactgttaatggcaagatcaagatttaatgccagacctgtttgacccctaagcctaaatgctttcttcttagagttaataggttaagtgagttagtacatctaatgcatttagaacagtacctggcacattgtaagtattgtgtaagtagtagctactgtcagtactgtattattattattactgttactgttattataattaccatgctgcactggcataaggtatggtactttcagcacagtggtaaattggattagtaattttctaggcaggcatattttcttcctccatctcatgatactcattccgtctttagttctcagtctttcacttctttataggaagcccttcttttacctgaaatccaaattccatttaaaaatattgactggattctttattctgtttttctccagcatccaaatctgccagtaataaaagtgatgaatataataactatgcctccagaatgtgaagttcttaattcaacttcacatttcctaaagatgctgcctagatttatttggtttgcttctttccttcccattttgaatcaactggtatgggtagaagccagaagtttgaaaggtaataataatagttaactttattgaatacttactataagccaatcaatatgccaagcttttatatgtgttatcttatttaatcctcacaataagtttataaaggagattttatcatcatcacctttattttatggatgagcaaattaaggcagacctgagtcagacctaggtgtgtatcacttcagagcccatgttcttactaagttagtgtcaccatgatctctatcatgttgttaataccccttccatgaaaacattatcagggtaatacaactactgctacatcctctaataggaaatctactccttgggctagtagtgggttccttataccttctgacagttgcagcttctgattattggatagatcttcagaaaattcagattcatcctctgtggaccacactcccatccaggtgtggatcctgtgtaatttatcacttcatttctgtaaaatgtatttaccaactgctatgtgctaaggatactgatgtgactgtaacttagtttctgctcttaaggatctcatgatctagaccatgagacatgttaaagtactctgatagcagtactgtaatcaaatatgtataatctatagttgaagtaccaaatcagccatatctagaaacaatggcaaagaagtgtggcttacaagtagagaaatttgttaggtagacttaggagaaatgtgggaaaagtcctaaaaatagatttatttaatgatttttaaattagtttatttctattttttaatttaaaaaattctgtgggcatctgtatacgtaaagtaaaaactttaaggggttgtttccttcaatagatacccaaaggtagaattattaagtcaaaagatatgagccttttaaagagttttgatacatattgccaggttgcattcctaaaaagttatgcaaaattttatacagtcaccaacataaatgagcatgcttagtttgctatatcatactgagtgttgcattgtactcacagtcattcatgactcccctgatagtttctttgagtaacttttcttttcactttcttcttattatcccaaggtatcttctatcataaaaccaggtcagtcattagtagcaagttaccaacaattattacctttctggccaggcacagtggctcatgcctttaatcccagcacttcgggaggccaaggtgagagaactgcttgagcacgggagtttgagaccagcttgggcaacagaataaaccctggctttatataaaaattttttaaaaattacccaggcatggtggcatgtgtctgtggtcccaactacatgggaggctgagacggtaggatcacctgagcccaggaaatctaggctgcagtgagccacatttgcaccactgtactccagcctaggtgacagagcaaaaccaaaaaaaaaaaaaaaaaagaaaaagaatcattacttttctcttaactattcctaacatcaactggcttttagtatacatctaaccccctccctgtcgtcccagtctccctttcaaaatccagctttaaaatattacagtgcattttgaatgtcttgttataggtgtttgttagacacttattatatagagacttttatatttaagctttatacaagtgtgattttagctgagtgagcccaggaattagaagacctgaattcaaatctgagttctatttttttgtgtcatataaccttctgagcttcagatttctcctcttaaaatgggaataacactgcgtacttcacagggtataatgcttcgattaaatactgtgtagttacctgattcagtgcttggcacgtaatagattcacaactgtttgctaattctaaattaggcaggcagagcatagaagtctgattaggaagattcattgctaggtagcaattagaaaaaaaatcacatggtagtgaattaaagcctaccaaatgttacagagatgaatataaacttgtattacatataactgcagagagatatagtttataggaaaaaaacgtgtaaagagtactgattctttggaagttttctctgaaagtgagggttgagtcagcacaatttgaatgaatattgttgaatggggaattgctattaagttagatttggttgcctctaggaaaagagacttagggccatgtaaagatgatatttggcaatgctggtaaactggttaattgccagaaagtcttgttgtttggtggggtttttgactggatgtaataaagaatctctctcataaggcttttggtggagaatgtagtaagacacaagtcctgttgaggaatattgttcttgctagtgtgtgtaggcatggaaagctggtatagtgaggaagacttgggtggttgaggacctatgctaaacaggaggtgaccggaagaaatggtaaaagaacttagcaccatgcctggctgtgaacaaggggagtccaagaaaactaagtgtccaaaataacatataagtttataatcttagagctagagaaaaattaggaaatagtggattattatgtttttaattgaagtgtaacatacatacagaaaactatacaaagcaaatgtatggctccaagaattatcaaatgaacaaatgtgtaaccagcaccccagtaaaaaaaaaaaagtatttgtcagcaccccagaaacccatatcattttccctcacgatcatagctcctgtttcccacaaggtaacagcgatgctaacttctggtattacagtttagttttacctgtttttttattttatataaactagatggtatgttgctggcttcttttcattcaacattgtatttgtgagaaccatccatatttttacatgttgtggctcttcattttctttgctgtgtagtagttaattgtatgaatatatcacaaatatttattaagtccactaacccaaatagtagttggatatttgggttgttttcaatttggggctattataggtgatgctgtagtgaacatttctgtacgtgtcttttagtgccctggtacatgcttatcttagtttgctcaggctgctataacaaaataccataaactgggtggctcataaacagaaatttatttctcaggtttctggatgatgggaagtccaagataaaggtaccagcatggtcaggttctggtgaaggccctcctcctggttgtagactgctgatttctcctcacatggtgaaaggagcaatcaagctcccttaggccttttttataaagtttccattcctgagtgtttcaccctcatgacctaatcacctcccaaaggtcttacctcttaataccgtcaccttggaggttaggatttcagcatatgaattttgaggagacataaacattcaaaccacagcaatgtttttctattgggtttacacataaagtttgggattgcttggtcgtagggtattcttgtgttcaatttcagcatattgtttacaaatagttttccaaagttattccaagttatattccagtatgttatagaactttccattgccccacatttttaccaacgcttggcattgtcagacttcttaatttgtaaccattttggtaggtgtgtagtgttaccaaattgtagtttagatttctttttccttgacttaatgaaggcaagttcatgtttactgaccatttggatatcctcttttgtgagttactggctgagtatcttgtcagggtttttttctgagttgtctgtctttttcttacttgaaaatatcttctcccaatttgtgcctttcttctttattcttttttttttttttttgagacagagttgtcacccaggctggagtgcagtggtgtgatcttggctcactgcaacctccacctcccaggttcaagcagttctcatgcctcagcctcctaagtagctggaattacaggcacattccatcatacccagctatttttgtatttttagtagagatggggtttcaccatgttgcccaggctagtctcaaacccctgacctcaagtaatctgccctcctcggcctcctaaagtgattggaatacaggcatgagctgccatgccagcccttctttactctcttaatagtgatttttggtgaataaaaagttattttaatgtagttcagtttatctattatgggtagtattatcgtgtcctgtttaagaaatctttccctatcccaagataatgaagctattcctcttgtactaccttctagaaactttattgttctatatgtaatatgaagtaaagatcaaatttagactctatactttatttggattcactagcttttctaccaatgtgctttttctgttctaagatctaatccaggataccacattgcatttagacactctaccttttgaaactttattttggtccaagattttaagcttgtcactagtaatactagattatcatacatcactgcatgtcccacttctgctcattcaagggccttacgttgctgtctgtttgaactagcttcttggtaccttgatctggaaataatcttctcttcctctgcatttctatagattttctttttctttccctctctcatgctttattggagtacttttgctgatttgtctgtcctttctatgtgatagataaaatcaggcctggtacatgtttggctaagtgagacctgagccctacatgaaactaagtcagatcctcttaagtgtagtctacactgttttgttaagatgataaggtgacactgggttgatgacttgatccaacctaacgtggttggagaattaaaactatagaattaagttagcctagttgttttcaatcattctgcttcacaagaagttaaaagactagaggtatttgttgaatcctcactcattgtctctctcagcttcacagattgatactgtgctcctacagttgtaactccaagaaacacatttgtctttttagtacttacagctgtgaagctaaaggcaaatttgaataatttctttaaatgagtgtatttaaaacattgacttttctatgaatgatctcgtattttctgctctgtttatgcgtttatattttacaacatacagattatgtcttaggtctccttaattatacctccaaaccgctagtaagtagcaggtgcaaaattgaggaattgagggaagaactttgaatgcatgttatatgggaattgtatacttatacaatatgtagaagtagcagttatttatatagcaagctttgtttatttttttaagagaagattgcctccagatgaataagcagtaaatctttcatttatgtgaagtaagttatgttttttaaaactgtcgaatagtttgttgtttgaacataattctataagatattatataggatagtattctaagagaaataaaagcatattttcagtaaaagacttgtacacagatgtttatagcagtcttactcatactagcaagaaatggaagcaacccaaatgcccatcttctggtgactagttataaaattatgatatattcaaacaatggactaccactgaacaatgaatagcaatgaactactgataaatgcaataacatggatgaatttctaaaacatgatgctaagtgaaagaagtcagataggaagagtatatactgtgtacttgctgttatttgaaattgcacaggaaaaaccaaccaacagtgtaataagattagtggttgcctaggaccagggtgggttgattgcttgactgacaaggggcacagggaactttggacgaggggttggtagaaatgttctatatcttgattattgtggttacacaggtatatacatttatcaaaactcatcacttaagatagatgcatttcattatacttaacttatacctcaaaagaagttaccttaaaagtttaagactgggcacagtaacccatcagcatttggggaagacccggtgagaggatcacttgagcccaggagttcaagataagcctgggcaacatagggagaccccatgtctacaaaaaaataaaaactaaacttaaaaaaggttaaaaagataaaaaacagtttgtgacttagaaaactgatgctaagagaaaaagggtctgagatcacaggttgaaacagagggatatatgggaccaaaagcaatgaatttggtcagggcagacctaattgcaatgataaactttgagactttcacatatgattaaacaaattgtgtaatctgatagtaaagccttttgtattgagtatgaaaattgaaactataatttaattcttttaaaaattatccattatatacaaggagaaatcctgtaaaagtctgaaggaaagcaagcacaactggagtctaactggttgttgaagtgctattagatctagttctgggaagttatgtggttatgtagagctatagagtttttggaagttatgtagttatgtcccaaggctttgtcctctggcattgaggaaaactttagtacttgttttaaattgatagtttttaatgtagtcattatgtatatgtatatatacatgctgctctaaagacacatgcacacatatgtttattgtggcactattcacaatagcaaagacttggaaccaacccaaatgtccatcaatgatagaatggattaagaaaatgtggcacatatacaccatggaatactatgcagccataaaaaaggacaagttcatgtcctttgtagggacatggatgaagctggaaaccatcattctcagcaaactatcgcaaggacagaaaaccaaacactgcatgttctcacttataggtgggaattgaacaatgagaacacttggacacagggtggggaacatcacacaatcacacactggggcctgtcgtggggtagggggagaggggagggatagcattaggagatatacctaatgtaaaggacgagttaatgggtgcagcacaccaacatggcacatgtatacatatgtaacaaactggcacgttgtgcacatgtaccctagaacttcaagtataattaaaaaaaagaaaaaagaaaaatctgggatggctggctttagtttatactcagctgtgttacattaactctctcaaaacaaaatgcggtagataactaggtcaataaatgtgatcattagttaaaatgtgaaaatgataaaattttctagaaaaataaataccaaaatcaactcaaaaagatctagataacctatattcattcgagacagtgaattagtaatccgaaatcctcctttctccctcttttccctaccagagtatactaaaacctagaaagtttgctgcaaagtttcactgtgccttcacagaacagattatccctgtattgtacagcttatttcaggcaatagaaaaagagaaaactaaataactattttatgagagtgatagcaaaagtggacatgaacaataccaaaaaaaattttttaagggaaattactgtctcagtgaatacagtgaaaaaatactaaatgaatagaattttgtagtgtgtacatattaatgtaattctctgtattaaaggattaaaagattaaaggaacaaaaacactatgattgttttaatagatgacattaacattttttgataaattttataattaaccaaaaggagagagacctcttagcaaatttggattaaaaggaatctaggctgggcatggtggctcacatctgtaatctcaacatttagggaggccgaggcaggtggatcacttgaggcaggaggtcaagaccagactggccaacatggtgataccccaactctactaaaaatagaaaaattagccaggtgtggtggtgtgcgcctgtaatcccagccactccagaggctgaggcaggagaattgcttgaacccgagaggtggaggttgcagtgagctgaggtcgcaccactgtactccagcctgggtgacaaagcgagactgtctcaaacaaacaaacaaaaaaatctgaaatttcttttacctaataaagagaatataacaaaaacctagagtgagcaatcatgtttaatgataaaactttagaagcccttccattaaaatcagaaaaacgttaggaatgtgtgctagccctgcttctattaaacaatatgctagagggcttaggcactggaataacatgagaagaaattaaaagttaaaagaagagaaaaaattggtagtgagaataaaccatttatgttttgtaggaaattcttgtcaagaatggctctactgctccaattctagagttaatgtaaaacttaagtttaaaaaagccaggttcgggaacaggcaacctacaaaatgggagaaaattttcgcaacctactcatctgacaaagggctaatatccacaatctacaatgaactcaaacaaatttacaagaaaaaaacaaacaaccccatcaaaaagtgggtgaaggacatgaacagacacttctcaaaaaaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgactcctcagggatctagaactggaaataccatttgacccagccatcccattactgggtatatacccaaaggactataaatcatgctgctataaagacacatgcacccgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaactggaaatcatcattctcagtaaactatcgcaagaacaaaaaaccaaacaccgcgtattctcactcataggtgggaactgaacaatgagatcacatggacacaggaaggggaatatcacactctggggactgttgtggggtggtgggaggcgggagggatagcatcgggagatatacctaatgctagatgacgagttagtgggtgcagtgcaccagcatggcacatgtatacatatgtaactaacctgcacaatgtgcacatgtaccctaaaacttaaaagtataataaaaaaaaaaatatatatatataaaaataaaaaataaaataaataaaaaagccaggttcagttatagttgatgttgtctctatctctctgagcctagtaataataaaacactgttggttctgggatagtggaagaacttccttttcatttagcagttgtattcataggttgtgcttaaactgattgtaattaaactgatgaaattatccaactaccaccaagtagttgtatagattttaaggatatctgtgagggaaaaaaatggtctattccaattattgaactactgttttatgtaaaaataatatgaaataaaagtggtatgaaatagaaaatggatggaaggatttttttgtggtaataatatctcttaaacttatattctgatttagggttgccttagtctgcatttaaacctgttcacatgctggatccaatcccagggccttaaagtacaaactgcttagccgaacttagtcttagctttaaaagccgaggtaacattgcagacccatggtgtattttagtcttagtcattatttactggtagcctggacagagtgcatggcatgtgctgttctgtgtcattcactctccttcacttcctccctacaatcctattttataatcagtttttacattttattgtttgtttatctttcctcttaggaagctgggattttctttttgctgaatggattgaaaaataattggggaaaaggaaaccacaaagagtttagagaggtttctgttaagtacaaaaattaacatttgagttaaattgtcttcgaattattttcacattatttatatatttaaaatgttttggctttgctcataaattcttcattgttcaaaacattgcttttgtaaaatttgtagtattccctttcaccttatctatcctgtatctattattatttttccctctttcagctttttgatgagaccacaaaggataatacttagaggagtttcctggcctgtattacaagatagaccatgagttctgcctcaattcaacttcattgtgtcaacttgataggataagacaggtggacattctgctaaccagcatctgattagagagggtggaggctggtgatggattgttaggtgtgatgacaaaataagcaattccgttaacatgagtgtgcagagtaaaattgggaccagcagatggtggggctaagctgtatcttatttctcagctatgagattttccgtggccgccttttcacagtagccagctgggattgtccattaactgggtttgagtaaaagggagttgttgctttctttagaatttgttcagcctctccttttcatgtatggctttatgttcatttggtagtaaaacacgatattcaaaggcagaatatatgagaactgaccttttcttggagaacatcccagttagatcccatttccacaatatgattacactttgaaatctggcttttccctgttctttctttaatcctctgatattttaaattcctgtaatctctgctattgccactttaaacctcattactgaaagttcttcccacactgaaacacttctcagaaaaaaaatgcagaatatagagcagagctataatataaacttaaacagacctgctagttttagctttcttttctagtatacataatttagtttacttgatccaaaggatctttaagaaacatgttttggtttaatttctgtttgttttgtttttttttttgagacagggtctcactgtgtcacccgggctggagtgcagtggcgtgatcttggctcactgcaacctccacctccagggttcaagtgattctcctgcctcagcctcctgagtagctgggacgacaggagtgtgccaccacacccagctaatttctttgtatttttagtagagatggggtttcgtcatgttggccgggctggtctcgaacttctggcctcaagtgatctacctgcctcagcctcccaaagagctgggattacaggcgggagccaccacgaccggcctggtttaatttctaaaacttacctactaatcgacttagttctgcaataaatatagttacaatcattataactagtattccttgggctggtttaaagatgttctttagcatttgagatgaaaggcagaaaccacaggtaggatcatgtaagctatggaaccaaaggaaaagcctggaaatgcaacttggagtcctgcttactctgtatccttggaaaatccagattgtgaaagaaaagaaaaagatcattttcatccatcttttgacagctttctactttgacacttctttcctctacagttccaacagaaagcccaaggctgactttgatttgcctgacttgggtatgttcccatccctgcctcaatcattaacttactggcctgagtcttagtgatggggtcagcctctcctcaatcctatgagcttggaacaggaaaggaaaattggagaagaggaaagggattctggacagtcaaaaataattaaatatccactctcttcccaaagctgtgtaatgggagagcactgtccttcagccaataatgcactagcagctagattccttagctagaccttcttccactgttgaagcctaatccctctgttttgctgcagatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaataacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgagatatcttgtatttatttttgagacttgcagtagaaataacagacactaacattcacagacaatctgataaaatagtaatcttgccaccagtacagtatttctaaaattcaactatggggaccctagtagtctgcacacatatacctgggtatccaaaagttctcagagataaaacctgccagccaaagaccaccaggaacacacctgtaatcaaacaaagttaggtttattagcttgttgtagtaagaggaaacagccaccatggggaatcataacatatttcagggagaaggaactagaaaggtcttttataggctttgagctgatgtcaaaattgttaaaagtaactgtggtggagtggaaataacacaggacatggagtaaaaagttctagtttgtctgaatccaacagtgccatgaccagtaggattcatttcaggtgtacatggctagttcagccttaaaacagtcaatgtaatgcactgtatcaacaaagtaaagaaaatcatatcaatagacacaaaaagagtctgacaaaatctaaccctcattcatgagaaaaactcagtaagttaaaaatagaagataattacctcaacttgatgaagaacatctaaaaccaacaaacaaaaacctgtatgttttaatagcaaaaaactgaatgtttttcctctaagattaggaacaaggcaaggatgtctgctttcatcactcttattcagcctaatactagaagtgctagtcactgaagtaaggcaaaaaataaataaataaataaataaataaaagacatgcagattgcaaagaaatttttaaaaacttttcatttgcagatgacatgattgtttacatagataataccaaggaatgtattttaaaacaagcaaacacctggagctaataagtgagttttagtgcagtcacagtatacaagatcaagaccaatacccccaaatcaattgcatttctatattctaacagcaaacatgagaacaaaaacacagtactatttaaagtcaccctgaagaaaatgaagtacttaggtataaaattaacaaattatatacaagatttgtatgttaaaaatgctgatgaaatcaaagacctcaataaatggagatgcataccatgttcatggattggaaaacaacacagtaaagatgtcagttctactcaacttgatcaataggtttaatgcaattcctatcaaaatctcagcaaggtttttaatagacatagacaaacttattttaaaatgtatgtgataagtttatttctctagaatatctcaagtaatctttataaggaaaaagtagcagaaagatttggtatcagaagacctaagttcattcttgcacttcaatagataccacatctgatcttataaggtagatgttatttccccttgttttgcagatgaggaagctgcaatttagaggtaacacagatcttaaatccttgttttctgacttgaaatccagtggctactcactctgccaattctacttaactgttgatctgaaaaaaaaaatttttttttaattattacttaaaaccagcctctgatactgaaagtgagaaggatcactctacccaatattaaggtttattatatagctatagtaattgttatgggctgaattgtgttcccttatatccctcaaaattcatatgtttcagtcctgacccctagtatctcagaatgtgactgtgtttggagatagagcctttaaacagctaattaaggtaaaatgaggtcatatgggtgattcccaattcactggtgactagagtccttagaagagcttaggacaaggagaggcacagaaggaggaccatgtagagacatagagagaagatggtcacctacaagccaaggagaggatccctcagaagaaaccagccctgccaacaccttagccttggacttctagtttcctgaattgtgagaaaatagatttctattgttgaaaccactcagctgtggtactttgttatagcagccctagcaatctaatgcagtagtcaagacagtatggtattggtaaaaggatacgcacatagatcagtgaaacaaaataaaccagaaattgacccatatgagtatgtccaactgattttttacaaaagtgcaaaagcaattcagtggaggaaagacagtctgtttttttttattttttcttttatagacagggtctcactgtgtcacccaggctggagtgctgtggcacaatcattgttcactatcacctcgagctccatgggctcaagcagtcctcccgcttcagcctcccaagtagccaggactacaggtgtatgccaccacaccccgctattattttattttattttgttgttgacacggagtctcattatgttgcctaggctgctctcaaactcctggccccaagctgtcctccacctaggcctcccaaagtgctgagattgcaggcatgagcctccacacccagccaagatagacctttcaacaaatggtgctagagcaattggacattcataggcaaaaacaaactcaacttgaatgaacctcacactttgtacaaaaatgtacttaaaatggatcacatgcttaaatgtaaaatataaaactgtaaacccttttgggaaaaaaataggagaaaatcttcatgatctagggttatgcaaagcattctttctttgacttgacacaaaaatcacaatgtataaaagaaaaatggataaattggacttcatcaaaattaaaaattgctgctctgcaaaagcccacatgtaggggctgaaaagtccagctacagactaggaggaaaatatttgcaaactgtgtatcttgacaaaggactagtacctggaatatataaagaacctgaacactcagcagttttttgaaaaattcaattagaaaatgggcaaagacatagacagacatttcattgaagaggatatacagatggctaagaagcacatgaaaaagatgttcaacatcattagccagggaaatgcaaattacaaccacatgagatatcattgcatacctattagaatggctaaaattaaaaataatgataacaccaaatctgctagttgtttcttttatgattttcttttttaatgtgtactgtgcaccgttgtttttactgtgattttactaaagagtgtccttaaacattttacaaacattcgtaataggtaacactcttcataataaaaaggaataaccttgtctgaatttttggaagacaggtttttaggtttttgtttttgcctttcctccaattctttgttgatttactttgtcattttaataaccctctttttatgatttattttctctttattattcctttgtgttcttcgagttttctttaattagatttatcagtaaagccctttagcagctagtactattgttcatagttctctgcaactttatcagtagggcttttacaacctaaaacttctaaattcaaattttttcttccgttaatctcaataatttggaggatgttttctagtgaattttgcaggaaagttaattgagtggccaatgttctgaaaatgctatactaccaaatgtctttcagatgacttagaagatgacagtctcatagttggagagtggaagagtttgctttggagcccaaactgggcaaccgtctaatccagccagatcctgcttagcagaaaaagcaaatttctggcatgtgacctcataaacaagggaaaagctctccttttaggatgatgtcttctcttaccatctatttccccatgtcttagtggaaggagccatctttttccccatgtcttagtggaagaccagagaattatctagagcatggtgtgatgctgcaaatgatgtatctgtagccactagccacatgactactgaatatttgaaatgtggcaagtgtaactgaataactaaatatttactctaattttaattaatttaaaactagtagctagcatattgcagatctatagggttttatgggatcagcaagggttttggatttgtcgactggaatccagagccctccacagcctagttcggtgatcttgggctagctattcaacttctgagttctgaattttttttcaactaatggggctaaattaatacctacctttaaaggttattaaaagaattgtaagaaattgtaagaaatctgcagtgtctggcacactgctcagtacatggtagatgtacagtacatggtagatggtcagtgaatgataactattgttaatattatgttcacatggttttacatctgcctttggcataaatcctatcagcttgtattttcctgataatctcatgtcacaatttttctgtaagattggtatttcagatccctcctgggtagaggccctatcctgagcactggtgttaagaagcgaccctggcctcaagagcacaggtacaaggcctgttctttggggagagagtatgtggggttaaaacataacacttaatggaattgagtctcaaggaccaggcttaggcaaagagacaaaagtcctagactttgtagatggctgtctgagcacccgagtctagaaaaagctccaggaaggaggacagggactgggtaatgaggttcagctgagtcttaggacttgtagaacagaaaatttgaataaatgaagaaagaaaacatttctgagtaagaggagtcagtaaattcacagaataggctttatgggacagtgaataagaccatctgccatatggataaatagtgaaagatacaactggaaaagtgggcaaggaacagactgcaggaaatgaggggactgaatattctgctatgaagtttggatatgagagagaaaagttttgaataggagcatcatgccttcaataaacacttctggcctggttactactcaccggatctgtcctaagggtgaggttcgacaaacattcaggaaaccccttcaaggatagagcagggatttaggagaattcagattcaccgagactgatcctagagaccctagaaccctgatagttgcagggacagaggatagaaacttagccagatgggcataggaccctagtggtttaagtaaggtcactcctaggaattatcagtcagtgctagacatgggcacaagcagtccagagtcaggaagcgcttgagaccaagtgagcaggggacagtttggtgatggtctgggaagtggagctcaagagcagcattgcaagccacagaaagggagtgtgataggacaaggcagggtcttatccagagggttccagggaattagaataggcctttgagagccatgacaaaagctcattttgatgaattgggccaggagagccagtgagattctaggctgtggagaagacatgaaggcaatttttggaagacagcagaggaatggagaccaatggtcagtgctagacctgggcaccacaatacaggcaatgtgagggatgtgggaaagaggctggagccatttctatacctgtcgcttcagttagaaactaggacaggatagacttttcacatgatgatgccacagggcataactgaaagctagggagaacagaagccaggaagggagataagcttagtgaggattttaaattctgggtcttaacttagtcctcatctccctattggctgttcacctctggagactatgggctccaaggcgtaaaaagtaattgctctagttgtactaggagagtagtttgtgctaacaactgaccttctaccctacatttacctctacgagaaggcttgggactccagtggctttctggaccataataaaaacaaggccattttgtcttcactcttcctcgtttccacccagacagattctgctgcctggataagacagctcaggcagggaccgctggctgacgaggcctgggcaagcctataatcccagcagagagcacagggacaatgagtgggaggggagccagtcacaggttgtatcttattaaaccagtctgcatcagctacagtgtacgtctcagaaacagatctgaaaccccagctggtaacctagttagttcaggcagcgtgtaaagaaaccatatccccgccagctaaaaagatgcatgtgctcctgggtagtgcagaagtatctgttatgaaaagcaaaggtaacaacagttgtgggaaattaaggtttcctctgtgtgtttttttattggttgcatttgaggtgacatcctctaattttcctaagcacagtggggcctcctggaaacatctgctggatttgaggagtaaggggatgcttccctcatcctccgggtgtgtgtatttggtttgggatttgtcaggctgggtagctgagggctctgggcagcttgacctggcagatttcccccacttgcctgaaaagcagcctagggggcagaggcccctccccagctcagccctgcaccttcactctaagcgcctggagctggggccttttatttcaagtctggtccccagggagcagagtgggaaatgaggacagctgataagcctgacagtattgactttatggggagtattcaatgaatttactttctgcaagtaggctgcactcttatctgctgcccacagagcatctaaatcctcatctaggagacccatcgatgagtcacgtcccttacacaaagaccagagaataaagaaggaaaggggaattccatccacccctttcttttctccagtacctggtcctgcccaccccaacacctcccctcgctttccccactgcgtttgggtttattggctgaaaacagaagcactcgcagctccaggcctacggagtcaaggccaagccagcctggtcttgagaggtcgacagctgggcacacccagggctgtatgtccctctaactggtaactatgggaagctcacttgaagtagttgtgtgcaccgctttatgctgcaacagtcaacatttgctctggacagaaataccctcacggctttaacgccaggtgtcttggagataaaatgtgggtgtgtgggcgttaccaaggggtcctgggtctggggtgctggagagtggaagttacatgtaagagaaaggcctgatgcgcaagagaagtttttctttcccctctggcttctccctcatccagtcctgggctctgtttcaaatattagaaaaaaataaaagcttcttagcagcacagaaagtaagtaacttgaaggagagaggtgggagccagaatgctggattgggcagatgaaaggaaaaaactgaaagtgccctttggcagaaattagagtcatgtgtttaggttcaccatctagcttttagacagagttttttggtagtaaaaataaaatgaaatctctgtattgagtaactttggtttcattagatgacttagcaccattttttagtatttattccaaagcactaactttttatacattagctcactgaatcttcacaataacccatgagatgatatttctgagttatagctgagaaaactgagtctgggataagttaagtaacttgctcaggatgacaactataatagcatcaaagcaaggatgcaaacaccagccagtctgcctccaaagccaagtcaaaggtcttctcttagctgccacactaaactgcctgctatttggcatttttcaatatcttatctcagtccatggccaatcaatgagtatttattattcccacgttattggaaacaggcttagcaggataccactacctgtccagggccacaaaaccagtgtatatcagagactctggtccacagagtctagcatctctcctaaaggtctcgccctgctggtgcattgcccactgctcaggcagagatgtgggccacatcagtgcgtttctcccttccaggtgccctggtttcctgtgtcacctgctttcacctgctgctacttgcttgataattttcttagttgagggaggttggaatgagggaggcaggaagagcctgggaggatgtgagctgttcactaagttgctctgtgggccctgtgaatggagtagtatgaacatccatgagaatctgcagcttctgcaggctctggaaagatgcctgtctaaaaaccgctagtaaaactgagtcagccatatgcttgtttctttaagtatatgttttagtatttgacttctttgggagaaatacattttttgtttaggataacttgttatgtaactttataattaatatttataattgttcatattgaataagaaaaccttggtgaaatgcctagcatgacacttggcacttaaggttgaataattggggcagaggattaagttcctgggccagagttgatgcttaatgtcaacccctcctcaggtcaagccatcatctcctcttgcctgcattgctttcacggcatcctaactagtccccccaccccacctcttctcttgcccctctccatgtagcagacagaatattctctccttcttaaaaaacaaccaggttgggcgccgtggctcacgcctgtaatcccagcactttgggaggccgaggcgggcagatcacgaggtcaggagatcgagaccaccctgactaacacggtgaaaacccatctctactaaaaatacaaaaaattagccgggcgtggtggcgggcgcctgtagtcccagctactcgggaggctgaggcaggagaatggtgtgaacccgggaggtggagcttgcagtgagccaagatcgcaccactgcactccagcctgggtgacagagtgagactccatcttaaaaaaaaaaaaaaaaaaaaaaccattctatggccttggaaacatttacctcacagaagcaagctatgtgtctgctgacagaaggcagggcaggctggaggcagctgtctgaagaaataagagctttcttgcattcattcaacaaatatctgatcaagcagcttttatgggcagtgagcacaattcctggggtctagtgatgaaggaaactaagtctttgtcctcatgaagtttataatgtagcaagtaaactagaatgagatttgttttgcagaattcaacatgaaggtggggtctcctttaaagaaaaaaaagagagagttaaaataattgaaatttatcaaaaagagtttcttatgaccaagagtcactcccacgcaccccaaattaagtataaagaatgggcacagtttactttggaaaatgcaaatttaaaagcaggggttgtaatattaatataataaaatgaaattcatggtaaaaagcaagatttttatattgatataggctacaatcctctaagtcaataaaaaaacttccttgagtctttatgcttcaaaagcaatgcagcaaaaaatgtaaagatctaaagcaaacactcccggaaaaacaaaaagaacagaaacaaaatagtaaagggagattttcacacagtgctctcttgaatagatcaaatagacaaaaacttccaagaatacagatttatttaatggatgtgtaaaaagacattttaccattcaaacagagaatatacctccttttctagtacctgtgaaacatttataaaagttgaatatatgttttatcaaagagaaaattctcaataaatatcccaaagcaaaaaacatacagggcatatatttcactatactgcaataaaattagaaactaatagcaaatggttgccaaaaaaatacaacaacaagaaaatttaaaaacactttataaaagaaaaataagcaacagacattagaaaccaatgacaatgatactacaaatggaaacaggatatccccaaaggtctatcagaagaaagttcacagcccggagtgcttttcttactaaacaagaaagagtaaaaataaataagcattcaatccaagagtgatagagtggagaggaaataaacgtaaacaaaagaacagatttaataaagatatagtagaaagtgtatttgaaaatcataaaaatgataagcgaatcccagagctagttttttaggagcaataaaatgaacagacttttgcaacactgatcaa

SEQ ID NO: 1331 - DNA, 7350 bp, Homo sapiens
gctgcagcctgctgttgagtgagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaagaatggagctggtttgtcaaaatccaaaggaagccgaattggatttgatagcacacagtggcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggccagagttacagcaagttactgttgatggactggaagttctcattccaaaggatccaatgcactttgtagaagaagtaccacactctaggtttattgagtgtaggtataaagaagctcgagcattctttcagcagtaccttgatgataacactgtggaagctgtggcctttcggaagagtgcaaaggaattactgcaactagcagcgaaaacattaaacaaattgggagtaccattctggctgagcagtggaacttgtctaggatggtatcgacaatgcaacattattccttatagcaaagatgttgacctaggaatttttatacaagattacaaatctgatattattttagcatttcaggatgcaggacttccgctcaaacacaaatttgggaaggtagaagacagcttggaactatccttccagggaaaagatgatgtaaaacttgatgtttttttcttctatgaagaaactgatcacatgtggaatggaggcactcaggccaaaacaggaaaaaaattcaaatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaataacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttg

SEQ ID NO: 1332 - protein, 461 aa, Homo sapiens
MSRINKNVVLALLTLTSSAFLLFQLYYYKHYLSTKNGAGLSKSKGSRIGFDSTQWRAVKKFIMLTSNQNVPVFLIDPLILELINKNFEQVKNTSHGSTSQCKFFCVPRDFTAFALQYHLWKNEEGWFRIAENMGFQCLKIESKDPRLDGIDSLSGTEIPLHYICKLATHAIHLVVFHERSGNYLWHGHLRLKEHIDRKFVPFRKLQFGRYPGAFDRPELQQVTVDGLEVLIPKDPMHFVEEVPHSRFIECRYKEARAFFQQYLDDNTVEAVAFRKSAKELLQLAAKTLNKLGVPFWLSSGTCLGWYRQCNIIPYSKDVDLGIFIQDYKSDIILAFQDAGLPLKHKFGKVEDSLELSFQGKDDVKLDVFFFYEETDHMWNGGTQAKTGKKFKYLFPKFTLCWTEFVDMKVHVPCETLEYIEANYGKTWKIPVKTWDWKRSPPNVQPNGIWPISEWDEVIQLY

SEQ ID NO: 1333 - DNA, 107320 bp, Mus musculus
  misc_feature (1)...(107320): n = A,T,C or G
aagtttaaacataaaggttaggagtgaaagtcggggtaggatgcttgtcagacacttgtgagatcctgagggcaggtctcaacacataaacaaacaaacaaacaaaactagagctggagagatagcctagtcattaaaatacgtgtcactgagttcagtttctcagaaccccaggtaaaatagatgggtgtggcagtgtgggaaggcagtgatagataggaggaaccctgaagcccattggccaagcccagctagctgaatcagcaagctccaggttcagtgaaagaccctatctcaacgaataatgtggaggagcagagaaatggctcagaggttaagggtgttccctggttttccagaagatctaagtttggcttctagagcctgtatcaagtggtcctggttgctccacctgtaactccagcccctgggagcatgcacacacacgtttacgattgtttaaatcttaaaaataaagtgttaagtgattgaggaagacacttgatgttgaactgtggtatgacattcacacggatattataaataaataaataaataaataaataaataaataaaataaaaaatgaaataaagcaaagcttagaaacagaaccaaaggctttatggcaagggcaaagaagacatagttactgaaagggacatggtgatgaacaaggtcctggggattgttctgatgcaaatgtgtttgtcacactgtgcttttggtggccatctccatagaggctcctgaacaggtgagtgacctggtagctacctgcctgatccttactgtggcatggtaagttggctagctggatagttgactggtaaaatcacttagcgtatttctttggcaggagtgacttaatcacgaagccacttgtggtcatgcttcagcttctcaagtattgataataaagatgggctcatcagcttgataacatcaaagtctacctgaagatcgtttcaatagtttgtttgcttttgtttttgagacaaagtcgcaatatgtagctctggctgacccagaactggtcctgacccttcctcactctgtttgctcctcagggattacaggtacacaacgtaaccatgcctgtaatatttaaagacacattttgtaggaatttagctctcatccattagtccttgtgagttggtaaattcggacagcactgagaaacggagctggcaggatgcattagtgaggaaaggcattttccaccgagccagatgacctaaagtcaatcttcagggccacacagtggaaaggaagaatttaagagttgtcccctgatctccactcattgactgtgtcgtatcttaacacacacacacacacacacacacacacacacacccataaataagcattttgtttaaagccatgtttgtggtccttcaaagctaagaagtaggactgcgggtgtggctcggcggtatcataaaacatgtgcttatcaagcacgaaggtctgcatgtaactctccagcccttaaaactcaaacaaaaagtaaggagtaggctttggaccatggcaacacatctttatttaacaaagaattctagagagtagactacaagattcagagagaaggttaattcagagttaaggttggattagaaaggataatgttgggtgatgaggaaggacagagtccaggtaaaggacacttagttacaaagtaattgtttttctagttttaactctgtcatagattttctttcctttctttttgtagataagtgcatacaatgtttaaaagtcgattttttttttttggaaacatggtttctttgtatagttctggttgtccctgaacttgttctgtagaccaggttggcctggaactcacagagatccacttgcctctgcctcctgaatgctgggattaaaggtgggtgccaccactgcccagcaagtggataaaatataattgatagtatataagccaaagcaaaggtccacagctttaaaatggctactctaattgtacagaacttcattaagatgtgtaggcttggggctacatcagcctagctggatgttgttgtgttttagtttgcaggttacacacacacacacacacacacacacacacacacaccccttaagttagaagcttactgtactccttactctcttttctcattgctgtgaccagatacctggcaagaagcgacttagggaaagaaagatttatttcggttcatggtatgagaggtacagcctatcatggggaggaaggcagggcagcaggaacaggtggctggtcacgtgatgcccttagtcaggaagcagagagaggtagtgctgccgcttcctcctcgccccccttttattcagtctggaccccaggccatggggccccaggcccacacttccttcctcagttaaccctctctggaaacatcatcgcagacacaccaagacttgtctcctagatgacttcaaatcaagttaagtcaactctgaaaatgaactatcacacctggtacatcttcctgtctataaaatggattacatctatctcacagcattgttgcagtgaataaacaagattgtgtatattaaagtgtatattaacatatcagggctattatttgataatctgtgggtatctgtcctagtaacagaataaacgtttgtagagtttcacaaccatgatcattgccattctgtaggttttctggtcctctgcctttgccttcagggtcttggtcctgttgatgtcagctgccacggtaagaacacgagagtttccaggaagtaacgcatgcttaattgtaacagaaggctaaaaataaaaggtgttttgggataaaatgtgatcgagattactggagccagagaagtgtaagcaaaatcttcaaggactattggaagttggtctagtttctgaaacaaaggtcacacaggcaatttactgacgggaaaactgagttccagagtgacagacgtcaagcccagtccaaagagggcagtctttcctcagttcctgacaagcaaagcagaagcatctacagctacacagagccatggctgtgccttgaaagctcctaactgttggatatgaatgaataaggaaaatttttttaaaaaatcacttcaaatcaaaggaaaggcgcctgtgtctaacatggtttctgagccgtcagcctgtgccctgaccttgagaggctgggttaaagctgtgaaaaggggaaaggaaacaaagacagaaaacaagttggcagaaaagtgcaagacgttttcaagactagacagaccagtttaactgaatggagaggaaagagaggcccacagatggatgaggtgtgcctgtggaggctttaaatttttcagtaagctactagaagtttagacaggaagatattgtttctagtttttgaatagagtactcaaatttagcctatattcgtattgaactttagtaagtttgtgttggacatggatatactgtactgtgtggctctttctaaaactcctataatatgtgagtcacacttgtctttgagaattagggagaacgtggttataattcagtattacaaatgcttggctagatgtgacagcccctgagttcactcacacacacacacacacacacacacacacacacacacacacaaacactacataaataagcattttgtttagagccatgtttgtggtccttcaaagctaagaagtaggactgaggggtgtggctcgggcggggtgggggggtggggagaggagagagtatgagaatatttgatttttttttcagtttggggatcaaatccactaggttcctatagtaaccagggctaagtatttaaataaacattacaattttgtaagtctatattagaggtatatagatggtaattctttctagtagagaagttaataaggatttgagaagagggaagaagccttaggcatagggtttctattgctgtgataatacaccatgcccataggcagctcgggaggaaaaggtctatttcacttatacgttcacaccacagttcattactggatgaactcaggggaagaacctggacgcaggagctgatgcagaggaagagctctgcttactggattgcttttcccatggcttactcagctagccctctgaaaaaaatccagggactccaagcctggggtggtgtgaccaactcagctgggccctcccatatcaatcctccatcaagaaaatataccataagcttgttccttcttccaaaaggaccttagcttgtgtcaagctgactcaaaacccagccagtacaccatatctccattctgtctccgtgcattttaaaggaaatggatacccagtccccacccccaccccagtgttgggaattcttatgtgtgctaggcaagtactgtcacctctgcggttgatctatatccccagctcagacactggtacttttaaatgcctgtagttgtaaatagcatatttcattagtctctaaaagtgtatttaatgcattccccctaattcttcttttacatgaaaagtaaaattctaaccaaaaaagtgtattgagaaatgaatcactgagcctcattctgtagaacatgtgggagagacactccttctggagggtagaacatgtgcaaaggtgttgaagtgggaagtggtgtgtgtttgggaaactaactgttgttgaacggcggcacattgcgctgattaaagccagcctgttctccagacaaattgaaccttggcggttggctctgccactcaggtttctgacttagggtggattacttaagttatttcaacttccatttccttacaaatgtcagctcctgttactctgattttgcccttgtttccttctattttactaactcctccaccaccactggtgctaaattgaacttaggatctcatgtaccccagacaaatctccactgagttgcatttccagggaagaaaaggaatgtgtagctcaatgttataactctacacactagacccttggaccagttctcaggtctgacaaaaacagacttgatgacctattaggattggagcttagaaggtttgaggaggttgagagcggttgggtaaattggaacttattgagtgcagtgtagctgtataacaccaggggagaggtagtgaacaaatatcacatgtaattatgatagaatcatctagaattctataatgcttactatatgctatgtatttgccttggtgctttacacttgtttttaaattatttacttattgattgattgattatatgtaagtacactgtagctgtcttcagacactccagaagagggcttcagatttcgttatggatggttatgagccaccatgtggttgctgggatttgaactcaggacctttggaagagcagtcggtgctcttaaccgctgagccatctcactagccccctaaattacttatttttacttatttaacttttggtttttcaaacagggtttttctgtgcatccttggctgtcctagaactctgtagaccaggctggcctcaaactcagagatccacctgcctctgattcttgagtgctgggattaaaggcgtgtgccaccactgtcctgctcttttacacttattgatttatttaactctggaggcaatctgtggtaggcagcactattctccaattctgcagatcagaaactgagacccaaatgtcctttaaacaagggattgactttattattattttatgtgtacaggtgttttgcttgtatatgtgtctgtgcacatgtgttcctggtacccccagaagccagaagaaagtgttggatcccctgttattagagttatagactgttttaagccaccacatgtgggctgggaatcgaaccctggtcctctgaagaacagttagtgctcttaaacattgagccatcactccagccccgtagactttaatcttagccaagagcacatgtttaggaaaatgatgtgactatgctatagatagggctggggcttgggacagaggtccaagaaagctagctgactatacgctaagaaccagaaaagaatccagaacaaggcaaaccccaggctctgtttacatgcagtttacagcctaatcccagacacaagagggtcataagaagtaaccaaggaagtgaaggataagaaacaaaaccaagggctggagagatgactcagcgatttagagcactgactgctcttccagaggtcctgagttcaattcccagcaaccacatggtgactcacaaatacctataatgagatctgacgccctcttctagtgtgtctgaagacagcgacagtgtactcatataaataaaataaataaatctttaaaaaaaaaagaaagaaaggaaaaaaaaagagagaaacaaacccaaaagatcaaattctaggacggatcatatttaagaggtaaagagaagaaagccttagggaagtcaaagagagaaacacagctcagtgtcaggaggaaagcaaggagagaacagagccccagagaaccctgggagaggggagattttgatagtaaagtgtcaggtatctgggaggtctggtaagataagaattgaaggtgtctactggcattggcaaccaacagatgtctgatggctcatagcaagagtgactctagaaatgatgaggtggcatcaaattgctgtgaattaaagtgaggttggaaagcaggggaaattggagaagggagatgagctagtcctgtatctggctaagcaagagaaagaaaatgtataaaccagggcgagagcagagagggacggttgaaggctacgaaaaagggaacactcagtatgacttggtgacttgaccacgggtgacgatgtgaggctctaagctgattccccccgcccctcttttttgaaaaacatttattttgaaaaacatttatttttgttttatgtgtatgagagttttgcctgcatgtctgtgcaccatatgtctgcctgctgccctcatagaccagaagagggagtcctatagcctggaactgagttactgacagttatgagctgacatgtggatgctaggaattgaattccaggtcctctggaaagcagccactaatgtagagctactgagccagatctctagccatcggatcctactcttagtcctggttcctgagagaaaggaaatgctgttactacagaaaaggaatggaatatattcctgagtttgaaaaattaaaggtaattgttggtctggagttgcagttcagttgtagagtactggctcagtacgcatacagtgctatatttgattcctagctgcatttgcatgtagttccaactctcaggagttagcagcgaaggaatcagaaacgcaaggttgccctatgctacctggacgatattggtcttagatctgtgcagtaagcattttttctttaatattgttaacctgatacatcacatatggcatttgtttatgaaggaaatgtttcattataacgtagggatactttctatggtcttaacaaaaatcgaaacaaacaaaactcttactcttagcatcaaaaatgtcattattgctgaagtaacactgctgctaaagtaattcgtggaacaggtgggctggacaaacatgatgacctgagtcattcagagcccaaataaaggtcaaggagagagcccactccataaagttgttctctgactcccacatgcttattatgggccaagtatcactccctctccctctacttctccccctccctctcccccaaccctcccccccaccccccagctaaaaaccaaggaatcactattttccactagattagatatttgtttgaggaaataaatggcatttatgtactttatttaccatataacaattattatctgctaagcacttgtaattgctttatagtgttaagtgatctgaatttaatccatcaaaatagttccaaaaggcaattttcattttacaagggaaatgccaaggttacaaagaattttgaaataaccttgccaaagtctatcagcttttaagaggcaggggtgggagtcaaactcaagtgggttgtgatgcatggcatcaatgcagaccttaccccggtacattttctcactttcctcttcacttgtgaaaatgccagtaatggaattaagactttaagcaaagcaatagtccaaacttgtaacatgaaaataccattcattattcattcatatttttaaagaaaagaaacagcattttagatgtaaactcctgcgatttctttgaattaaaaaagaaaatgatctttgcttatgattattagaattgattataaacaatactacctaatatcaaacttgtcacagagatggattaataactcaaaaagtcaaaacttctactgcctgtgagtacataaggcagaaacagcgcatgtgataagcaacatgtctgcaggttactcagaatagacactttacaaaaggaaaaagaaataacagcattcagttactctgtattgattttatatgcttcagtagaaacgaatggacaggacaatcatgatgatgtgggaagttctgactgcagtattgagtttagtaatgtgaagcaaaacaacaattcatttttcaaaacaattaaaataagtatattccttaagtaaggtgtgacggtgcatggaagatgggaggaatcagaagttcatgtttacccttggcctcataaccactcaaagaataacctgggataattagatgagagatgggagatgggggtgggaaaagtattctcatctttatttctgttttctttaaaaaccacattatctacattaacaatgtaggttgtagaaaatatatagggcggaagtaaaaggtttgcaatttattcttattatcaataatataaactcatattctttgagtcaaccgaagcagagttaagtatgatgaagacgttgtagttctttttttttttcatttattcattcgcgttacatccgaagagcagccccgctcctctcctcccagtcccacccttacaaatccctcctcccattactcctaaagttgtagttcttgaatacgagtataaagaatcaaagcgagtaaatgagaagtcaaataccggttttgtagaagttggcatgaaggaggtatgagggaaacagactaacaagcgagcattttctgagctggagactaaggaccaccggcttatttatttatttatttattattatggctaaggcctagtaggtgacatacatttgctaatggttcgggaagatacccctttgggtatttttttcttcctgttggatctttccttttatgttcccatcagagctgtgtatcgcggctaaaatcatggtttgctgggactgcttttgtttacttggcagctgcagagcttcaaaagaaacagatagagaagcaaggaaaacctctagttttttggaggcgaagaagccgaaagcccttcttgacagcttcggggtagggtgtgattccaagagacagtccttaacagctggaagaaccaggtagcactttcacagggaaaagagcgctcccgcccggggcggtgggcggagtctccagcggccccgccctcccaggccaatccctgctctccgccagcggacaggaagcagcggcggggcctagcggcccgggcgctcgcctcggcacgcatgcgcattatcccggggcgcttgggggagcagggcggggcgggaggcaggggtgcggcctcgcgagtgtattgggtgccgtcgcgtcacgtggcgagaaaggaggcggagggccgcggctcagggaaggggctgagaccaggcgaagagcgagggcagggaagcggggaagggaggaaggaagaggccgagggggagggagggccctgttttggcggagcagggcgcgcggctgggcccctgaagtggagcgagagggaggcgcttcgccgggtgccactgccggggaggctcgtcgggacccagcgccggtcgcggctccctcaggatcgatgcaccgcggttaacccgtgaggaggcggcggccggggaagatggtgttgccgacagtgttaattctgctcctctcctgggcggcggggctgggaggtgagacacgaccccgggcggcgacggagcggcggtcggtcgggccgagcgcagcgtcgcggagccgggccgcgcgtgtcaggtctcctcggcttctgtcagctctctcagctcgcctcagccgaccccgagcgacgctccccgcgcgctattgtcctcgcgcgccccgaccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgccggggtccgagccccgggtccgcgcagactcgcagcaacttgcgaggttggcagcgcggcgggagcattgttctgcaagcgagcgagcggacccgggccgggtgtcggacgccggtgtgcgtgtcccacccgagtgccttccctccgcctcgtgctcttttcggagtgtttgtagccagcgcgccggaggttgtgtgtgtgtgtgtgtctgtcgttctgtctgtctgtcttctgtctccccggggcaagactttagttgactgaggagaagggcaagccgttttaggatgctcttcgatccatctgtctttttgagttgagtccacagagaagcaagaccgacccttcctgggcgaaccaacttgcagagttttcttaaactctcaggtggagcagacgtactgcttagtcagaggattgtcagggctgtgctccctccccctgcaaattggagttcactgttgcttcaagtttcctgatgcttcgggtttgagacagcggtatttcattcccaggctttcctaggacaggttgcatgattattttgttcctatgagaaagtgctttaccataggtaagctaatttgccgcccaagtgtctggagagaggttagcttaaaagcattgaattggaaacaacccccagaacttccaggggtgcttcggatggttgtcagcagcctaatttgatactttagaaaatatcctagtgttttctgtagtgtattgtctgtgttcatccctttgtctcattgacttaaactgcaggacccagcctatttttgtctggcattctgcttactctgaagttggttttgtgtactcagtttctgttgttgtgtgtactattcatttattaagtacacattttagatgacagccactaatagatgcttatttttgttttgtttttgttttttgttttttttaagaaccagattgcagaccgtttgtaaagagcctctttatttaacatttgtatttctgtaacacggcttatagtcctggctggctgttttcactttttgtgattatggtcaggaattagacactgttctctatgaggtaataaaatctaagttaaatgtgatacactttgataagtagtgatacaaaatgccttttattaaggaaaactaaaaccaatgtggcctgttgtttggggaaaaaagtaaattaacagcataagcattgtgggtgaagagttttattcagatctttggagtttctttctgcactaagtaatgattcaaaggccaggttttgttgtgcttctgctaaaaacttaaaaaaaaaataaaagttttcacttaagtattatgtcaaatttgtaatacttgagtatgtaggtatatttataatttggggctgtggaatgtagcccagtggcaattgcctagcaaggccatgcaaggctttggattcaacatctctgtttaaggcccaaaactcctcctatgtttatttgtaactcattatactatatgctgggttttttttttttatctgaactgaatcgcatatagctaagtttatatatttttgtgatgttttgtaggctagtgtgcattcaaacttagtagatattggctgtagtgcattggaaagttgaatgtttgtaaggttagggtagttgtagaaatacagaactttaaggtataagccatgttcaggtgaaactaaactctgttggttgctttcatcttgcctgtttgtgttaatcactgttgtgtgtgaatgtttttcttactgcacataatgtgaggggtgggaagctggaaggaggcaataaagtgcttaaatactaaaacaacttttctagttttcccttctatgttggtggatgtcctgcccagtgttgtatttgtagaaagataccatgatagtttttgagtttatgaagtgtctgtatggaagtattcatatatctgtacaaaatgcttctaaaaagttatttgttgcctagcaaaatggctcagtaggtgggagcacttgctttgaaagcctgactatctgatttctagtccccatcccttagttgaaggagagaaccaactcctgaaaattatcttttgaccttcacatgcacaccatggttcctcgtgcccttactcacacatgtacactacacacaattataagataataaagttatttggagacgtgttaggaacttattggcactatcctgattagccaacaatttttgtgttttgttgttgttgttgttgttgttgtttgtttttgagatgcagacggattatgtttctagctctaactcctgccttcttagtagctggtactgtgggtgaagaccttgatgtagggctgatggttacttttgagcatagaaaatgtgaaaattaaggtctttctgagcagtggggaagcacacctttgatcacagcacttgggaggcagaggcagacagatcactgagttcaaggccagcttgggctacagagtgagttccaggaactatgtcttgaacacgtcccccccaccccacccccccaaaaaaaaggaaaagaaaaattattttgtgtacttaagaactcagaagatattagttatagcaacaaagtaatcctgtaatgtttggcttaaagaagttatccatgtaatgagccatgcttggtatgtggtgtgtgtgtgtgttttaatttaaaactctggctttgtatgatacacattctacagaaacaaacttggatatttagcccaaggaatttaaaatattaaggcttaagctttaactgttcattttttttttttttccaaacttctgccagcaagtaggagtataggaagataaggtctttttgtcttcggctcaaaggaactttgaatttttatcttttcagctagagtttgagattccagtacactctgtcacctaataaggccaatttcaagtcatccccaacattagcagtggctctgtgtcagtgtgcaggacctctgttggcagagttgaggggactgggcatggcaggcactcctttgttccagaccttcgcatagtgtatattattgggtctctttttcctaaggactttaacctaaagggttggatagaggagtgcaaaggacttttctctgatgctcatcattgatctaatagtgtttaggagtttctcctttaaacatgtataaaaattaaatgtaagtttaaagggataatttttctaatatctgctaagtggtgaaatatccaaacataaggcagtgttttttttttgttttttttttttttaattttaggtggtggggattagatctgaggtctcccaaattctgggcaagtactctattactgaactacattctagtctcccctgtccccaaacagttttgttttagacagggactcctcactaaatactaggctggccaggagcttggtatccttctgagtagctgggattacaggtctgtaccaataggcctgacttatttcaaacaagagaaatctcaaaggttaacatttttaaccctcttttctccatatacctccatacctgtttttaagttttgtttttcttttcttctttctttctggaaacagggtctcagtgtatggcccacacttacgtttatagtcttctgcctcagtttacctagtgttggtattacaggtgaactctaccatgtcagattatataaaaactttctttcttctggatggtggcttatgtctttaatcccagaactcaggaggcagactttaatcccagaactcaggaggcagagacaggtagatctttgagtctgaggccagcctggtctacataatgagttccaggacagccagagctacataataaggccttgtctcaaagaatacaaacaaacaactcagcaactttctgcttttttttttttaattgaaagaatctttctctttctctctttaaaaaaaaaaagatttatgtgtatgggtgtttgcttgcatgtatgtctatgtaccacatgtgtgcttggtagattcctttagaactgggattatagacagttgtgaattatcatattgatgctgggaatcaaacctgaattctctggaagagcagccagtgctctgaatcactaggccatctcttcagcccctagatactagctttctatttagatagataatgcacttaggttttctggttttcttgtgaaatttgaggatgttatttttaggaggtggggagtgggagtcaggcatgatcctaccatgaagcccatgctggccttgaatcaccacatagtttgtgttggcctggagttcttgctgctcctgcctctgcctctggagtattggtattacagttgtgtgccatcataactagccaggttgtcaacttaaactagtttctaacttctccctgtgagaaaactaaataaatatacttaacacttgacctgtaaagtggaagttctgattttcctgtgtgataaagtaaacgtcctttggaagttttatctttttaaatatatgtttggctttgtagagtttactgctgagatcactttgttagtttctgaactattgagagatggtactgatgtgttagttaaagtgaggagggtagaacggaaagaaaacccatgaataacctggaaggcttagcagtgtctatgctcatttatttagttatagatatatcatgtcctgagtctgaatggtgaatactgtagctttaaactaatttaccagattattgataggaaacacatactttttttttaaattcttttttttcaaggtttatttatttattttatatatgtgagtccactgtagctgtcttcagacataccagaagagggcatcagatcccattacagatagttgtgagccaccatgtggttgctgggaattgaactcaggacctctggaagaacagtcagtgctcttaacccctgagccacctctccagcctgaaacacatacttttaaatgtatattgtagtaatgtttattgtaatattccctgtagtaatataaactgaattgagaaaatgcattttctctacttaaaggaaactctgtaaaagctagaagctcccatatttgttttatttatttactgtaagagctgtgctatagtaacattgtttgttattctaggtttgatttttttgtttgtattaaagttgcaattctactttcccattttaccttttttttttttttctcagcatagagaattgaacaccttgcccctgcttggaaagcattctaataatgagacatatgtcccaacccctttttaatatttgaactttaaaaattatttatttactttgtgtgtacatgtgcacatacttgtttgcatgcacatgccatagcatgcttatgcaggttagggaaccgtttggaagttctactttgtgggttctgggaactgaactcagattgctaggttttcactggcccttctttatgattaattttgagacaaggtctcactaagttgaccaatgtggccttgaactctgtttgtagaccagagaagccttaaacttgcaatctttctctttcagtagtttgagtaactaggattatagtaggctcaggtaaagttaactccccacccccactctttctctctctttggtgttggagactaaacctaggccattattaatgttctaccactgagatgcatccacagctctgtgttttaattataatgtttgctgatgtcggtaggggtttggttttttctttttgttaatgcagttagggcttaatcactgagttgcccaagttggcttaaaaacttctagactcaagtaagctctgtagcagtgggatttataggtatatgccatcatggggtcatgtagttttgcaatggtctagcttaaaataaatccgtgtgaatcctaatggtgtagtttgcatgaatggagactgctggagagcaggacacaggtacttattggttatctcaaccggtgcctttcagtgataggccatgttcctatctattaattgtaaagtaggagagtctgtagatagagaagtatatggtgttttcaggttggagccccaagctcagaatcacggaggcagactttagatagcaggaaatgatttgtattttgtctgtttttcacataggcaactccatgtgacaaggttgggtagagccttaaggttgtttaaaattttgttgttgtttaaaaagagttaatttatttaatacttgctaataattctcccatgaaattctaaaaacttggcttggggccagaaagatggaagtgcctgtcatcgggtccgagaacttaaatcggatccccagaatgcacacagtggaaggaaagatctgactcctgtaagttgtactcagaccatacatgtacagagttggcttgttctgtaaaataacctagcagtggtaattctaactaacccagatttcagtgtttttaaaaggttatttatttatttaatatatgtgatgtaattatatttgtgtaagcactttgaaaaggccagagaatgatcttggtgccttcctgtatcatgttccaccttattctttagaagtggggtctctcactgaagcagaagtttgcttttttagctaagctggctggccagagagctcttggatttgtagcagaagcctgtctgtacccactaatagaggaattataggtatgaacatcagtcctcagatttgtttctgtctgctgggcatttaagttcaggtcccagtgtttggactagcattctacctcacagagacatttccccatcctctgtccccatccaccgattgccaatttttatattagggacaatgaagtaatgtcagtgagagtggaaaagctgcaataatttctaccagttggatctctagttattctccaacagcgagactgccttgagttagtacttgtgggcatagctctgatctaggtagatagcagaaacgcatatgagaacagttccagataatgtgctctccctttgcttcagaaagacttcatcctgaacctactacagttctagctaaataggtgttcagtgagaaccagggattgttgggcatctttaattggttggagttttgatgccacagtttgaatgagaagaaaagtaaaaaatactaaatttatcagagtggaggaaatgccaggatgtaagcatacagttccaattatatattgtagttatattgtagtgaggtaaaatttggtgaaaatgtcacctggctaactggcagtttgtgaggtaaagagtggtgatgcatgtagcttgagaaactaggtttgaggagacacagttgtttttgattttgttaatttaacatgttgggattaatttctttggtgctagattgcatggtacatctggttatatgaaaattgtgaatttaccatttcaaacactagttggggaaaagaatctgatctttgagttttaaatggcagtaaagagagatgctaactgggctgtaagaacctggacttgcattattcgtattctgggccataactaggaggtggaatattatggaatgcagttggtctccatattgaatggctggggtaatacaataaggaataagttagctgcttggtgaactgtgtggtttagtctcaggttagagtagttattgtagaaaaaaagattttaaaagtagtgagggctgtcaagctggctcagcaggtaaaggcactgccactaaacctgacaacctgagttttatccctgggacttacatggtagaggagtgaaccaattccataagttgtcctctgacagtcacatatattgcccccccaacccccaccccatatgtacacacacacacataacacatgaaaaagcactagtaaaacttggcaaatgtttaatgttaggctaacaaaatgtactgagggtttactgttgaaatgggatcttaggagcttttacaatggaaagtggctctgtaatgaggatctaagttgttgaagttgaaattgtcttgagattttgattctagctagaaggtgggggtgggtatcacagtctgggacttaatactgtcatccttcttcctggggactgcgtaagagtttgcattgctcttcagttctctgtgtctagtgatttggaaagtatcattctagagagttagatgatagtagtctataaatttggaacagaggggagcgattagtttgaagatacacgaatacatttttacaaagtgattttattttatatgtatgagtgttttgcctacatgtatatatatgcaccgtgtgtatatctggtgcctgtgaaggccaaaagaggttatcagatctcttgggactggagttatagatggttgtgaccacctggtaggtactaggaactaacccaagtcctctgtaagagcagcttgtactttaaactgctaatccatatctgaactatctctttagcctccatttttctactgatttatcttgttggaattagcctttaggattttagactatggtactctaacaatagttccacaaatatctttccatgtctttgcttacattaatgatgattagagacacatagtcacacaaatacttgaacttttgactgagttttggaataatagcatatatcaacctagaagaccattaacagatgaatggataaaggaatgcattatttatacacagtacagtttaattcagctttaaagactgaccaaatttgtaggaaaatggatagaactggaggttgtcatgttaagcaaataagccacactgagataactattgagtgttttctgtcatatgtaaaatctaggtttggagtgtgcatgaatgagtcagtctatctgtctgtctgtcatctgtctaaaacctcactggggcttggggtttactgagcgggctaggctggctgtccagctagtgagtcacagggatttgcttatctctgcctcttcagcactaagcttacaagctttttacaagtgctctggggttctcatgttaatgtggtggacacttttatcaactaggctatctactcatccctgactttatttttagtttatatgttttaggacctagcacaaagcctagctcacatcaagatttataataagtgttttattaaaattgcagaattagtgctggtgaaatggctcagcagggttttttaaaaaaaaaaaaaaaaaaaaaaaaaaaaaaaagcctgataagctgtcctgtatccacagtaaaaggaggtaaccaactcccaaaagttgtcctctcatatctgccatggcacattaatgtgtgcctgcattcccacactctctctatatatacatgtacacatcatacgcacaatatcaaatgaagttaaaaaacccacagaacaacattgctggtgagtggagtggatttgtgagttcatgttacatagacattttcattaagcaaggttgtagtctagtgaagcagcctttgaattgctgtctgtctacagtgttatgggaatagctccattatataaagctaaatgtcatgatgatttttgttaaagtagagtattcttgcagtacattagagagtataccttccaattaatacagtatattatcagaattccaagtggacaataataaggattaagtactttaatccagaaccatttgctagtctgggagataggtagtcatttgtacttacagactagttagggaattaatcatttgtacttataaattctaactttattttggtcaggatgtttaattttcctggtgacatataaaatctgattttttccaatgtagtacaaatctcttagtaatccaagagttttttttttttttccttcatgtgtagagtaagctacagaatagtgattgccagacaagtgtgacataggtggaaagcgaggtcatggaaatgggtttagggtgaaatgtaagatctctatacagcagcagtggaaatggtggctggagtttcttgcatctgtgtgggagaataatgtaggtaggttggaagcttccgtctttaatgaagattatcatctgtactggtggtatttatttgaaagaatatgaaacatctcagttatatatatcttcatccatccattctggaattttgaaatttcatttcttaagtgaaaggtagaaatagaatagtcagtggattttagtcactcatattttgtgccctgtgtgattgatttagtttgtatttgtgagagggtttcttagcttctcttcagatccaactgtctttattattttgtttataagagtctagattattttttgaaaatggatgtgttgaaatatgctttttggggtcatctactggggcatgagcagactatgggcacaccagctccaccccttcattaacaaaagtaagtcctttctttttctagactccaccctttcttctttctgtctcttttttcagtacttagggtcaacctgagggtcttacacatgcttgttaagtattctaaccctcagatacatatcaaggtcatttctaaagatgtgcgacaaaagaggaaagaaataccttgaatgcggggcatagtacctaatgaatagaaaaaggaggaaatgaaaaagccaacgtgctacaggcatttgtaaacctattagccatcaatatgaaggaagctgttttgcttggccatgcttactccacagtaggagactcaaacctctgaagccatgagccaaaggagtagcagaaagcctcactgctttatttttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctgtgattggggtatatgtattttctctaaatgatataattttattcttaaaaaaaagaaatatgcttttaattatagatataccctgttatcttgaagtttcacttgtaactgtgagatgtagatagttgattctagatgatttgactggtttctagtgaagaaatagatactggtttcagtttgaagttatatagtagaaatggtgtgtctaagtgcattaaaatactctgcaatattgctgaaatataggacatagttcttagaaggctatttttgttatatgagagagcacttttataagtgctgtgtaatatttcaagatcagagtgaatatatagcagcataaagaacattggtcatggatatttcttgaggcaaagataatgattttgaaattacattgttgaacttaattgtcaacttgactgaatttggaattacttaggagatacaactctggggatgtctgtagggtgtttccagagaggtttagctgaggaaggaagacctgaatgtgggtgctgccattctatggattggggtcctggactgattgaaaagggggaaaaaaccccagaaaggatactgaccatcaggaccccatctctgcttgcagactatggatgaattgtgactagttgcctgaccttcctgcacacatcttcctgtcagtggtggactacactgccaggccacagcagtgaaagtattagaaatatcttgattgcagctaattttcttgaggcattagaaatgtaccagctttagtttgtcctttatctaccctttcatatgttgtaattgagttttctataactaggaagatttattatgttaatatttttgttaatttttttcccattcttaagattgtgttatcaacttttttgtttggatatagatagagaaaaaaatttgttaatataaagtgatactattaacctaccatctgtaggctgagtagctaggatttcaggtgtgcacaatcatgcatagtttatttagttacttattttcatgatgttttgcagtactttgattgaacctaagccttctcacacatgctaggaaagtactctgtcctgtggggttaagtggttgaactcagttttcaggcttggtgggaagtgccatcttaccatccctattgtgtgtgtgtgtgtatatgttaactgtgtgtgttaaattgtgttcacaatttcctctggacctttaaagtgttaggtactgagtgcatttactgtgtactttatagaaattcagatttctgaaatctgtaacagggcaaggaagcaaactgctgttgataggcttttctgtgtaaatgaaataaaatagcagaagagaaagataacttacttgataaagtgcagagtggagtgatttaatatagttacaatgctgcagtaaaatagccttaggattattgcatcattgtagcctcccctaatcaagatgcgaggctagggagagaaattataatagttcaagtggaaagatatatgacacatggaaaaacttgggcgatctagaaactttccttcaccagaagttgtcattttccactgacctcagataaggaagtttcactctgcactccaggttaaatgtgtttcttttgctattattaggaaacatttctacatgggaacacctttaatagtattgtctatgtttggagataaaaggagtttgggttggcaaagtttttctttttatctctttttcagtattgggtatcaaactccagtcactgtggatattaggcaagttttctgccattgagctatatatattcctggcctctggttgtcatcttctgagcccttcctgttaacttccctgctgtttgttgggccttgcatggtaatgcataagtagtgaaagggatgctctagctctgtgctgttttggttttggttttggtttcttagtcattagaagattgatcagtagctatttattgtaactttttaatatttgtattctcagaacttaaagtaaagattagcatatacactattaagtgtgctcaaatttctgagagagtgtgtgtgaggagaagctctgaagatttatgttgttgttatttttttttttttaattgacccccttaccattttgagtggtactcaggatcaaacctaagaattcaggatgctagctaagcactttaccacagaggtgtgcctcagccgtactgtaatcaactttaaaatagagcagattaccgttcttgctagtgtatttattttgctcattaagtacttttacatggtcttttaattaaagaggtagagtaagttagactttttttttcctataagaactaagttgctttttaaaaacaactgtgtctttttatctgaaagtacattttattttgtgcatatgggtgtttttactggaaagtatgtttgtgcacttgcatgtctgatgctcatagaggccagaaagtgtcagaatactcagaactggtgtttacagacacttattagctgcagtgcaggtgcttggaacctaacttgtatcctctgaaagagcaggaggtgctcttaactgctgagccaagtctaatccctgaaagcatttggaagcatgtatttgttcattgaaaaaagtagcctaaatggataaatatgttgttgttttgagacaactataaccagattgtttcaacctcatcttcctccctcagctttctttatgctggtttatagatatctctcacaatgtttagcagttattttttaaacaataacttactatattcttaggtagtgcatgctgtataccattctcaacactcaacacacatacatttagtccaaacaatgtcacttttaggtataagtactggtaaatctatttttttttcaaatgggaaaactaaggcataatgaagtaggtagttcagacagttgtgaatgctgcatgattattttgcatgaaaatttcctgaaatgcattcatgatagcagtaagataatccctcctttatcttgaaagtaggtatagaggtttataaaagagtaaattttatgccaatgccaggatttttgaaattctgttcactgaaatgtgttccataggaccacatgtttttcagtgattggattatggctcttaatctctaaaatgtagtttccctttgcatggaacatttggataggttcattcattaattatttatattggtgtttatcgatcaatttttcttttttggagatagggtctccttatatatccctggctggttagcacttgctgtataaaccaaagtgacttcaaactcagaggtcctcctgtgtcagcctctcaagtgctgagattaaaggtgtataccaacatgctgtacctgactgttgtctaggtgctgaggatacatagtgaacagagtgcttatttaacttgtgactgtattctaatagtggtgatgggtagtatatgttagttagaactcataaagaataccagagtagcacattagagagtgagtgatgggaatgtgcactagattgggtgttcagagaactcaggatgacaaaaaaggtgacagatagagatactgcacatagaaggagaagtggaggaggatgagaacggacaggagttgggtgtaggggatgcaatctcctacaaggatcatgctcagctttataaactatagtttagactttgagtctggaaggctaacatacttgtacttttcttgaatagagttaccctgttgtgtaaaggatagatggtagaagggtaggaatagtaccataaaggttagttgtttgtcatggttttgactgtcaagatactttttgtttttgtttgttgtttgtttttgaggcagggtttttctgtgtagctctggctgtcctggaaccagctctgtagatcacactggcctcaaacttgtagagttctacctgcttctgcctgccactcaactgactgttgagatacttttgaaccttgctgtgtttggtacattttcagcttttggagtttcgaatttctttgcagcacatttctttccttctaggcatgtaaagaaagctactgttatggtagttacaggcacctgtaattagaactgtccctggagacttaggttctgaactgagcagacatgcgttcttgatgaaatttaggcattagtgtgcatcttttggtacttttgggaagttttttccccaattgcttttagattgagtttctggcaccaggaaggctggggctcagctcagtggtaatgtgcttgtctcagcacccatgagctccccgtgttaagtccccagcaccacaaagatgacattagaaaggtagcacttttaatattttgatggtcattatggtgcctctgcttgcttctaggagttacttgtgtatttttgaggatgatggtggagaggtttgatactgttttaaaatgtggaattttattcttaaatagactgtattgtatgagaagagtagagattgaagaaaatcatattgagaaatacttaagtatttatggggacagttttcatgaggaggatacaagatgatttgtaagaaacagaacctttgatttctgtttgagtgtgatattgctttgcctgagtcatgatttctcttggttagattgatattataggaaggataatattttcagttcaaaggcatctatagattaatagaacctgttggcaaggattagtactggaatagatggtaaggaattggagtagagcgttggcacattggcactggggaaaccaagagaactttgcctaggaggactgcatgcaaaagtgaggtgtgtagaggccgtgctttgtttaggtagagatgtgagagtgtttaacatgtgcctgtgagacctgatggcagtctgtgttctggctttaccttttgagttcctgaccagttgttaaagtataagaacaaaattcagttgagtcagttcagagtctgaactgcatgtagaagtctacatgtagaaacaggcagttctgtggtgtctgactgagtaagtggtgcaagggctggagattggcttgtattgctgtggagtcaaccatgccagtctcaattaccagctgtggaaatcaagggtctacacatatatttttgatctataaaaagtacgtttcattcctctttagtatttcattttatgtagctttaaaaagtatatcttaaaggtgaatgctaggcttgaaggccatgtgctgccacctgatggttttcctttcagctctttgtagtcacatcagagtcatgcatgaggccgactttatgaacatagtagagctgttatcatggcctcattgatacatcacttgcctccttcatattgcttctgatttgtccatgcccttggacttattacatatctcttaaaccaccagtttcttctacattgcttgataattttttttaattaatagacctgtttggtggatcagatagaaaagtacagagcagtacatagcctggtaaatagcaagtgcttaacaaattttaattataattacattcagtttataagtactattattgtggtggttgaccttggttatcttgaggctgagattagtagtctagagaggattaactgggtgtaagggcgtgataattcctgaatgtagggggtacctaccatccaatatgttgaggcctgggtagaaaaaaagagaaataaaaaagaagtgttttttctgctccctggccactgatgcgagtcactttgctctgtcacactctctgccatggcagaataaaatctcttgagtgtgtgagtcaaaataagtatttcttcctttacgatgttgtcttcaagtttttttttttgtaaccattatgtaaagttaacaagcttgcacaagcatttattttacttaacctatttttaaatcaggtgctaatttataaaattatttaaaaattgcatttatttttttttttggtgggggtggggtgggagcagaagcctgctgtggtgtgcttggaggtcagaggccaacatttgagaattggttctttttttctacctcatgggttctagggattgaactaaagtcaccaggcttggtagtaggcagctttatatactaagacatctttcctgtcacaagtaagtatttaattaaataaaaactttgcctaatcaggatagtccttttccttctttatacatagtaaactgtcagtgtccattaaaaacaaacaacaaagccaaaaaacaaaataaaaccctacaactaaagtacttaaaaaataaaatagctcttggtagttttgggatttaaattttccttcttaagatgtaaaatgttcacatttgtacatgtaaaatgtacagtttttttgtttcttttagccagattttcatgtgaattttaaaatactagatttctaaaatagatctggaaggaaagaattagcatgattttatgaatatgtgatgaactgaaaggtattcttactaaagttgagggaaaagtaaaaatgctctcatttctcatggtttgtggtaatcctggttagtatagtaagttaaacagataaggctataagtagatgagaaagagatttaaataggagaaacagaaacagtgccagggaagaaaataaaaaaaatattttcacaagtttttatgcataatcacagactttacaggttctcaccagagaaataaaaccaataagaaacagataaatggagctggatgatctaggtatgtgagggggtttatcagaggaattgacttgttattgactacgagaagtctcatgggaggccatcaaagagagagaaagggagaaaaatgcatgcaggatggtgagctggtgatgttctcctgtgtttgtcttccccactcacatccataactcacatggcagtctcatagaaacacccagaaatagcactttgactgctcttcacgttattttgtttgtttgtctgtttgtttagagatagatgtatttatttatttatttatttatttatttatttaatgtgtttgagtacactgtagctgtctccagacacagtagaagagggcatcagatcccattatagatgattgtgagccactgtgtggttgctgggaattgaactcaagatctctggaagagcagtcagtgctcttaacctctgagccatctctccagccctaggttattattttttttaaattaaattaaaaaacagaaacaaaatcaagtttatcttacatgtatgagtatttgcctgcctgtatgtctgtgtattacatgggtgcctggtatactctggaactcagaagaaggggttggattccctggaactagagttacaaactgttgtgagctgccctttgggtactgggagtcaaaccttagtcctctggaagaacaacagctagtgcttccaagagcagagctgtctttcttgccctatctctagatatttgttaatctattcaggggggcactattacagaggtcttttgatctcatgttggtgttcttattgcagcagaaaaaaaggatgcattgttgttaaatcaacactaaagaaacttaatgtctttagtgacttctgtaacattctgcaatgctccaacctgcctcagcctcctgagtgctaggattacaagtttactcagctctgttgcacaaaagccacgatgaaaaccaacacagagcttatctgtgttaaacacaggtaccatttgaaaactggcttttggattataggttgtggactcttgtaaaattttcttagcagttcttttacctagaagcataggtggtccttagccctgttaatactctattgatgcttaaagcaattctgtagggggttgggggaaagggaaatagctgctgattgaagtttggaatttcttcatgaagaaaaattgcaatgcttcctgagcttgaatgtacatatggatgactttggaaatctggtctggacttagattgtgtgcctttctgttactgtgacagatgcctgagacagtcagcttaaggaaagagtagtttcttttggctcatggtttcagaggttccagcccatgggctgatacagtcattgtttttgggcctatagagcggcggacagagcgttctgatggaacagagtgctcacgtcatagtggccaggaaagaggaggagtcacaggaggtttggggtcaaggtaaatatgcttattaaaggcatgcatactcccaatgactaacttctttaaaatagggcccatcttccaagctccatccagtagtctcctcaacattgtaaatnnnnnnnnnnnnnnnnnnnnatgtctctcaatccagtccaggcaacattcaaagttacttaccacactgagttatttgggagtgccagtagatgctgtggagtgctccagaatctaccctgttaacattttcccagtgtgtacctatcctcttgcccttgaaacaacttagacagtgaggtttcttgtgataggaaaaatctgtgcatggaaaagtatttgtgtaggattaaaacatctacagaattgtatttctaggttctacaaatgttctctcatactggaattgattggtacttgatcttttatttttgcctacttcttgctttgtcttgttcaaaatggaggtatttaggaacaacagattattgaaagatgggctaatagtttattagaagtgattagaatgctgataattaaattttgagagaacaaatgggaacttttgttttttgaattgtctgatttttgttttttatcctgtactttaacaagtatgaataattaaaagcaaatttatattttgtttatttttatgtgcatgggatttttttctgcttgaatgtctctgtatcatgtgcacatctggtgtccttaaaggccagaagagtgtataggattccctggagtacctgccatgtgggtgctgagaactcaagtcctctgcaagagcagtaattcttaatggctgagccatctctccagtcccctgttactattttttctatctgaaaattttcttttaatatttctagttgtataggtctgttattaataatttagaagttttgatatctaaacaagtcttagttttgacctctaagaccctttatttaactgcttaaaggatcttgggctaaaagtttcaactttaaacataagtgcctaccttgtgatttatacagagttgtgtcttcattcttccctgtgtatctctttgtggcttttgttgttgttccctgtcccagtttattttaatattttgacctctagttttcacccattagtctatgatttgactttatctggtttcttttacatgtattctttttggcttactgttgacttagatttttacatgcacacgcgcgcacacacacacatgcatatatatacatatatgtaaacatatgtattatgtgtatgtacacacacatacacacttctttgtttttggttttatgagacagagtttctcagaatagccttggctaccctggaattcattctgtagaccaggctgacctggaaactgcctctgcctctcaagtgctggggttataggtatcccaccaatgggcttaagtgtggcttaattttaatatctgcttttacaacctcatctgcaaatttcatcatctctaacattctattactaaggactaatttttgttttagttatgggagaatatgtatacacacatatatatgtatcgtaattgttggataaagaaattcctatttttatatttggaggtgtttcattatatctttaaacatattcagacttttctggcagttaagctacttggaatcagttgaatctaatttgttatttaaatttggaagaaaatgtttatttaagctttgttaatatagatctagaacagctgtttgactatggctacttgtaccccgttactaaggagttacttctctgagggttatacccagtgctttatacacttttaggactttctttcttggtgatatgactatgaatactcaccagtcctgtgttagatgtgttatggctgggcttagtagtacatacatacctttaagcccagtactcaggaggcagatacaggtagatctctgtgagttcagggttaacccagcctgcatagtgaattgtagggcagccaaggccacatggaaagaccctgtctcaaaacaaaaatgaaaaaaaatccaagaagaattattctcttcttctctggtggttcttatttttttgtggtggaataatttattcttttacattcagattattactcatcaaacaatccaggtattacaactctttttttcttggcaactctgtcccacagatcttaaatgtttggcctcactgaactcagctgtttaggttgcttcttggaagctgtgggcatttggaaaagagctcacctcatttgtggctttgtcaggcttctcattgttagggtggttggataaattctgtttgtctttatttcatcctaacgagaactggatattgacttaacaatttgcatcttttttcttgaatcacttcagtgtaagttatggatatcattccaattaactcataaaatacttcaaaaaagtgtctttgaaaattcaagaccttctgttatgtaaccatggtactgtactaaagaaaagtagcaagaattccttaatgtcctcaaagactgattctggtttgttgcaaattattttcatatgtttgttttcatcctgggttgatttttttcccccccttttattttgtttcttttgtgggtttgctctaatgtgattatgcagggttatatttaagtgcacatgtaacagttctcaggagagattttcattctgggttatgaaaggaatttaagtgtatttaaaaggacattctttggctatttaagaattaagttaggccgggcagtggtggcgcacgcctttatcccagcacttgggaggcagaggcaggttattactgagaagaattattctcctcttctctggtggttcttattttttgtggtgggataatttattcttttaaagtttctgagttcgtggccagcctggtctacagagtgagttccaggacacaggacagccagggctacacagagaaaccctgtcttgaaaaaaaaaaaaaaaaaagaaagaaagaaagaaaagaagttagaaggcaataacaggaacaggttctgggatgtactcagtggtagagtgattgctggtgtgtatgaggctctgggctggtccccagaaccataaacatatttagagtttagaactaaatatcattagtatttaaaatggcatatggatcaaagaataagttaggaataatgagagataaaaatagaaatgaaatgtaacagaatatgtgagttacctctgaggcagtactgagggaacatttataatacttaatacccataaagttcacccaggactgactgcctgcctgcctgcnnnnnnnnnnnnnnnnnnnnnnnnnnnnnnnnnnnnnnnnnnnnnnnnnnnccttccctccctccctccctccctctttctctctttctctctttctctctttctctctttctctctttctctctttctctctttctctctttctctctttctctctttctctctttctctttttctctctttctctcttttcaaatctatctgttgtttgaggcaggatctcactgtgcagctccgggtgtgctggtgcttgttttgttttgtagaccaggttggcttctgacttgtagagatccgccagtctcttcctcctgaatgctgggattaaaggtgtgtacaaccatgcccagctttttagtttatttataaaatgaaattgtagttaatatgtttctacaaaacagtaagattatttcattgattaattttgaccagacttgaagggggaaatgataacttattttcttttaatttatctagaaaattgaagacacaccattatttcacttatcttttactcagataatatcaatagttactgagtggaccaggtgacaaaattggcttcaatggtgataatttctatcagcaaaatgtgattaatgtgaatttgtgaaacctgataaagcatataagacaagcctacagcagatgcaaaagcttttgtgtgtggttaatgtcacccttatgttaagttcttgtttgtttatttatttgtctggctttgtttttgtttttgttttttgtttgtttttgagacaggatttatcttcatagccttttctgtcctagaactcactatgtagaccaggttgactcagagatcctcttgcctttgctccccaagtactgggattaaaggcatgcatcgccatatccagccaatgtcactcttataacaataagtttaaaagtgtgcaaaaattatttttgtgggagatttatcatagtagtcaggattaataagacagttggtatatacttattcatagatatttgaaaataatggataagttaggactaataagttagaactagaaagagccttcaagttggtattaattcagactgttacctgtgtgcttgtttttataggtcagtatggaaatcctttaaataaatatattagacattatgaaggattatcttacaatgtggattcattacaccaaaaacaccagcgtgccaaacgagcagtctcacatgaggaccagtttttacttctagatttccatgctcatggaaggtgagtaaattcattgctctcagtatctgaagtcttttgaaatagtctgctaatggaagaaactttttatcctgatgtaaagcttcctgtttgaatattcatcctcaatgaatataccacattttttatactggaatttggtatatacattaaaaaatgccatcattaaaaatggattgcccttttatgtatttaagtcacttgtaaatgtttttgaattgtgactgtgaggtctaagcatggatatttttaaagggtggtcacaggaggataagaggttgtagaaaatgtgaggagccatagacagataagacatactttatttaatcagtaacatacaggtggctatgaagagagatgctgaactgaggcacaaattgcacacagggggacacatgcatgcatgcatgcacacactcatctggcacatcggccatacagaggtggggcagtggcagacacacataggcattcacctttgatcttaaggccatatatcacacaaaatggcactctgctaggaatagttatataacagatgacatcacatttttttttaatctggtgttagccatgggtgtcagctatgtttcagctaactcataccagatagccatattagcaacgtgttttctaagtattagctagcccttacggctggcgaggatgtggagaaaggggaacactcctccattgttggtgggattgcaagcttgtacaaccactcttgaattcagtctggcggttcctcagaaaattggacatagtactactggaggatcccgcaatacctctcctgggcatatatccagaagatgtcccaaccggtaagaaggacacatcctccactatgttcatagcagccttatttatgatagccagaagctggaaagaacccagatgcccctcaacagaggaatggatacagaaaatgtggtacatttacacaatggaatactactcagctattaaaaaaatgaatttatgaaattcctaggcaaatggatggacctggagggcatcatcctgagtgaggtaacccaatcacaaaggaactcgcacaatatgtactcactgataagtggatattagcccagaaacttaggatacccaagatataagatacaacttgccaaacgcatgaaattcaagaagaacgaagaccaaagtgtggacactttaccctttcttagaaatgggaacaaaacacccatggaaggagttacagagacaaaatttggagctgtgacgaaaggatggacattctgatcttttaatgtacaattcagcttctgcctcttccatgttcttttgaacttttaaatttctcactgtttcattgacatttgatttgtgctctccttcctttcatgtatttcttgcttatttttcttttttttaaaaaaattattttatgtatttggatatttggcctgccttgtatgttgtgcatcatatatgtgtctgttacccatggaggccagaactaggtatcaaattccctggaactggagttacaggtgtttgtgtactgctgtgtgggtgctgggaattgacttcggttctcttcagagcagccattgcccttaagcacttagctgtctctttagccctgcttgttttctgtattgtgttgttttcttcttcacaggcaagcactttgctatttagtattgctcagtatatttcatatctgatctaggtgtttttggaaaaatgttaatggattaatcaaaagattaatttgaagatgtttctttatactaaaaagattagggctagcagtttacaacactaaataaaattttatgactcttagttttaggtattattaaaaatcatccattctttattagtaccataaaataataatatcattagcttttctaactttagtaacctctcaaaataaacttactactgtgtctccaaatatatgtactattgtcttcctcactaaacagaggaggagatttcagtagctgcctttgttttggatgccacattgttgtataggtagatttttattaggtaagttacatattttatatttgacaaaccaaatctctagttcttttatgtgtctgtgagtgagaatgagtaaccatgcaagtatgcagtcatctacaaaataatttgattgttggctaaaagtgatctctatgatttaagccttggctgataggaccataaacatatagctaataggaatagtaagtaaggtgtgcagaagtcacttcacagaagggaaacttgctgtggtgttttggagatgaaatactgtgggaacttacaggaggagcacatcttattgaggtgatggtttgatggtgtagcgtctccttttctttgaaatagaaagtacaaagtgatgaagctatgtaagaaattatagatttcttactagatctattatttcctctgacttataagaaatgctaaaaccaggtgtgatgctacatgactgtaatctagtccctgtactcaagagacccaggaaggaggagctcatgttctagaacaatgtattctacagaacaagatcctgtctcaaaaaacaaattgaaatactagttaggcacatcataacatctctaataggatatgcatctgtgtaaagagtaacttgcattttacttttctaaatgatcttctgtgtgtttctattggataatgagtacactataaggaagactttggcttacccttaactgtagccacatctataaacattgactgtcatatgcattgtggctagagtacttacctgctttttcagcctttaaaagatatcaataagtttatttatcttaattgcaaaccagggcccagtctctcagaaccaggcaaattaatcaattatggaacatgttgaatacagaacagttagctcacatacataacgattttgcttgcactgtgtcttagggttttcattgctgtaaagacataccatgaccaaggcaactttcataaagaaaacaattaattggagctggcttacagtttcagaggttcagtccattatcatcatgatgggaagcatggcagtatccaggcagacatggtactggaagaggagacttctacatcttgatcctacagccaggaggagactgtcttctgcaggcagcaaggaggaggctcttggcagagcttgagcattatatatgaaacctcaaagttctgcctccagagtgacacacttcctctaacaaggccatgccgcctccaatgaggccataccttgtagtagtgccacttcccctggcccaagcatattcaagagtttattgatcttatttgaaaacctgcattatgattagacaaatattgcattgtattattgcattatgattagacaattatgatttgaatattttagaagtattccagcccctgtgtgttcaaatattaaagtccttttttataaataagcatatgaacaaactttcaactttgcttaatattaagggcttttttttttccaggccaggaataggtaggcggtgtactcctttaataccagtgctcaggaggcagaggtaggtaggtctctgagtttgaggccagcctggtctatgtagtgagttacaggataaccagggctgtgtagagagttcctgttcccaaaaaccagaccaaaataaaatactgtatgtgtgtgagtgtgtatgcatgcagccttttttcaagtctaagatttttttcctttctcccttgaggcagggactcatatatgttagtctggtcttggctgaacttgctacatagccaaagatgaccatcaacttctgatcttcctgcctccatatccccactgttgaaattataggcatataaccatacctggcttacgcagtgttggggcttgaattgaggtctttgttcatgctaggcaagcactctactaactgaggtatataaccagcccatgtctttgtggttttttgagacagggtctcactctgcatctcaggatagcctagaactgaagatatagataatgctggccttgaatttgtggcaattctagcttccttagccttcagagtgcaagaattacaggcatgagctaccctgcctggcttctaagcccaaaattaagaattctacgaaaaggcattggttttgaaagagttgaaagtttgtgaaaagtgcgacttgagccagtactacagttgttgaagaaggtattttaaaagaatttaccaattaggtgctaaggtaaaatacatcaaagataatttgcttagaataataaattttctggatttctgaaatgatttcatttggataaatgggattgtttagttagtgctatatttacatcaattatgactttttccttttttgattattttgttttactgtgtccaaatgtgcatatcttcccttaagaacttgaggtacagagcctgagtcttacttaggtttttacatatggttgtaatgaggggaaggaggggaggagaaggaaggaatgaatatgaaaatatccagaatatgcagaaatggcaggtctatcatattctaagacagaatttttctaataattttggataatttgtgcttctcaatccttgtcttcatgtaatagtgtataatgtaccagaaacttgtttttctatattccttttaaatactagctggagacatgttgcatcttgctataactatcatagagtcctaccttaactatcatgttccgtggtttgactaccatgcattttaggcttctataatgccaatggactataatctcctgaggaatttaattgatgtggtttgtaaaatgtggtttgtgtgctaccttaaatctcatttaagtcttggttttgcagttctgcattttgtgatgtaataactccatagattagttggatatgtcttgggctttgtttctgccatatcatgagttgggtagcagaaaaacccatcccttcaaaagcatttatttatgtagtgtgtgtgtgtgttttgtgtgtgtgtttctgcacatgcatatgaaggtaggagaacaattcttaaggagttctttcctttcacctttacatgggttttaaagatcaaactcaggttttagtaagatttgtgttttatgagcccttagctgttgaatcatctcagcaactttttgttttgtgtgtgtgtgtgtgtgtgtgtgtgtgtgtgtgtgtgtctttgtaagagacaaggtctggccttgcactaacagcagtcctcctgcctctgctcctaagagctgttttatttacgttttactatgtaactcagactagcctggatctcactatgtagcataagctggtctggtacttaccttgtagttcaggttgcccttgaacaagtgtaatcttcttatctcacttttataagggctatacttcttttgtgtttgtgtgtaagtgtacacatttgtacatccatgtttgtgaacatgaatatggaagtgagaagacaaccttggatgttgttcctcaggtgtatcctatctctttttttgaggcatgttattcactggtctacaacttgtcaaataggctaagcttgttgaccaaggagcctaagggattcattctcctgtctctgtttcccattgctgggcccagccttttcttctaaaatggattctggggatcaaactcaacagattgtgcatgcctaatggaccagtcagtctaggaggaacgatctctgttaattctgtggtgataacagggagccagtgacttttgatttggataatttcttccttatggaatgaagtaaaaacatattttgcttgaccctggtaaagacgttctatctatgtatttgactcccagctgttttttgtttgtttcttccaatttcacaaagagcttactctcactagtcagtaactctttgattttatcttgaaggcctttattgttgatagaataaatatggtgaaagtggggtacctttggcaggtggtgccattgtgtgctactaagaaattatgccaagcaacagatttaatgttggggaggagggagagtgaaaggctgtttaggagtggggacatgagagagaaacagagagatagggacagagagaacgaacaagacacagaatgagagagatagaataaaggagatagaggcaaagagggaatgggagagagagatgtggggtgcctgggacctttttttgtactgcacatgttgcatgggtggaaatgcctaattgctaacactggtcattttgcccagactgatattggatgacatcctgagacagagtattcagcctgttttacttctttgatctgcttcttttaggctccccttatttacacattttcaaatttcccactattggttatactttttcattcagtcctttgatttttgatttttgctagaaggcctgcattttgccaattgtgattccttgtacatcctaagcaggcgatctataacttggtatggtgagaaggccgttggctggctaaatacagatgactggtcagactcagactctggttttacttgtgctatattcatgttactgtgctctgacttgtgaaattattaagtgtatgtttttctgcttaatttgtgtttttttttttgcctttgtttacagtctgtagagccttagaactcttgtgaatgatacccaaggtgcacagagtgattctatcttgtacttctacaaaactgttctgcttattctttatatatgtgactgtgatgcatagtaagcttataaaaggagatttgaaaaaaaaaccttttcttttttttttaatttattctttaaagtccagactttatccccctcctgatacaccctccaactgttccatatcccatacctcccccttgctcctgtctccaagaagatgttccccacccccgttccaccagacccccccactccctgggaccaacttttctatttaaaaaaaaaatgttactgcactagtgaatggctcagtaaagacacttgctgacaagcctgatagcctgagttcaatctctgggacccacgtggttcaaggagagaacagaatctcagtgtcttccaacctctacatgtgtgtactcacacacacacacacacacaagtaaatgatatgaaatgtaataaaaagtatactagtgaaagcaaactcataatatttgatgcttatattggcaacttacctttttattcttttaaaattagtatgtaagaatatttttgttaaaacctttacccgtgagcatcatgtgtattgctcatattcactcctacaatagaaatggaaagaaaatatagatagagtgactatctcaggcatctttataagaagacagagaaaatgaacgtctggaaatggcagacatgtctcttgaatgccttgtggtttaaatgagaaatatcttccataggtttatgtatctgaatacttggttccagctggtggttctttttggggaggttatggccatctgttttcttttcagagttgctttactggtctaggtcctttgcatgtccatcgtgttagagctgacttgtcagcatttacagcaaaacttgctattttgatggagactggtatatctttagataactcggaaagttgatagctttttggaaggcgtgctaagtcttgatactcaggacctcatgtcctaagcccactgtgtgctaagcacacattctaccgcactgtacacccagcccaacaacactacagtgtcttcatatcctgaatctgatacctctatttatttaagtcttatttaatttctttgaaatttttttctaaagagatttcagtgtagagacatgatacatcttttgttgaacttattcctaaccactttaaaaatgctattgtacagagagcaaattgtctgtcttagagttgtaccatttatggtgttgacctgggagtgaattaaaaatgggtgatgttgagaaaggcaagaagattttagtttagaagtgtgccacaatgtgaaacgggaggcaagcataagactggaccaaatctccatggtctgttcgggcagaagacaggtcaggctactggattcttttatacagatgccagcaagaacaaagttaccacctggaaagaggatatcctgagggagtatttggaggatctcaaaaagtacatccctggaacaaaaattatcttcaccgggagtgagaagggagaaaggctagacctaatagcttatcttaaaaaggctactaacaagtaattctattgccttatttattacaaaacaaatgtctcttgggttttaaattatactataatttaatgcatataccaaaattcagatcatgaatggctaagtgtttttcttatacagtcctaatttaagtaaaactggattgtagtaaagtcgatattatctttttaaaaataacaatctcagctgcatacttggtatgtactgctcatcctttctcaagataagagtgaacttaattagtaatgttctactttccagaaagatgggggtgttacctcaaaccattaaatagttttataattagatttataaaactgggcatatgaatatgtttaaacactgggaaagttctatcactatctcagaaacaagaagacttacttgtgtttcagtttgtgttcactggcttgttacaggcaatggttaaatatcaggagggcaactatctattctggacaatgctgatttaattataattccctatgtcaagtatgctcttttaccactgagaggtactttctgtggtttttgtataatatcaaataaagagtatataatattaaaaaaatactattgtagctgagaatggtgacatacatcttgaatttcctagtacttgggaggcagctgcaggtggatctcttgatttcaaggctagccagggttatatagtgagaccctgtctaataaaacaaaacaaaacccccattagaaaaactcagacacacacacacacacacacacacacacacacacacacacactaattgcaattgtttcttaaatttcctctttcatgtgtttgcttctagatataaaaacgtgctggtgggttttgttttggtcttggtatattagccctgtgttttgtgactttattagtgtccagtagttgattttatttcatctacaaataaaggtatatttatttgtttgtttatatattgagttattgtgctatctggtaccttcatttagtgttggaaagaattggcaagtgcaaatgcctttttatttctaccttaggggaagaatgattgtctttaatattaaaacatattagcaatattttgataggttaaggaagctctgactcttgttttctatcagtttttatcttgagtgagtgctgaaaatttcagttgctttttctacaactaatgttatgactgtgtgggttttctcccctttgaatacagtcagttacattgatggtttttttttacacatttttaaaaagatttatgtatttactttatgtatgagtatactgccactgtcttcagacacaccagaagagggcatcagattccattacagatggttgtgagccaccatatggttgctgggaattgaactcaggacctctggaagagcagccagtgctcttacccactgcgccatctctccagctctacattgatttttaaatgtaaacctacctgactcctgaataagctaagttgaccatgaaatattatttttattaaggcacttttctggtttctctgactaaatgcctggtaagagacagtttaaggaaggaaggatttctccaggctcatggcttgagggcacatcatgacatcatgacacagaagacacaacagcaggagtagctcaggacaagtgatggcaggagcaccaggctgcttgcttacacttgtacagatcaggaagcagagaggtagccagaaccaggcctgcctctcagagaggcaccataactaaaagattctttactcagttctcgttcagaccacatgatcattttttatattgccatttccttcttgtccttttcctcgtagtttgttttctcctaataatgctaatatgctccccctaattcagtggttctcaacctgtgggttgggaccccttggggacacatatcagatatcctacatgtcagatatttacattatgattcataacagcaaaattacagttgtgatgtagcaaaaaaaatactttatggttgggggtcattgtgttgtatcttaaggttgtctttgttttgttttgtacctttttgtggcactgggctaaaatagagggccttggcgtatatactaggtagtgctttatcactgaactatactcctagaaattaagatgttaatttacattttgttttttaagtaaagaataagttcatatatttcaagtctagatggtgcagaagagtaaaagggacaatttcctttcatttcctgtccccagccactcattttccattccaggttgacccttgcttttaatttcctttttatttttaaagtcatttggcatacacttggacactatgtctttcacacaaaaatgttctttgcagaaatatgtgtgtgtatatgtatatgtttattcataatctttactatttaaaaaatatgatatggactggaaagttggcacagagggtaagagcacttttctctttcaaaggacccatgtttgagtcccagcaccaatgtggtagcttacaaacatctgtaatttcaattctagaggatctagtgccctctttggacttctacaggtgtcaggcacacacatggtacacaggtatacctgcaggctaatatccactcatttacataaaataataaaataaaaatagaaaaatatttaactgtacttattatgctatttacttttatattggaggaataggggccttctatgggagacttagacagcgaggctctgtaactaaggcttcctccatgctccctacagccgttcttgatgagagagacagttcaagcttatccatactgtttattgactgttcatcatggaaaatgggttgtatactacttcctcagggtggactagagattaaataccttttgtagaaaggaatgttctggtagggaagcttattggctaaaccctgagggcccatctaaatacattattagcatgaagaactaggagtgtggtcatgtgtttcaggccaggaatctggtagggagcagggaaactccttacaaatgagtgcttataatttcttctaaagttataagttcaagaatgggttacagaagtcaggaaaatcatttccttatactttttattgaaaaaattttatataatatattctgatctttttactcttcactgagttctttccagatcttccccatatctctacacatccaacttcacttttcccctttctttcaaaaaacaaaacaagacaaaaaagcaagaagaaacaagaaacataaacctttcagaaaccacaggacaaaatctaaacaagtaaaagtctaataagacaaaaaaaaatggagtaaataatgcaaaataaaacagaagttgacaaaaataccattgagttctgtgttaactaactactcctgggtttgtggcttgctcagaagtgtggttaatatacacaaagagacttcattggaggagacagattttccctttgtccatgggtatcagttgcagatagtttcttggtcaggggtaagacattgtgtctacctctccctctcagtactgggctcttatctggcttgaacttgtacaggttttgtgcatgctactacagttactgtgaattcattatgtgcatcagtcttgttgtggctggaagacatgatttctttggattcttccatcacttctggctcttagaatctttttgcttcttattctgcatatatctctgagccttaaggggatggacttgatgaaaacatcctatttaggactgagtgctccagagtttctctgcacattgtccacttgccggtctctgttaaattccatctactgcaagaagatgtctctctgatgaaggctctgatctatgggtatagcagtatgtcattaagagttgttccaaaacacaagaaaatcaagaaggaagaccaacgtgtggatacttcattcctccctagaatacggaataaaatatccgcagaaggagttgcagagacaaagtttggagctaagatgaaaggatggaccagccagagactgccccacctgggggtccatcccataatcagccaccaaatgtagacactagtgcatacgccagcaagattttgctgaagggaccctgatatagcctcctgtgaggctttgccagtgcctggcaaatatagaagtggatgctcacagtcatctataggatggaacaaagggcccccaatataggagctagagaaagtacccaagagctgaaggggtctgcaaccctataggtggaacaacaatatgaactaatcagtacccccggagctcatgtctctagctgcatatgtagcagaagatggcctagtcagccatcattgggaagagaggccccttggtctagcaaactttatatgccccagtacaggggaacgccagggccaagaagtaggagtgagtgggtaggggagcagggcaggggagggtataggggacttttgggatagcatttgaatgtaaatgtaaatgaaaaaaatatctaataaaaaaagtgggaaaaaacaaaacaaaacaaaaaaaaaaagagttgttttactgccatgttcctttagtaaaataatagtatgtagtttttattatttattctcctgtacctgtgacctatctagtctcaggctcttgaccaagttagcagtgccaggtatgggttatatctcattgaatgggctttaaatccaatcagaaagtgattggttactgcaataatatatgtgccagtattgtaccactttatcttgtgggtaggtcaccattgtagatcacagggtttgtaactgggtgatactgatgattgcttttctctgtgtatagccagcagagtacattccagtaccgtgaatgctagtcattggagttctcatagtttaacagtaagtgttgtctttagcaataaggcctttctatcaaattgtgaagagtagccttggcaatagcctatgatgtttggaggtttctgtaagggccctttggccaatgaatcaacaagatgcaacctatttctagccttggaggttttattggtagcataagatggtctagttggggcattgtatcttattatttagtgactcttatttgtatctattttagaaagcttttatagtagtaggattccatatggtttttcagtggtttagtgttagttgtacttcaccgtattcctttctttacctttctctcccatctccttccctatttaatcgtcatattctacttaagccttttgtctcttttataacacaaaaagctatttcttctttattgagatcttctctcttcattagtcccttactggaatcttgtgttcaaattgtagcacatatattgagagcttaaaacctaacatggtcatgtaagagaaaatatacatttgtattttggggtctggattacctcactcaggatgattgttttttacccacagatttcacaattaaaattttcttaatgacagaatatttcattatgtaatgtactacattttcattatttatttatcagttgatggatatctggactactgctttctggctattatggacagagcagcaatgaacatggataagcaattatctctgtagtgggatatagagtcctttgagtatatgctcaagagtgatatagctggattttgaggtagattgactcccagcttcccgaggaaccaccaaactgatatacatagtgtctatactggtttgtgtttgcaccagcagttgaataagtgtttcttttccctcacatccatataaagtctttattttcattgatgcaggtaataaattcatacctcttaagcatagtaatcaagtactttacctcttagcgataccacaagccctacagtttacttaactaatattagtttgttgtaaaggacgggacttaggaacagcaaaatgaaagtgacacaaaggacagataggagtacagaacttccatgccctttcttgatgtatcacctttgcagtacttccatgtgttaaccactggtggacactcaccaatttcactgactgtgataatgaagtgactgaacatgggctgaccctcagacagcctcaggttgggctgatcatcagatatgcccaagtgactgagggctggaattttagccccagagatctataaacatgttacacagcccctgatgaacctgaggatatgtgggggccccatgttcagacacctctttatagatttgggtgtgattagaaatggacacttgaatagggatgaggacactcctatcatccagaagatcccagagttttaaggaatttgtcataggaaatggggacagaggccgtttattgaagtctgttgtactggaggtcatttcattatatggaagcatgcctaagaattctagaagaattcctgtactagaagccactgccactgattcttttgatcagttttcctaagcagatgttgtacagacttatttatgtcacaaatgagtatagtgactggtgcaaatttgtaatgtgttttaaacaaggtttcttcctcctgttctactattcaaaacatgcttgagaagataaactattacaacacatctttgttatatttgtcataaagatcatggagtagaaattgtattgtgtgcagacttctgtaacaattatggaactatgatatacttttaagagtttagtgatgacacttaagttgttgccatttatccacatttcctgcaggctaagtattgtactgactttatgttatgatctaatccttaaaacaattccacaagatgggcagaattataatttacttcagtttcgctttgagacatggtttcattttatagttccacctggcctggaactcactatatttcccaaatagatgaattgtgttacacagcccttgtcttgtgtactttttttttttaatagtaaaagaaatcatttaggatttggatcctttaaatttcttttctcatcctattttgcagacagttcaacctacgaatgaagagggacacttccctttttagtgatgaatttaaagtagaaacatcaaataaagtacttgattatgatacctctcatatttacactggacatatttatggtaagttggacttttatctgacatattatttgattttttttttttttggtttttcaagacttttttttctacacacaggagtataatgataaatataggcagatagctcagaaaaggttttgtaaatactgaggagaggaaagaaagtggcagaggaagaatttcttgtcatttgatggttcagagtgtcaagaattctagaagattctaagatcctttttttttctttttttctttattagatattttctgtatttacatttcaaatgttatcccctttcctcatttgccctcccaaaaccccctatcacataccccctttccctgctcattaacccacccactccggcttccctgtcttggcattcccctacacgtgggcatcgagtcctcacaggaccaagggcctcccctctcattgattaaaaatcaagcttaccattttgttggccagggacctttcccctagagatccataaaggatggagaaagtgttcccctgactctgtggtccctgattcaactttgatttgtacctcagtgtgcaatctgaacaggagtcatatatctatgagataggggagaagagattgcatctgatcccaggtggctgtcttatctctttagaagcccatatctgtactttggtttatactgtcctttccctaaatacttctgtccccaaaattagttgctcaaaaaccaaaacaacaacaacaaaacccaaaacaaacaaaaacccaaccttgtcaatgaatttccaactttgttaaaacaaaagcaaaaacaaaaaaacaaaacaaaaccaagatggtagtggctgttggtatacattctttctgcccagcctttcctagactggaccaccgtgtgcagcagaggcacagagcctggaagagatgaaaggtctacttagagtcacttgtcttgcctggctttgagcctggtattcccatgctcaaggcatgtagggaattttgtggagttttaaaattttaactaattaattaacttaatccaattaatttttttctgttttaaaacaaaacctgaggcggtagatcaggtcatcttaggcaatggtctttgaaaatgaagtcatctgtggagccactttacatgatgtttaatagtgtaccacaacaaaaatctgtaacgctttgacgcttggtgctttcaagtttaagagttactgttgttttagcctcttgtttgtttgtttgtttttgagattatcttattatgtagtctacactggcctagaactagcaaacctcatacctgtctcatacttgtagttgataagactacaggcatgtaccaccacattcaatcagagttttcaaaaaaactttcaatgatttttataatttctgattttccaaggaagaaataagtgggaatttctgagttatataaatagaaaaagttaaaaggaaactgacagtagagatcatcttagttcaaaacaatataacaaagtcacctaagaaaattttcccaggttctttctccctaaaatccatgtggtttgttgttgttgtttggttattttacacttgtaacaaatatctcttaagagtttaaaatgtgctgggaggcacagacacatacttaatctaacaggaaggtcaccagacagcaaagtgggacagacagggaagtcataaagaaactaacataattcagacaatcctcaactattaactcaacagtggtcaacaatttccttctgtaaatgagattttttttttgcttgaagtcataacattttgaaaaattaaatgcttaaagagaaacttttaattttttattatactagataaatgatacatggttttacttacctgtacactaatgttactaaattttagtggttctttgcagtcttctaattgtaaccaaggaaagtatttttggcagtttctagtactctcttacattcttcatcacatgtcttactgggcaaactgtgctgattttgtaggtgatggtcataaaaaataaaagtataaatgagcttgtaaagaaaggtgatgccatttaaaatatctcagggatgagatttgatggcacacacctgcaattctgataatctggaggcataggcaggaggagcatgagttcaaggccagctaagtctacacaacaaggcggtttcaagaaaagtacagattttattttcagctcgtgatttattaaaaatcaaccagtgttaatgtgtaacttagaaatcttgagaggtcgggtcgtgttatttcacgtgggtggtgtatgtgctcagcatgtatcaggaccagacaatttggccccttccttctccccaaattacagaaaatcctatgaggtgatttcagccttgtcttcctctttcctcctcttcctccccttttcttcttgtcatttctctctctattttccactgccctcttccttctcttctttccttccattctttccctaccctgcctttccacttttctcctctccttttttttcttcccttcccccttctctactttaccctccctctctttcctttcatatggtctcttctctcctctccctcccttttctctcttctcctctctttgtaatgtttgggattgagaccatgaaaatttgtttttagtgagagatgtttgttgttgaagaaaaagtcttgttaatagtgtccaggctgatttcaagcactcccatcccagtctcatgccacctttgttaatttaacttttgagtcctgccccttttaaaggcatgtgcatatagttttggctgcttggaaggttgaggtagggggagtttgaggccaatttgagcaatatagccaagatgctctctttaaacaaaaccaaatgactggtggtgctgtaacatggctcagaggtagaattcttgtgcagcactcgagaaaccatgggttcagaactatcagagcaactgaaatgaagcaaggtgaagctacgtgcctccatgtcacttaattctgtgcctccatgtcacttaattctgttgacttaggtttatgactgtattgaaatagaactaaaagcactcattttttgatgttacttctcttagtagagaatagtacggtagtattacaaatctgtccagtacttttttcaaagactcattttttaaaaaggtttaaaaatcttacctcccaggctggcttagttctcagtgtgcagttcattctcactttgaaattgcaggttcctaaactctggtattaaaagcttgagacactacatctagcttctttgtccaacatctcaaactagattataggaatgagtttttttaaaaattacttctgaactacttggccatttcatgtatttataaaatttataggtggcaagaaggccaaaaaatgtacaatgtcaagttagaaagaaggttttcacttgtggtaaattaggaaaagttttccagggtactttaagtttctttattctggaaatacctagtttattagaggatctctttgctttttaaaaaatttaagttaatgtgatgattattgaatgactgctatgtgtatgtcagtcattgtgctaggtagtaggcatatgattgtcagtatgacagatgttccacttttattgctgtataagtaattgtatatctgttttaactaaatactggttgctattcatatctcaacttgatgtattttacgtgaaaattaatttcccagcacatttatacttaggatagttgtatatatgtgaatatgtgtgtgtgtgcgcattcatatatgaatggcttttttttaaataggagaatgtgcaaattaaaatttcaagaatttgttgctttcatcaataggtgaagaaggaagctttagtcatgggtctgtcattgatggaagatttgaaggtttcatcaagactcgtggtggcacgttttacattgagccagcagagagatacattaaagatcgaatcctgccatttcactctgtcatttatcatgaagatgatattagtaagtattcatgctttatattaggtagtctttgcaaaggcataggaatcctcataactgtgtggagacaaatgtagcctgggctgtttctttcctaagcttattcaggttaaacaaccagagtgtaataagcaaagtctccatttagtaaataatgggtctctgtggtatagcagttgtcaacacaggccagtcatactctgttgatataaaacaaccaattctgtttgaactgtgagttagccaaaccgacttgaactgtcattctaaattctggtatcagccagtctgcttggttacaacatctgatgtctgtggcttcaacagacattgtgctgaaggtacaacaatgtcttatcttcaaatatccatttctatatgaatatttatgtaatataggatttttctaatttctaaatccactgagtgcttctctttagaatcttgaaataatgatgtgaccacagcctggtgtatgattccaggctttccatggatttgttgggtaattctttttctatgtttaaggatagaaaattcatttaacctttacattttaattctgtcagtttgtgtttccgtggttattcaattgtgagactgtaccattaaaataacacaaacacattcctgtaatttctatgcaccttgaatactttccttcctttttaacgtaagcaggctagtttctctagttttgcctgttttcctgacttggcagcttccttttgctttcattttttttctacagatagggatttattatccatatttcattcctgtgcttcgtaatatactggcaaatgtgaattattttgcttttttgctccattgtctctgactgtttctgtgtttccatctgcccaactgcttgttgcttctgatggtgagctgctatgggagaatagccaactttacttaaggatgtgattatgactgttgttgtttgcagcctcgtggatttattaatgctgcctcgcttgcattttcagtcatccttatttgatacctttcccactctacctggaatttcttttggcctcttaagccttatagtcctcctcccataaataggaatatggattctttgcttttctttctactgacagaacttttcttcattgggcttgtgtttttccttgaaattttcttataaattaagtcttttttgcagttttatctccactattacaatgtgcttttctacaaatacaggttctgtgggttttgcccatttaatattcaagtaacagtatctgtgaagtagatcttgatgaatttctaataaaatgttgaaatatgctccctatcgagtgtcttcaaacttggaccaggtctttctggacaagaaagttgagaagtgtgaccgctcaggctggttttcctccttcggcactgtgactgctgctacgtctggccatcagctcccctgtggtttgtgctgcttgtgacctgagatgcttctttctcctgtgttctttcttctgcttatccctgttttggtttttgttttgttttgctttttacatttacacttcccccttgttacagctcataacttccaaatatcttacgtcaatattttttattaggtaccagtagtagtattaaaacttaaagatagttatgtttagatgattttgcttataacttctctgttaagtggaaatgcagtggtgtcaagatgggcatatgggaagcaacagtttataaaaatgtttatcaccttttgttagtgtcaaatgaataggtttgttacattttcattcagtgtattttaaactttattcatacaaaaagctgagttgttagggcaggagagatggttcagtggataaaagtgtgcagcataagtgtgaaggctatcctattatcccataaaagcctgagaggtgtaacagcagcatttgggaggcagagctagctagactatccagaactgatggccccaggttcaccaagagactttgagcataaataaaatggagagtaatcagtaagacacccaatatccagttttggctttgacttgcacctgtgcccatgtacccttcccccacatatgtaccccacacagttagtataaaaaccaattttagcaagtatgctaatcaaaaacagggagttagacttacttgtctggcaaactgtagtttacctactccaattataggggattgacaagtaaatttacttttaattgaccatttaaactctggatgttggtgatcctaaaagaagcagcattaattagaaggatagttgtaatttaatgttgcttggcactagataaaattctttatgtatgttaactattttaccctcagaggctctgtgaggtataggaaaacattattcctgttttataggtgaggaaaggaagacttagaatctaatgtgacttgtggatattgtcttctgtgccatgtacccatggggaaaaacagtataatcctcattaccctttactactaggattactggggcttttctgaaatctgcacgccttcccaaaattatacaattacatctattgctgtgttagaccaaaatctattcttgggtttcttttttctttccctcagctagtgaaaagaaagggtctgctcctaaatgcatgttattatttttacataactagcttagtgtcaataatttattttctttttttttttatggttgtagaagagtaggaagttcttttttattttttattttttttaataatttattttcacaactgaagtactacttgattatgtatatactgtaggtatgtataagtgaacttacataaagattctgataatttagctatgctttctgaatattcattttgtacctattggcataagtgtatacatccatgtggaaaatgatgcttttgttctggagaacattaggtgatgtgttttaggcagaaatactgagcagcctctccaggtgcttttgatacacacctggatgtgatgctgctcactgcatacagttatcagcttagaaatcacgtatgctcagttctccattgcagcagtaaaaaacactctcatagtattacacgatgacaaagcaaaaatgccacttagttctctacttgctagcatagtttattttgaagaaatagaaaaaccactgtctggtaaactagtatttttttttaaagaattgtttattttgtgtatatgagtacactgtagctgttttagatacatcagaagagggcatcagatcccattacagatggttgtgagctaccatgtggttgccaggaattgaactcagtacctctggaaaagcagtcagtgctcttaactgctgagccatctcttcagccctctaatagtaattttaaaatgtgtagattttaggaatgcctgactattttctccttggaaccttctgtatactctgaggcagaagtttaagtcatttttttcctgttatattttcataaaaatccttaaactctgaatttaaaaaccttttaattgtataaagctatatagaatatttggtttattcttttagagttattgtttttatttattttcctatgtgtagacatttgcctgtctcttctaggaatgtaggtgctcaggctcttagcatgtgttagttatagctgtatgtatctcttcttttgtgtgtgtgtacttcagtgagaaagcacataatcttatgaacttaaaaatgaaggtatttaaaactttgttttaccatctcaagatggagattccattggtgtagaaatgttatttatggaggcgtgagtatattacttttaatatctttaaaatatcagttagagagttgcttttcgttgtgggttctcttctcctctaatcacctcgaggaaatataaatttctccatccattttacaggtgaaaaaattgagaaagccataagaaatggcagttatttttaaaatgatagttaagtagaaatgtaatatgcttaaaaattaaatatgaagacaccaggtaaatgaggaacatctgcaatacagcatataggttatttgagtaataaagattccaagataaaatccagcttgtgtttcatagggagttctgaccatcctagacaacagaaccaagccatgtctcaaaaaacaaaacaataagtacaacaaacaaactacaatgcacaagcaaaaattaggttaaaaaaaaaacgacttatttagtcagaaattatacaagtaggacttgttgagaaaattttagatcaagaccttttctaatttgttaccatatgtatctgtatatatatttatctttataaagtaaaatatagctacaataaaatacaatgtttcagaagcacaaacatcaaagatctgttataaagcaactctaagaagtaacattgatgttttttgctcttctgagaactgctcatgattctgttttacagaattttacaaaaagattagattagcaggacattgtggctcatgtgtgtagtttagcactcaggagcctaaggcaggaggattgtgaacttgaggccatactggactacataatgagttccaagacagcctgggctatattatgagactttgtcttaaataagcaacatcaaccaaaagcagagattaatttatcatacaatctagatgttatagttgagtattttcaaatgtacaatgtggtgaaatgtttgggaatattcagtctgttactaagaagactgaatttttaaaaaaatcttaaaattttacatctgtgttcattttaaaaatcattataatagagtattggcacataagttaatacaactcaggataatattaacacatattagtcaaagcatctggccactttttaaatttttttcttttcaacttttaaagagcaagtattgtatatgttctggacaagttctacagaaccatatttccaactcagcccttaattttcaatttgtcttttgtagtaatctgtaaaaacagagatttaaaacatattttttggagaagcagtttagaaatgttagataattcctagttgttgatggaatgaaagccagtaggaggctattgaaactatgtttttgttattgtttttaaatatttgtctttgcatgatagatgcctttgagaaagagccatagaaaacagctgctggttggaaattaaattcaattatattggtttataaatgtacaggaaagattaagttaaaaaaaatgcaccgtgatagcaaattctgacttggtacaagaatgtgctaaataaaagctgtaactaaaacaaagagggtggaacaatctcataaatcataaatctcataaataagttggatatagaaaggcttcctggggattgtgacattggatttgaaccttaagacaaaaggtctttgctgaaaagaatctgtgattacagaagctgttacctggttgtgaccccgtctgtctgtctgtctgtctgtctgtctgtctgtctgtgtctgtctgtctaactaaaatttgcctgtcatacagcttaagaaatttgagaaaagaaaatttagaaacaaaaacaaaaagtccaagaactaacattggctttgtcttggaggcactgtggacagatgtaccatcccaagatggacttataaatcaatgtgttaaaagtattcttatgtatttcagttctaagcttttcagttcacaagtgtgttagttttgtacttcaacttgtgattttttttccttaaaaagcttttagagaaaggatttagtttcttatgttctggggttttagtcaatggtttgtttgccctattgctttgtgcctctgggggcaacagtgtatatatcatggtgggggagcctggtaaatattgttcactttatgtcctctgggaattcagagaaagtgacaggacagggcctgggtccagttatcttcttcactggttgtttctagtgacctaattcctgctaggtttattccactgcttttgagcacaataggtggccaggccttcagcaaatactccattaacaggtttgtatgattactttatttcttaactgacatttgaatggctgatcctctctttaggtcctggtatacggtggtgaatactgcaaaagttcatccattggacttcaaagtctagtgattctgtttataattgatcataatacagcaaattttcctgttgctctgactcccatgatctccttcctgccagcactaatcctttgttcctaaaggccagggtgagggtagacttgcttgagtcagctctcccacctgtttcctggaagatgaatgctgtgtgtctgctgctctttccatccttcccaaccttacaaagctggggctggggctggggctagatcagaggggatagggctctcacaccggaattgcagagaagcatttggagtccttctctacctctacattctttgttctttctcctcttggttattgttatttgggcaactttggaataaatagaaattttcttagttaaggaacaagttggtggtatgacaacagttttcatatattatctgcttgtggaggtgttctatttaaatttctgctcagattaaggattgaaatatttaattgaatttgtgttaaatagcacattactagattttagaacttcttttgtctaagagagccctggtgaagaacctagatcttaactgcacagaggtgctgtcctcacggtagtgaagctgttggaagtgggtgttttgtgactgttggtgctgggcagataattcaaagaataaatatcctgctttagtagagtggataattgagagtcaactacttacttcctgtgtgaggtggtaccataatgtatgtgttattgatatttgtgtttcctacagaaaacaaaagcaagaggtttgcatgcacaggaactggaggaaaggcaggagctctgagcggatctttgtttgaaactggctaatgttctccactcactgctcattcttttgaaagaatctctgtttggccttttcagggaaccgcagtgcatcctatgattttgcatctcaatgagggcttattcattagttgaacaaaggctttttctagaaatggggattatattggtcagtaattttacagnnnnnnnnnnnnnnnnnnnnattgtcagtaattttacagagaaaatgtcattgttctttttttttttttttttttttttttttttttttccttggggttaatgtggtggccagggaaaaatagtctcttagaaattttggaagtatacagacaaaattatatacttggcctctgtcctttttctgtcatgagaattttgtgctgacagaatttgaaacatataatagtgttttgttgccttggaatttttttcttaccctaacaagttttcaaaataatttatgtttttaacttatataaaatataatttacaaagagaaaaacactacttgtttaaacactaattttagttttttcaattacagcatattaagtaaataaatgatacttttattgttctacattcccatatgcattgataacattagaaagttttagtcttttgacaaaagtatttaaacattatagtggttatagttttttcattgtttattaaggtcactttgtggagtttgataagtttgtaggattagttttatggcctatgctactgtgcatgaggtctccttggtgtagctttgtgtgagagaaactgcaaatgtactttggggtagaatggaggtttctaggctgtgttgggaacttaaggctacaggtcatgactttgaactgagaaagtcctgcttatcagaggtgtggataaagagttgtatttaaaggggatttggctgggagtcaagggagtaggataggggacaaaggaagtaaaggtgaatgcagtaagtaattatgaccctagatgttatataaactgaataagcagaaggaaactgccctatggtagtgcacaggatgagaggcattggtgaattgaaagatttattgtgtttgaatgggttgggtctatctagaggtattgtgtagatggtggacagaacataggatgctgaaagttgacgttgtggaggagctagagaaagtactcaaggagctaaagggatctgcagccctataggtggaacaacaatatgaactaaccagtacccccagagctcgtgtctctagctgcatatgtatcagaagatgacctagtcggccatcagtggaaagagaggcccattggacttgcaaacttttatctgcctcagtataggggaacaccagggnnnnnnnnnnnnnnnnnnnnnnnnnnnnnnnnnnnnnnnnnnnnnnnnnnnnnnnnnnnnnnnnnnnnnnnnnnnaaggataataaccagcatatccatctttgaaaaaaaaaaaggaaaaaaggaatgagaagttcaaaagtagagttgtagactagagtaaagatctaagaatactagagggatcatctgcatgaatgttgtagtttcaaagaattatgatggttgatgtgagagtgagtcaagatctaaaaataaataatgggaagtgactttgaattcctgtggtacatgggatagtcactggtataatctagtggctattttaataatccaaggcagaaagtagtagatagccctgagtacttattaaaatgagagggggggagataattatctttccaacaataggttgcccttgacttcatgatgaaagtaaagatgctcttggcctttgccagatgatggattttagaggaactgattttattaaaaacattctttttttccccattaatcaatttattcactttatatcccatctcctcctagtcccgccctcacaggcccttcccctgtccctccatccctctctgagaaaggaaggggaagtcctccctgttaccaacctaccctggcacctcaagtcactgcaggactaagcacatcctctcccactaaggccagggaggacaggccagagaggggaacaggatccatagacaggcagcagagtcagggtaagcccccacctcctgttgttaaacatgtactcttggttatagagagctgtaatcttttctcagtgaagtaggggcatagcagttttattattaattctaggctccctttcaactcggaggagtgacaacctattagatattggttctgatatgtttctactgactttctctcaattcctgctgctgatagctcatataggcaatatgatatactctgaacactgacacatacttgactattatatgaagactagaaatctactctaatatcaagtatatgtaattgcactgtgttacagatagatgtgtttatgtgtataaatgtattaactcaaatcttttatcagtaaaggaggaagtaaaatacccaggagatattatttgttagattattttagaattaataatgaaataactagcctgcatccataacaatgtattggtgaaaaccagtgctgatcttaatctcagatgacacagtaccaaacgctgaaatatccctaaagatcaaaatccttaaagtctaaaatagcagaaattttaaatgatgcatagtaatgtatagtgggtagttgtaattgctttaggaggctgagatatgggagtccagttcaagagtttgaggctagcatgtgcaatatggcgaggccctgccactcctctctaaaacatcaccactctaaaagactaaagtcccaaatgttggtgtcccaaaagatgaaatctccaaaacaaaaattctcgtgtgtgtgtgtgtgtgtgtgtgtgtgtgtgtgtgtgtataaagtgagctatgtgtgaggaacagaaaggcagattctaggtaagggattagtcttgccatatggcagcccaaaggtttcattttaaaactgttctcaggtgtaatggctcatgcttgtaatcctagaactggacaggctgaggtgagggggaatcatgagtttgaggccagcctggattacatagtaagttttaaatcagccttaactacatagggagaccctgcttaaaacaacaaaacaaaacaaggctgttttttgtcttcatttgcttttgttttagctggtgaaatttgaaaataattatttgcagagtaggataagaagacttttgttctacagtgttgcattttgaatattacatgttatatataatagtatattatattatatgcagtatattatgtgccagttttgtgatttgtatgagtgtgtttcaaatggatttcccagtaccaaaaaaagagtgtgtggagatgattcagtcgtcttgcaggcatgatgatctctgagtgcataaccagcgtgcatgtaataaactagaacagacaacttatgcaggctccttgccagcaggtccaggcaagaggagagaggtcctggtcttactggggtctctctggggctgagctagatggcgagtgtcgatggcccaaaagaaaacatacagagccaggagtcctgtagaagcaggaactcaactttatggcactggcctctcgcttatataagttcagaacatagggaggggagtcttggtgggtaagatgatataggaggcagagaagtgtgacagaggatatggagtgatggacagggccagtggcagagctctacaacagcaagggcggggcagaggcagggccaaacaggtcttgctgagtcaccccaataagtggggagtgactgagacaggtctcaaaattcaagccagtctcaggtttgtcctcaaggcccaaaccagagcctaaatggggcccaacaaacttacacctgcattaccagcattggagaggtgagacaggaggatctctggagtttgctagataggtaggctaactgaatcagtgaattccaggtttagcaggagaccctgtctctaaaataaaacaaacaaacatggtggtgtggtgatggtggtggtagtggtagtgtcatcgtctagagagatggcttagtggttaagaacactggctgttttccagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggagggagggagggagggagagagagagagagagagagagagagagagagggagagagagagagagagagagagagaggagcaggtggattgaaaagacccccaatgttgaactcgtgtggacatgcaagcacatatacatacaccacatatatatatgtaccattgctgttaccatggaacaacacagaatcatggcatgacagtggggggggaaatctagtagtgaatgctcatgtctacatatatagactacatagggatttcaaaaggagcagcaccacatgacctaaaagacaagcaaacagctgttcattcctatacagtacttcaacataaagctgatgctgtaaaagtcagccagctctcatatgcttcttctgtacagttgctagtctttctctgtagtgtactttttcatatgcggaactttgagtatttttcattttcgttttttcactgtttaaaatttaacattattttctgtaatttgctatgctatttattttatcccttattatttataatactgaaagtaaatagtagtttggactaggttcagttttattttatggagttttgtgtgtttgactccatgaaaatacattataagctgggcatagtggtgtctttattcctagcacttgggaggcagaaacaggcagatctgagagttctaggccaacctctatattggaagttctcgagcaaccagagctacatgttaagatcttatatcaaagctaacaaaacctgtagcattaccttaggtgtaaattgtatgtgtgtgtgtgtgtgtgtgtgtgtgtgtgtgtgtgtgtgtgtgtgtgtgtatgtgtgtatgtgtgtatgtgtgtacacatcattgaactatccttatttagtcaagaatttttgcatttttgaatgataagcttcttttgagaacttggctattgaagtaactgcatacataatgttgttcttgtgtggtttttaattgatctaatcaaaagattcagtttgtcactgtgtattgaatgctttacatatagtttatgtatagttgctttacatatagaatgctctgtccatattcacccgcctacctcttggacctgatggctgccattagtaagccagttgtgctgaggcagtgcttagtacttacagacgtgtgctttattgctttaaagaaattttttttttcaaaaatttgtgcaaagtggcctttaaaaaactttttcgtgccgggtggtggtggcacacacctttaatcccagcacttgggaggcagaggcaggcagatttctgagttcgaggccagcctggtctacaaagtgagttccaggacagccagggctacacagagaaatcctgtctcgaactccccctccccaaaaaaactctgtttcgtgttttttatgtttcttaaacaagttctcttttaaaagtgtaagtaaatgaccaaaggagttttaaaaggtttttagtggtgtatgtgcacaccaatgtacgtgtgtgtgcacacagacaggcttgaggagcagctccagctctgtccagcagtcactcacttagtctttccttcctacctacctcccttctctctccttccttccttccttccttccttccttccttccttccttccttccttccttccttccttcctttttgagcaagagtacagagtctcttagaatttacattcttttttgaaaatacataagatatttatttctatatattgttacacttggcagtgaaatcaatggctgttgacaaaggtacaaatcttaccaatagatgcacagaaacagccagaacgttttccatttcaaagtcattaggccattacaggattcatagctagagaacattttattattattattcaaatcatagtatcattctgctattgccagattggagtctattagccattcaggacaaaagatcagggaggatcatattgtggctaattacttgagctagaacttgtttgtctgtgataccttacttgaagctatgaagttcgttctacagacatatgcctaggataatgagaagtagtttggtcaatgacttttaaattgctttttttcaaaaaataaaatttgaaagtttaataatgtttttaaaggtctgaatacatggtatgctaatataaaagggtatgtattatgttgaacagatcattcctacccaactctagcacacacttttttttttagtggtaggtggtattgaggtgtaaagagaggaggaggaggaggaggcatttgggtaatgttattgtgaaacttgctgcaagtggttcgatcacagaggttgtcttttgaaactcttagtttcagtagtcatttatttgggagtaatatctatgaggtcttgtgtctgttctctcatttgagtgtaagatggagtttgaatgtggctgggggtgggggctgggaggttaggatgtaacagctttagaaacttcataataaattaaaactgtaagcatagttctttgcaggagagtgcccaattcagttcagtaaaaattgtatcaaatattgaataatttttcctattaaacttagattagcctaaggtaaatgttaagatgggatcttattattaaatgaagtattggcaccattcttagaaatttatatagaggcatcatgtacttactcacaaaggaaaaccaagaacatggcatactaattgaatagtaatttatttgctcctcatattgaaacaagaatttaaaaatttaaatatcacagtttatatagtaaaccatttagtatgtcagtactcctagaacttttgtttttcatttgcttctgtagtcaccgctgtcatagttacttttctgttgctgtgaagacaccatgatcaaggcaacttacagaagaaagagattattgggggcttacagtttgagggtgagtctatgatcatgatggcagggagcatggcagcagacaggcaggcatgtcttgagcagtaattgagtgcttacatgttgagacaacaaccacaaggcagaaagagttaactgggtatgatacaggcttttgaaaccttaaagcccatccccaagtgacacacctccaataaggccatatctcctaatcctttctaaatagttctaccgactgttagataaccaattaatcctgggggaaaactatttctcccactctcagcattccttagttgcctgtagttctttgactagggttggggacttgtaggctttttcctatctactttagcatgcccattggtgtcatccatgttcagctcatgtttgggcagtcatgttggtgagactttatggatgtggcttctgacatttctaggagacaaattcccagatcttcttactcttacagtctttctgccttctcttttacggtgttccctgtgggagtgttttgtagatatattcattgggactgggtttcaactctgtattttgattggttgtggttttctgtaatggtctctgttgcaaaaaagagattttcttgatgtggggtgaagactatacttccaggttgaaggacaaatgtttagatttttgttagaaattatgctggtttatttagtaaagtgatagttgtagagtttcctctaatatccatgagttcactagcactgagtggttagctaggtttccagtacttgaaatggtttttaattaattaattaattaatttttttatactccatattttattccccaccttagtaatagtgtcagaccttaggaccttgagctggatcccactttgggcctgtcactggaccttcttttcctcaggctcctctccatttccatccctgtaattctttcagacaggaacaattatgggtcagagttgtgactgtgggatggctccccctctccctcatttgatgccttgtcttcctgctggaggtgggctctataagttccctctctctattgtggagcatttcatctaaggtccctccctttgagtcctgagagtctctcacctcccaggtctctagtgcattctagagggtcccccaaacctatctcctgaggttgcctgtttccattctttctgctggccctcagagcttcagtccttttctctcacccaattagcagatcaggttcccctctcacccccactcccccgccccatccacttttcctcccaggtcccttcccttcctccccacttgtgattgcagtcacaagtggttttcttcttcttaagcaagtcttaaacccaattagagctgttggatgcctccaaggtatgtgtgatcctactacactattagctccttgccttcctcttttggaagctgcatggtgccttctggtaccatgaaagctagtcctcgagggagaggcattcaagtcagtttcagttaagggcatcagaactttgttttcacctcagggagcaaccaagggcagcagcaataggctgtatgttctgagaatcttctggacaaccctgaccaagagttcaaacagccttctcatgtctggttttggtggtttttttttaggtggtccttgactgttgatgggagcattgccatctcagatgagaaattcactaaaactatttaaatacatttatgtcagaactttatgtattataaggtttttgttaaggttgataattaatagtatggttcctcatcacactatcatcttgttatcataccatgtccttttcagacatccttactgttaattttccttccttccttccttccttccttccttccttcctaagagcccattttttcctatcttcctctcagatccttcccctttatactcttcccactttcttctatttttatcctccactccctcctaaggagccccccactttgggaaaagtgatccctgttcagatcactgtaccctctactctgcctctattgttccccaacccccatcctggcaatggtcccattttacctggtttctacagttgctgctcaagcactttacagtgcacactgtcctacttacatcttggtgtttgattttgtacgttctcttaattgtgcttattggattggattgtaaactatacttatgaacttggtaagaagtttttagaatgttgagagaatagaataagtaaattgaatagcttatttgaaaacaaaaacagcttagctaaggataaattaatgtatgaagagagaacaaatgataaaatactagtttgaatagcattaatttggattatacatgggataaatttaaaataaatctactttttatcgtgccatgaaatgtttttggaggtcactttatctgaggccagttagtattcgtagaaggacctaaaaccaaaggtacatatattgaccttactgtgttcaaattgagggaatttgtacatttgtagtgtggaaaatataatgtactgaaaggaaagttataaatatcaaaatgaggtaaattacagttttaagatgttctttttatccatagtgggaaagttaagtccaaaataaaaaatgattatgattctgtttttgagttcagaagttgtccacagacaaaaagctagatttttatcaaggaagacagttgctaagattcaggtccctagcatagtgtctttctcgtgaatgttcagtaaacacttacggccttcattaattatgatagttaatttttaaaatgtacttctatttggtatgtatgttgcctgcatgtgtgtctgtgcaccatatttgtgtctggtatttacagaggcattggatggatcccctggaactggaattacattcatttgtgagatgccatgtgggtgctgggatttgaaaccaggtcttctaagaagaggctggaaaaagaggctcttaaccactataccatctctccagccccaaattaggatagtcaatttttattgataagatgctggctctatctaaatacataacaatgatttttcttctctgctttagactatccccataaatacggcccacaggggggctgtgcagatcactccgtttttgaaaggatgaggaagtaccaaatgactggagtagaggaaggagcccgggtaaggatttcagcgttctctaagttaagcagaatgcacttgggcaagtgtttcttcatttcacacatatgttctaggagttgtgaaacatttataccactgttgtgaaatattcccatttaaataaatgaaaattaactatcctaatttggggctggagagatgctatagtgataaagagcctcttctttcagcctcttccagaagacctggtttcgactccaagaggccatccacacaattcagcagtagtaaagcggtggctgatcacctgttttaaaactgaatcttgaatctttagacaaaccaagatgattattcaccctaaataaaagctcagtgctttggacattttaattacacattgatctttccctttttccatttgatatttaaaactttttcatcacaaacattctctgatagattaccatgctcccaggtctttacagcatttaagtgtctaagcaaatgctagataaacactccaggggaaaacaggctttaagaatatgtaaaactgcccatggtagtgaacaccgtgctggaatctcagtactgggaggctgaagcagtatgaaagataacaaatgttttctcaggttcttaaactttctgtgaatagttaaaactatatttgattttgttaacttaaggattatatggttatctctaagttaacttcttcctctaaaatataagaatccagaaagactgaaaaaaaaccctaacatacaagatataagtatttcaaattcctaccagtattatatatattttgttaatatcaaagtagactttaggcaagaaagcaacaataaaataaatatttataaaaaggtttagttctctcatgttgtagcaataaattgaaacttatataaagccgggcctggggctgtagctcacttgatagatgcctgtattcctagcacttgggagtacaggtaagaagatctgaacttcaagattgtccttagctccacttccaatttaaggctagccttgctattatgagaccttgtctctaaaatagaacaatacagctaaagttgactaactcaaaaggagcagtagaaagaccatatgacagattttagtccacttcttagagaataattagacaaagaataaagcccaataaagatacagaaattctgaattatataattgataaacttgaccgcttaacttatgttaattcctttacttgacagtttttttcacatttaagaataacttaatttaaacatttttactccttatctggggatccatcccataatcagcttccaaacgctgacaccattgcatacactagcaagattttgctgaaaggacccagatatagctgtctcttgtgagactatgctggggcctagcaaacacagaagtggatgctcacagtcagctattggatggatcacagggctcccaatggaggagctagagaaagtacccaaggagctaaagggatctgcaaccctataggtggaacaaaatatgaactaaccagtaccccggagctcgtgtctctagctgcatatgtatcagaagacggcctagtcggccatcagtggaaagagaggcccattggtcgtgcaaactttatatgcctcagtacaggggaacgccagggcccagaagtgggagttggtaggtgggggagtgggttggggggagcgtatgggggacttttgggataccattggaaatgtaaatgaaataaatacctaaaaaaatttttttttttactaaaaaaaatattttcatattggagcattcagacttccctcccaaagttaaaaaaaaaaaaaaaagctgtatatacaactttaagtgtagctaagattaacatgtgtatgaagtaacatgattgtaaagataaactatataacacaaatttgggcccatgaagtatttttcagtcattttcaagctgaacagattggtacctagaaacaacctaaatgagtatatagaggaaaatagtattaaagacatgcttcctccaaatgtcctgcttaggactgtattgattctcccctcccccatgactgggaattgaatttagggctcactcttggttagagtgctagccaagcactcaacaactgagctatataactcgcccagtagaattcggggttttttgtttgtttgtttgtttttgtttttgaactataatagtatttgaaacttttatttaaaattgtgtatttttatgatatagtttctgtaatacatatagactaaaatgactattataggaaacaaattaatgttttcattatcacactgttacatctcctcttgtgaacataatacagcatttaagtttgtataaattaacagaattatcaaggaagaaggaaaacataaaatgcgaatgtagatttagaattgtgacttaaaacttaagttctatgtgactgtcaagttaggcttaacatgatgtttttgatgtcttaaacattttgaatgtttgaattcagcagttgtggtaattcattaaagaaatactttctgttaaatttactaagtgatgacaatctagtgaaaaagaaacacaatgtggttcctcttcaaaaacatatattctagttgttgatgagttagggacagaaattaaacagaagataataaatgtaaggttgcattgtagaaggaagataggtgcatagctctgtgaagtgataaaatgggtgaattaacagtctctatatctgaggaaagacactaactggatccagagagacagcataagtgacatacaaagaatggcgggaggcagacaggctgtgtgctttagaatcatagaaggcttcagttttgcaaagattacagtatgaaaaccagttcaaagtccagacatggtaggtagctttaggtgaagtggcagagccagagaaaatggctggaggagataaatttgctaagactaggtcatagatgggaaaggaaagatgatattaaattattatgcatgacgctttatatttaaatgaatatattttatataccttggaaatgtttttaaagatggaggaattgtttgaatagtaagttcccatgtggaaaatattttatggacaaagtgttatttataagtaaattctaaatattataaaatgtatgcaacatgatgtacatatttataggtttggtgcaaactnnnnnnnnnnnnnnnnnnnnnnnnnnnnnnnnnnnnnnnnnnnnnnnnnnnnatttgtcattggctatagtagagtacagttgtcctgctgagccatacaacacaagcgcatggcggccctccactcctagcttttggtgtccactagccacttctcacacttgtacctttcttcctaacttctagtggcccttttatactatgaggtattttctagtgaccttagaaaagcttgggggtattgcatagccatgtgatttaaaattgtttaacatatgtgttcttaactgtaaaactgtaattgtaaaacaagctaataatcagaaatgactttgacgtacaggcacatccagagaagcatgctgctagtagtggtcctgagctcctgaggaaaaaacgcacaactctggctgaaagaaatacttgtcagctctatatccagacagatcacctgttctttaaatactatggaacacgagaagctgtgattgctcaggtactgaaagttactcattgtgttacgtgttttctcctattgttttgtattattgtttcagttgtgtcataggaaagtctgtaaacttagtgtagaggagatggaaagtccagtttagattttggattgccaaacagaagagagataaaggaaacaattttaattaaaagttgctagtaacattggaacttaggcttttgttctttgttttgttttgttttggggaaaaagtgttttggatttgggtctggtgacatgcatggtaaacaagtatgaaactcacctttgtaaacagttccgtttttcatttggattttgcaagagaaaacaggaattttctcttagctagaagtctataatttctgttttgtatttcattgtatttacttagcattttccaagtaaaattattatttatagttgtccccatcttccctgctgagaacaggttctttgtggcccagagtggcttgtgctcacttcattctgagggtgtcctggaagttatggtaatccttccatttcagcctcctgagtgtgctgggattacaggtttgctgtacctgtatgaaaatctttatgaaaatagaatattttagggtaccctttaaaatgtctttttatgttgaagatacctagagaaagtttattaaatttatttttgacaaagaatttgagcatgagaagatagaagtgctgtggtataaatgatgattacgttttggtggtggggattgacagggttttaagaaatgtgagaaatagaaaggatgcaataagctataatttgagaataatggaataatggagagcaatgagcacagttaaagactgggaagcacctttgtagagagacagtataaacacgggtaatgttaatatccccacagtattttttttgttgttgttttttttttttttgtttttttcgagacagggtttctctatatagccctggctgtcctggagctcactttgtagaccaggctggcctcgaactcagaaatccgcctgcctctgcctcccgagtgctgggattaaaggtgtgcgccaccgcgcccggcgtcccacagtatttttgaagagaaagtgctctagaacattccctaaggagtggggtaaccttaagtgaccctttcaggagaagtctccatctgaggagataggaaaatttagagggaaagatagaaaagaaaaagataaaaaggaagggactccaagtaaagtaggcaatgtaaacctgcctggagacatatctgaattgccacagatgcacatggagcagaaacagtggggaaactgaaccaggcattggaagctgctgaggccaggcatgcgagttcaggatggacccttcaacactgttgtcctactcctcggagtgtttgtcagtgtggactgcttttgaaatgctacttcttgaccgtcttctgtgccttctcaataagttttgaaatggcacatacatatttccacctagatggtagccagggtgctcttttgtagataaagttggaaggttgcatgtagagtggttagagccgatgcttagttgggagtcagctaagtaaacaaatgccgcttgtgttctttcactaagtttatttcctttcagaatttaagtagctattaccatatttattttatattcagattatctttccctcctgtatacttcattacagtaagcctctattaatttatagagaccttctctatttcatttattagtttatctctgacccctaaaacagtgcccagttgtagaaagtaatcaggatgtttggaatttgtgtcagtgcagcaacagaaggactattgtggaggaaggaatgcatgccctgagattgctagatccctgtagatggtgtttgagtcttaaggactcaaactaatgcagacattccaggcactaagtccagcagcatgtgaaaagcagagggagtgggactctgcaggctgggctgatgaaggagttttaataggactgaaataggggtacactttctaattgatgcattggttgattgattagccagagcctgggaaagacaagagtatccactctgtcctagctcactcatcttttccattctgtacaacatatggcatacatattttaaaatttaaatgtgtagcataaataactcttgatgttacaaagagaaattgtctttttcatatttcagtattgtccctaaaatgttttgttttctattttaattactagatatccagtcatgttaaagcaattgatacaatttaccagactacagacttctccggaatccgtaacatcagcttcatggtgaaacgcataagagtaaggaactttagtagatccattttaaaaagtgttaagggggctggaaagatgggctcaacagttaaagcactcacactcttccagaggacttgggtttggttagcattcacatggtggctcacaactgtctgtaactcgtgttccagaggatctaatgcccttttctgtacccccccacccccacatgggcaattgcatacttgtgacatatttacatacatgaaagcaaaacacataaaataaaaataaataaaacttaaggttacaaaaattagtaaggaataagtttaaaaagaaagaaaatacttgctttttacttcatccttagaacggagagagactgatctctgaagctcattggctgtgcttgctagctaattttatgagccccaggtttagggagcatccgtgtctcaaaaatgaagtggagatctttagaggaagatacctagtaccaacctctgacctctatacaaacatgcattcacatgtatataccacatgagcatgtatacataccactacaagaatcaaatctacaaggccttaattgagactacagtagaggtaaaacagtattgttttttgtctgataaacattgcttgccccccacccccattactaatttcttaaggtttgctttgtgcgtgttgttttgggtgtgcccgacttgttattctagggctggggaaaaataaaggcagtgtttaaataaagttagactttggagaaacacttattgttataatcttgaaacattacagcttagaatgtcatctatcaggttttagaagtcctccaagaaagaaagctctaagtttggccatggaatccttttttgttgtaatatcatttctaactctcagaactgctgaacagaaccacagggtactggttgcagtttcttgacattgttgttataatggctgtaactaaaaactgaacctagattttagctatattaaaaacaggtaataaatatttaagtataattgctttaaactaaacttacaatctcagttatgaactttgaagctgccatagtttttgttgatgtacacatcttcagagtgccaatcatttactaaactctccattccctccaaagctgtaaaggtctggtgttgactgttcttcagtttgtgaaggagggtccatggaggagaacagtagccaagtatcagaaaaaagatgtgcaggaacttagcttaaacagtaagagaagtgaagtgaaagtagaaatcaaaattcttgtatacatcaagaaaacagtggatcaagtagttagggttaacttacctgctttctaggcaagaaggaccagggaaatctggcaaactcagccttgcatttcaaacttattctacctataagctaatgatgaggttttatgttttcatacttgtgcccattcatagagctcccataaagagccctgctcaggcagttgagtttgagaaaccggacatcatttgttagaacttgcagaggtgcagcgtcttctctgcatgcttctgttcaggaatctgcagatccttgctgaggcatttaatagcatcagctccgttcttcctgccctgctctccttttgttctttttgtctgtgtgtttatgctttctacaatcagttcagggctgtgctcagggagaacatctctggagcccatgagaatgttgtccaggtctgtgggaggggctggggagagaacaactagaagtaatcattgacttcagttattgttttggattttagatcaatacaacctctgatgaaaaagaccctacaaatcctttccgtttcccaaatattggtgtggagaagttcctggagttgaattctgagcagaatcatgatgactactgcctggcctatgtcttcacagaccgggattttgatgatggtgttcttggtctggcctgggttggagcaccttcaggtagattgtgtaacaatgtcttaatacttggaagaaaaggcaagtttgggggaagattaggttttactaaatataggagaaaacaatgcctgtgcagaaatttaattcacacagcctgggttaagactagatacataacataaagcaaatggcagaatagatgaagcagccttttattttaaaaggaatataagagttgaccctgtggcacacacctacagtctcagctcttatgctgaatcaggaggcttgggaaggtaagttcaaagccaccctggacttgggattagggagaccctatctcaagtaactaagcaaataagtaaaaatttaaaaagaaaagagaagtttgggaagtaccctgattttgggatttccagaagttaaccattttgtgggaagaagtagtatgtgtgacactataaaagggaaacctaagttttcccacaaaagctaaatgctgctaaattcccctgcctgctccttggaatggggcctgaaagtcaacagcagaaactgtttttgctttgtcaaaagggaaaacaacaacaacaaacctatcttcttttctgttctgtaatgagagaaagaaactctggtcaggagcagcaggtagaaagaaagaaaacatatcttcatttgctgtcctcgggtcattatttcaacagcagagatgtactacctggaaggcagtccaggcagcagcacaagtgccgcatgcagcttgctggcatcatccaagctcaccatggggtggggtccaacactgagaaggctgagatgggctgtccccttcccattacagtgggtttgagtacgctgttggcaaattgagattattcactgaaagacaggtagaaaggaagtcatattctttggatctgagtgtggctgtggagtgtgagttgtgtgtaaactttggagtcctaagcagtgatttctccttctgatgcctcatttctacttagaaattgacctttctttacctggtataaagcacgtttttcttactgtttagtttattctacgatttattatgtatattttatcttacatttcttgctttttaaagaagccaacagtaaacaccttatttttatttccagtgcttttctttcttttcttttccgcccatgttgtaaaatgcacttgattcctgtgtctctgaggtacagatgtctgtcatggccttcttctcttaccatagtgttgttttcatcttgtttgtgcgtagtcctcttttcatgtttcttgcattgtgaaaaggtgttcagctcttccttcccaggatgtttcaggttttataaattctctttcccctcaaatagctggatattttttctcacaagattaatgattcccttttactattaattagtattataaaagcttgggtatttctttgggtttcctttgcatattttctagatactcttgggtaagtcaatggctctcctcctgtggagcatagctagacgtgcgtgcgttgccagaacctttgagaaatgttatggttcataggctccacctatgtcctttgaatcagggacgcttgttattcatctcagtgtctttgtttaaataagcattgctgctcactaaaatgagactgagaaccaccaaactatttatgtctctaatgctccctcaccaaatacctccagagcaaacacagcaatttccaaatgggagcctgctaccgttttgtattttcatttacagactattgttcatcaaaatgtctgtaatcctggcagaatcatgagttcaaggacagccttcactacatagtaagagcttgtctctaaaacaaaggagtgggggtaggtggattcttcaggagcttgaaccactttgttgaaatctttagatgccttcatgttttttacacatataactgcttaatttccttttacattccttaatttgtttctttagaatactttttagagttaaagagttaaatgaagcagatgctatggagagtccctcctctcagctactggctttgaagaacactgtttgactgaattctaggatattttgtcctgaagttagatgattttatgatcaaatggggctgtgggcttagggacactcagtatttatgtctagatttcgggatatttgaaacatcactttgtgatgttgctcattttgttaacatggcactgggtagagtttcaggttgaaaacaatgtgacatggttttttttttggttttttgttgttgttgttgttgttagattctttgtatgaatgaaacaggactctaccttagcctatcatgagcaaaaagagaagattcaacctttatccttatttccaccttttctttttctttacttcaggtgtgaaatgcactctgacttgactgttaaatccccaactctgggccttagaaggctttttccaaaagctgtttcagagagtataggccgagagattagaggccagagtgagggaaagaagtctactctcttggctcagttgctttaattcagggtcctgtcttgaaataacaccagcagctttgtctgaacagattttgagtttgatatacactttcttttataaaggatgttacatacgtaatctgcttgattactccagggtaatggctcctgcttcccagtagatattatattttattgattgcttttccttctttcttaagagaaggtggacatgggaactctgttgcacaatacgttccactaaattactttgcatcagataatttgtgttataatttcttttctctccttgctttgagactccatctttctgcttgtaagtcttaattatgtttgctattatcttgttctttttagataacacttcatagccaatttattgagtttatagtctttaatatttcttaatctttcatttttatttggtttaattaatctttgttaattctcatcttgttgtataatttgccctaagtttaattcattaaattctgaagttatctcactattctaaaatatgatagtcgagatttttgttacattatggttaattatcacagaatatgtatgtagattattagtggtagtcctttttgctgacccagttgatgcagggaaatcaatgagggttacttacacttaatagtaagtttctagtctttatgtcttcctatttttcaaataatctcttttacttttgtgttagaattaggacaccatgtatcctagtttcttctttgtatgaatacatgtgtactaggacaactctgtctcttctttttcagtactttcctctagttgaatttttttttaaggtgtctttgatcaagaaaacagtatctacctgttgaactgagtttacctggagatttctacttaaaattatgctatgcctacagtggagccatcagaaaagagtctggttcccatacaaagatctacagggggtgtggctcagtggtagagcacaggctttagcatgtacaaggcctagggtttgatcagcacaagggagaaagtcaaaacaaaactcgggaaaactatatacagttgccattttgattgttattaccatgattttataacaaagtaaattttattttgtaccagagggctcactgtatacaggctgagcttggatttgtgttaagcttaggacttggttgttgcaggttcccatgcattggttctaagagagccatcaccttccttcagtttcatttcacttgctgaacatctttatcatgcttctgcaatggagttctctggcttgttcagatatgtcctgacctgtattaactggtctcggtgttagtcagttaagtgaacatagccgaggcttgctcagattactgtcactcttctcatttactcacaaggttagtttctgtgataactgcagtaaaagcttacatgtcactgatattctggtatatcaaaactagttgcagtatttaaaacaatatttataaaataaaatttagtaaattttctgtgtgatttagcactccttaaactgaggagttatttaggagattaagcaatatacacatcacagagattatgtttaagaagagtattctcaaacctacatatgatcttgctaagttagctagacttaaatacatcaatatgtcagaagtttttaatgtgcctatttagtcttttttctttttaactgttaagatgtgtattggagtcttctgtgcctagatcaaatttgacaggacttattttgggtcagtttcatatgacaagtctttactgaggcaggatattaatttactacttgctcaaagctaacatgtggttgtgtaattgttacagagtacttactcatagatttaattttttagttcctagagtgatgtaaccttcagaaaaagaacagaaaaaatattcataaatcaaaatctattttctctattgttttttgttcaggaaagggtgtgtatagaaaccacatgaaggcctgtgggctaattctgctcttggcttagtattcattttcctttttcacaaagttcatcatgatttcatcttgctaaatcataaaattaattaaaagaattgggagtctaaaatcaggaagatggcaaatgcagggagctgagcataggcagaccctctcaaatacaagacaaacacaggagagttcattcttgtcagtgtaggcattgacaagctagttgagttggttttcttatttgtcccttattaattttgtgtaactgctgttggctatgaagtattgtcattttgatcttgagctccaaagttcttttaataaaaagacaaattacagaatgcttactatgcttactttaattcctttcaattcnnnnnnnnnnnnnnnnnnnncccctccccctccccctccctcttcctcttcttcttcctcctcttccttccttccttctctctctctctctctctctctctctctctctctctctctctctctctctctcttccagtctagtctttatccctttcccagtctgccctttgactgttctttatcccatacctcctcctccaagaggatatcctcaccccccactcccatctcaccagacctccccactccctgaggcctcaataatttcttttaaaatttgaaaattatttcagggcacatcaaaattacagttcagttcttttgttttgttttaagttccacagctgctgaagagttgtgtgaatagtgcagtgaacgcctggccgaccagatatccatattcttccatatttgctttcctgtccctttttttcttcctaccttctctccacccttctttttccatgtctattccttaaatccatgtcacgcagtgtcttgctgacaaatgagtgatagagtgcatcacagaactatgagcacatgctgaatgcccctcactctttgtataaatttctttcagagaatgtaaaatattgaggatattttaatgtgtatttaatttttaagtttcccctttaaaaggtgaagggatttaaaaggtgaagggatataagctttggttcagtgtaaatgtgaactcacccaaatttaaaggaaataaaaatgttttgctatgttaatggcaggaaaaaataactttttgatgctgaaaaatatgtaaggattgtttactaaatcctgggattttttttcagggaccattaatgttttattttaaatgatttttaaaatcttggactaattgaagtatttgaatcagttatgttcatttagtcattgtattttaaataaatataaatgttttagctccatgtaatgattttaattactgtttacctattttttataggggaatagataactaatttagtctttttttattattattttaaaatctgaattaggaagctctgggggaatatgtgagaaaagcaagttgtattcagatggcaagaagaagtcattgaacacaggcatcattactgttcagaactatggctcccatgtgcctcccaaagtctctcatattacgtttgctcatgaagttggacataactttggatctccagtgagtactgcctaattattaaaagtttaaaaagcagttagcttgacttttatcttcagtggtattttgcagtacaataatgtacatatgaatgtttagtgttaatatgccagtacatagtgatgcaattgattatactgaaagtaagaagagttctgtgaaagccagaattttatttagctcctttgtgggagggtagttttgagatacggtctcatgtagcatagacagtcttgagttcctaaccctcctgtccctgcttcccaagttctaagtgaatatctgtatgctccaaccatgtctggcttgtttatgcaggtcatctgtctatatttgctggtttagaaacagttaccatcacataatacactcaaatatattttgaatgagtctccttttagtaatttcgtaaattgtgtgatggctttttggcttttgtttctattaaaacaatattgtgatttacttgaatatatttctctactgtataaatagattgatattttatacttttttataataggtttctgacacaaagaagaaaaaatagcatagcaggccatgttctcatcacctagaacaggagtggcaagcacttcccgaagggctctcgtgaacatttcttctaggctttgggggctagcatttgttttatgctccatgttctttattttccagttctttaaatcttcaaatacggaaagctattcttagcttaggctttgtaatagcagctcatgtgtaatgtaggttcatttgctgacccctgagtcagttggtaattatcaaggtttttgcattgtttgctttttgtgttcctttctttttctttgttaagatgtttaaatttacattttttagaaaaaggctttatatgtaaccacagtgtgattattacacttatagcagctgtctttggtattctgcaatacttaggtccattctgatgattttacagtgatctaaataaacatcaattcaacccagaaataggaaatagtaaaagattttctctgcttttggtggagcttatcaagtatgtttcttttgggaaaattctacttgaaaattgtgtaaattcattttacttgaatgttatcatttgtagacatggaagttattatttttttaaggataatttgttggtgttgagagtataggtcagtatagagtacatatgcagcatacatgaggcctagggtttaatctctagtaccaaaataaactaataaaaacattcatgagtttgtagtttaaaatcttaaaaggcacttctaaatattccaggtttttaaaatgtatcacctcagactttccttgtctaagtatccatcagaaactgagaggttgttttcaaaggagttcttaaagtaccagagatgagcagagggctgatgctgatggttaagttgcaatttcaagtgcaaggagacacaccttcttcacaagcaccatacccttctagttccttttctctgcctcagggtctggcttgttatttatttatttatttatttatttgcttttggggagtatgtagacttggtgactgggctgttctagaactctctatgtagatcaggcctactcatggcaatccaactgtttcaactttctgaatgctgaagttaaaggcatgtaccaccatacctggtttgtttgttagcagtcagaagccaaggttggctcttcctccattgcactccctccattgtttcatagtcttcttttaaggcaggacagctcactgaacctggagcccacctttttagctagtctgactggttggcctgtaaatccctgagatttgtctaaaggccagcatactaccttgttcacctttgatgtggattctggggaatctaaactcacatctacagacttgggtggcaagcactttaacttgctgagccagttctccccagtcccctcacactcatcttaatctttatctcacagccaacaattgcatttagtaaattagtattattgtatattttatgtattgcttaataagtaatttggttctcattccttgtcaactttgttaaccttttcctttcctaatggactacttttaatgaccttactatgcttaaccagactctttctttgcatatgctgttaattctacatggtagatcctgaataagtatttattgagtgatttatggtaagatgaactggagccataaactcccaaacctgtccactttgacatctctctctgaaatctttctttctccctgctttcctcttgctgtgtctctgtgctacatgatactttctccaagtggcttgcattattctttatattcatttttctttatatgagtacactgtagctgtcttcagacacaccagaagagggcatcagatcccattgcagttggttctgagccaccatgtggttgctgggaattgaactcaggacctctaggaagagcactcagtgctcttaacgactaagccatctctcccgcccttatattcactttacttatcccaaatatttgttgagcattctttccccaaaaagccacacccactccaacaaggctacacgtaatagtgccattccctattgtcctattgaaggacattttctttcaaaccactacattccacaccctggccctataattttgtagccatatcatagtgctgaaattaattaagtccaacttccaaagtgcccatagtttattataatatcagcactttttaaaacttcaaactgtcatctgagactcatgcagtctagctgtgtaaaaccaaaatgaaaatgcagatcccaggcttccaacacacagtggcacaggatctatattaccattctaaactggaggaaagagagcatagtaaggaaatactggaccaaagcaagatgaaaacccagctgggcaaactccagactttatctccatgtctgatgtcaaagcattcttcagaactccaactcctttcatctttgttgactgcaacacacttcttgctcttgggctggttccgttccctgttagcagcttaccttggcaggtatcccacagctctggtatctctaacattttgggctctccaaagcaatccaggcttcacctttacagcttcacacaatggcttctctgggcttccatgcaggaacacccctgacacacacctggccttagtggcttttcttagttgcagagggagattctgtaacccctttaatctatccttgattccaaagctgccaagttctggtgcttgctggggctggaacatgtcgtgtgtcccctccccctcccctacccctgttcaattacatcttattaacttactgtttttgatagtttccttcattgtctaagtttggctgccctggctcattgaccagactggccttaaactcagggatctgctagcttctgcttctgaagtgctgggattgaaggtgtggacccctaatctggctctgagcgtttctttaatttcttttcataagttggtctcagctgggtggaatcttgccctgagctctcctccttttatccatttaacatcatgcttctctttaatatgtttctctccttaaacacaggatttagctccatttcttctccctgtaccccttttctccttgatctgtatgttttgtattttcccttgttcaacttgctccttttaattatacatcttcatatgagttttttcattatacatttccttaagcgtgaacactaacaaccacaagacagagtcagtactaggctgttctgagatttcctctgccaatgcaattaatccaaaactttactgtagcctcaggcaaacttttcagacaagagcagaaaatagcaacaatgttagccaaaatatcataagaatagtctctaggccacatattaaaattcttctcctctgaaacttcttgagccaggccaccacagttcaaatcacgatcagcaccactgtctttcatcttcctactagactggtccattaagccccacttaaaatgttcattcaactgcttttctaatccaaagtcccaaagtctacattcctccaaacagaagcatggtcaggcctatcagtaatattccaatactaacttctgtcctaggattttattgctgtgaagagacaccatgaccatggaaatttttataaaggaaaatatttagttggggctggcttactgtttcagagattaaatttattatcatcatggtgggacacatggcagcatgcaggcagacatgctggagaaggagctgagagttctatatcttgatccacagacagtgaactgtcttgagcttggagacctcaaagcccaagtgacatacctactctaacaaagctatacctcctaatattgccacttcctatgggcttatgagggccatttctttcaaacctctacaggtttcatcatttatggccttttcataattcaagtcaaagtatatatgctgtgtcatttctcacctctcaaatctgatgaatctcctgctcttaccttaaaatctttttttaagtattatttttatatgtatgggtgttttgtctgtatatatgtctgggtacaacatggatgcctcaatccttagagtagaaggtgcagaacccttgggactggaatttatagattgtgagctcagtgtgggtactgggaactagcatagatcttctcagagaagcagcaaatgcctttgactgataccatggaatattcttcagccattgaaaagcaggctcttcagtgcttcttatactggtaagctgagatatagataattatatataccagatcccaaagtttatattaagatgtgatacagccaattatagtcataggaaatacaacaaaatgtcaatagttgtgggctatagattataatttattttttcatatgttcttaaatctttttcttacttttctgtgaatattttctcccttctttctctctttgttgccttcttctttctgtttcttcttttttttttttgataggttctcactggatagcctaggctgacctcaaacttgtgatctttctgtctcagcctctttaatgctgggattgcagtctgttccaccaaatgcatctgatattatgaacttagaatacccaaaaacctaactctttacgaacaaacaacttgggtacttagcttagaaagtagtttttcttaatttcttttttaactagagttgtagtatactcatgaaacctgagtcctttttgacatccagtcaggatagtccattgtgtgtatgtgtgtcggaggtgtttttttttttttattcctttctttgccagttttgttcctgtatctgctgtagcaaataataagcattctttgtttaccgtccattcttccttttacggctgttggtgagatctgttacaccattcctgagagattaagactaggcaggtaggtcacaattagctatttttaagaatgtaactccttgccaagttagggacaatgtttattccgtctgtatcagtttgtatattttagcacttccatgtataacaagctactcattagaaggcaatattcaatgccttctaacatagctactgtttctttgatcacattaacagccattcagtattggaacttttctttctgtttctcaatttgaatgatgagattgttgctagtaccatacttaataaaaaaccaaattgtaaggagcagaagcataaagcaaggtaatatacagagcaagtagtttccagaggctgaatctaggctcaggagaaaagcagggcagtatcaggaagagtaggatgtgagacatctgatgaggaaatgtaaaatcagagtgacttggtattattgtttgttcgtaaagagttaggtttttgggtattcaaactaaggtcaagttaaatacaactgctattctaatgtccaacattttttccctttagaataatgaataccttaattacttgaggacattttgaggtttctttcgggtgtgtgttgtgtgtgtattgagggtattttgtgtgtggtacatgcacctgagtattcacctttgtatgtacacacacagatgtcagagaaggatgttgaatgtcttcttcttacttactcttgggacaattagccttgagtgatgctctctgaaccagaagctttgggctcgacgagtcatctaatgagctcttggtatctgtctctgaattctagtgatgaggttgttgcaaaaaaagcacagtcatgtctggctttaaatttttttcttaaaattgttattacattttgtgtgtgtatgtgtgtgtgtgttcatgttcatttgtatgccacagcctgtgagtggaggtcagaggacaactacttgcatttgggtcctgggatcaaattgaagttgtcaagcttggtgacatcttgtaccactgagccatctttctgctcctgggcctggatttatgtgggtcctggagttttgaacagaggtccacttgcatatacatcaagtgttcttccccatgaagccatctaacaaaccctggcgttgttgttttagtgcatatgtgcgaggaaagcaggtgcttccttagcccagctttgaaagtgtttttcctttatgaagattcagggagctcttgctttggtctttcttatgcctctggtacctggataaattaccagaatccaaaccacgtctgtgcaggtgctcatatacagaactctgtctcctgtaaagcaatgttttgatcccatgccttgggttttcttagtcttattttaaagtaaaacttgtgtttgactccaatcagcattttgcgtggctgccttttgcgccaactcacaaggaagtgtcactgccttgagttcttactctgccttcctcagcactggtcttgggtttcattttcacttctgccttcctgaaccagtttgaacatgtacttaccatgcattttaatgaatgtgaatccatattattacggccacccataaaagcttcttcttagtaatctctatgacgatgtatgttcagttctagtccctaattacaaagctctaagtttatgtttagactttcagttttcctctgtgctgcaacagtggccccatagagcaagtgtttatcctaactctgatcctagacagttgttagattcttcttcaaggaaagtatgtgacttctactgttcttctgatgagaaagttccacataagcaggtgactgggcaattttacttcctactaatgtaacaccatattctgtttggcagcatgattctggaacagagtgtactccaggagagtctaagaacttaggacaaaaagaaaatggcaattacatcatgtatgcaagagcaacatctggggacaaacttaacaacaacaaattttcactctgcagcattagaaacataagccaagtgcttgagaagaagaggaacaactgttttgttggtatgtatattttccaacattttaattaactttttcttctacatttgtgcatgtgcacacaagccacagcaggtatgtggaggtcagaggacaatttgatggagtcagttctcccccttcaccatgtggttctgacaactgaacgcagcttgtcaagcttggtggtaagcacctttcccctgagtcatcttcccagcccaaaatatttatagtcaaaaaatatgtaagaggccactcagttcccgcctgtgttttccagttaacactttgcaaaaagtatttgctttatcaaatacttaggaattcatttgcccctttgaaagtaagtatcagatagcagagtgttttacttctaaacgcttttagcttatatctcattagctagagttcaatcttgtttgaggttcttttctcttccctcctccttctctcccttccttcctttctttaataggtgaactgcacagttttatatatatataatttcattcataatacatacatgccttgctgcatgtgtgacatttgcacttactgtacaatgagcaattccccaagcctcttatcctccctttctgcactgtctcctcttgttagttcccttgtttcctagataattttgcttctgctttcatgtcatatatctgtgcatggttttatggatctgtataaaccctataaacaagaagacatcgtgatacttgtctttgtgacattggcttgattcatttaaggtgattatctccagttgcatctcttttcctgcagacaacaaataatttcattcctcatgtctaaaaccaactccatcatgtatctactgcatgggtgtggtgttgcacacctttaatcctaagagttgggaggcagaggcaggtggaaggttctgatgtcaaggccagcctggtctatatagcaggctccaggccagccagggcctacagtttttttaattacaggtgtttttttgtttttttttttttgcgggggcgggggggggtaattgtggatttgcacacagggcagtagtaggtactcagtaccatcacccagtgtccccattggtaatactgtgcaggctgatagcatcacaagggccatgctgtcatcagggcacactccccactccttgctcctgttttatcgggatgtttgtttcttttaatataatataaatacatgtgtagttctatatcccaccactatagacaagatacagaactgtccatcaggacaagggtactgctgctatgaacatagtagagcatgtgtccttgttatatgttggaacatcttttcggtatatgtccaggagtggtatagctgggtcctcaggtagtactgtgtccaattttctgaggaactgccagactgatttccagagtggttgtagcagcttgcaatcccaccaccaacaaaggagtgctcctttttctccacatcctcaattcctttataaaatcactggtgatttgttagataccttgggggagctttttggttgttcttggtatagcacacagtcttcctatatttgtgttctgagtgctgaattataggtgtgcactattaggctggactcagataatggtttacagatgtttcctcctggcctgtagtatatttctttattcttgtcacagacagagtctttggctttttcttttaaactttcccctcatgggttagattgacattacattgatgctgttattctattattgtcatcaatggttgcttttctgtcacttacttctgtcagttcttaagtgttctatggacggtggagttttcacagtaaacttagaagctgattataaaagtgaatgcactgatctgttggtcactgttacgatgtaggttgtgtcagacactgcacacgcatttttctctagaattatatgtcacatgaattataaagttactagccatttaaagtcattgttttacttatgatggttgttctactagaacagtccaaagacatcatataaggtcagttagtgggctacaatttcagtgactgttaagattttctttaatgaattaagaatgaacttgataagtgtaaagcctaccttcctggagtgattttcaatcacctgtgccacagtgaggtttttgtgctaggtgtgtgttcccttcattcagtagtttattcagttcacattctaaatcctgattggtgcattagaaacaaaagcctaaaatttaagacccaagaaccccctgcatttcatctgtttgatcatatcggggtatatacacatggggtacaagcaagtcataggctccttataacttagttttgcttactagaaatgaaggcatttgtttcttgtaattcacggtaaatgattgtgtattgaggtgattttgagatcttacaaagagaattcctggtctgaatttttttcctccatcatttgttttagtattgctggggattgatttaaatctactcttctaattttttagcttcaggacttgagaaagttgaagaaacggctatcactgggaagagaggccccttggtatcgcaaactttatatgcctcaatacaggggaatgccagggccaagaagtgggagtgggtgggtagggtagcagggcggagggagggtatagggaactttcgggatagcatttgaaatgtatataaagaaaatatctaacaacaacaaaaaaagaaatctgggggaaaaaaaagaaagttgaagaaatatattgaaattattcaccaatatttaggccagactttctaactctaattatctaagatctgtccttgttaggctgcttgggacttcagggagtatattaataattcatacctatttcttaaggtgcttggtctcgcaataagtagaataatattcatttaaaagttattattgacactattgtgatcacttttaaaaaatgagttataggataaaattatccaatatccttaacaaataaatgatgtaaaaaataaaaaacaaagtgaacctattctatagtaaaataacttaaatgataaatcacctaaagcaattatggtggaaggggtggggttaggagagccttttttggaacttgatttggtgaccaattattgaagatagttcaggaaatttgaacatggatttgtgtggtaatttcaaaatgctacagaataaaaagtggttgcaagtaagtaagagaagaaaagcattcatgggaggtgtcttgctgtgaaaagacaccatgaccaaggtgactcttactaaaaacagtatttaactggaattgggttacaggttcagaggttcagtccaaggcaggagcatggcagcatccaggaaggcatggtgcaggaggagctgagggttccacatcttcatctaaaaggccactaggagaaaaactggcttctagtcagctagaatgagggtcttcaagcccatgcccacagtgacacacttcttccaacaaggccacacccactccaacaaggccacacctccaaacagtgccactcatattcagaccaccacaggaggtcattgtgctaattttcttactatttttatgtatgtttgaaaacttctgtaacaagctttcctcttttctcttggttgagaaacactaacttcgtttgcatacatatgatacacatgtgtagtcagcaaagctcaactgtaatgtggcctaaacagcaagttattacttctataaagaacataggtaaggccagtcttctcacgatgtagaaacagggtgacatgctgaggttgcaattgctgtttgtagcacttcccatactaaacgacaggtctcctgattttcagattctgttttttgccttacttactcgttaaaatttcctttttctttttggtaaaactctaaagagtttgtcaattttatgtatttatgtgtgtgtggtgttttgcctgcatgcatgtctgcattatatgtaagcttgattcccacagatgctggaagatggtgccagatcccctggatcttgaattatagacagttgtaagctgccctgtgggtgctgggaatgaaatcaggtcctcaggaaggtcaataagtgctcttacataaactgtcaggccccctctccagccctgagctttgaaattttgaaggaattaatgtgtgcatatagcgctcaccgtgtcctgtgactttcctcagaatctggccagcctatctgtggaaacgggatggtggaacaaggggaagagtgtgactgtggctacagtgaccagtgcaaagatgattgctgcttcgatgccaaccagccagaggggaagaaatgcaagctgaagcctgggaagcagtgcaggtacctaccttgccaacctgtgatgccaacgtccctgcaaggccacccacagcagttaggacagatgaaatgctgatatcaagagagctgtatagccgtggaagtttgccttgctttgttgtattgttatttatttgtttatttggagtgacagcatcctgttttgacatttggaacaatttataatttagtgatttggctattgaaaaagagaatgtgaacaggctgctccatcaaatgcatgtatcatctagttcctaactgtgaaaacatgactgtattactttaaactatttaggtgaagtggggcgtgtaggcttctgtgacttagtaccatatcatcatttcactgtcaaatgcagtcatgatttcaggaaatagactacagcttacacaaactttttaaatggttagtcagtgaatccaagttcaatttagtacagagaggtgtaaattgattaatgtgttatgtagctgtgggggaaaacactaaaaagttttctaatcctgaatttacctcacaaaaggcagattaacaatactgattttagcatttttgactgtggaaaccatgtacataatcatcttcttagacttgctagactgtccaaagagagtagcttgttactagtaataactgaagttgtagtccagtaatgaacttaccacttaagaggtgacgttcatgatgtgaaaatatggctcatatctaggtgtataataaatagctagtgatttactttatctgattatttaacacttctcctagtccgagtcaaggaccctgctgtacagcacagtgtgcattcaagtcaaagtctgaaaagtgccgggatgattctgactgtgcaaaggaagggatatgcaatggcttcacagccctttgcccagcatctgatcccaagcccaactttacagactgtaacaggcacacacaagtgtgcattaatggggtaagcatgtgatttaagatgttttaaattttattgaacatcctttttcagaataatgattgccacccatcaggtaactattctggggttcccattcagtaagatcctatctgttccccacaaaacctggagtgtatgtaacacaattgcctggtggcatatagttagctcctgactcacctttcatttttgcaactgtgtatctttggtatgcacaagagtacaactaggcatgtggtcttatctgcactgcttttaagttgtataaattaatatttcaggagtctgaataaaagaactcatctggtcattttctcagagtgtgaaatcttctgagctcccatggctaaatgttactttgttctgcatgaggaaaacttattttttctctgcttatagaggagccatagtaaccaacacaaatgtggagctgccccttcctctgcttttaagttttttgtttttttcttcattgctttaaaagttgtacagctttctttcatttactctcagatctatatatgtggtattattgacgctggtgttcatctgtgggtttgttttgtggtgctgcggatcagacccagggccttgcatgtgctggcaagtgcttgccatggaggcgcaaacccacacctgttgtttgtaactcccattgnnnnnnnnnnnnnnnnnnnnnnnnnnnnnnnnnnnnnnnnnnnnnnnnnnnnnncaacttccaaatgttttttttttcatcctttgggaatgaggtttattgggagaaggcctttgagaccatgatggaaccttgatgtggagagcataagaaagggacagcagtatcaaaaatagcttagcagctccttaaagagaaagaagcttccctctaaaacctggagagaggggctggagagatagctcagtggttaagagccctgactgctcttccaaaggtcctgagttcaattcctagcaaccacatggtggctcacaaccatttgtaatgggatctgatgccctcttctggtgtgtctgaagtgtactcattaaataaataaataaataaataaataaataaataaataaatatttttttaaaaacctggagagaagcctgttatagcttacagtgggacacagaaaagacagagacagagaaagacctagaaagagcgccatgacagtgatggcagcggtgggatggtatgggtcagagaagatccttgcctttaattgttaaacagtttagacagatactttccagctaaatcagttcttttgagaaaaatttaaatgtagcattgcactatggtctttacaatgttgctaagtaatacattagaacagatcttgccagccttagataataattcatgtaaacatacctcaatggttttaaagccattgcaggcactaagtcaattgtttgtttatattttaacatttaaggtaaatgagtaatgatgttactctgacaaaaagtatagatctgtgaaacatgggaaagagcttaagtagtctgtttttttccgagactgccctgccaggtattctgacctctgtttatgtttggcacttctttttccagtggctccatcaacttgtgccagtacaggctctttgcagtggagcaagcagttcagtggtcggactatcactctgcagccgggctctccatgtaatgacttcagaggctactgtgatgttttcatgcggtgcagattagtagatgctgatggccctctagctaggctgaaaaaagccatttttagtccacaactctatgaaaacattgctgagtggattgtggtaagtctagtcttcattcattaaaaacctcaaaatgtttgatcttaattttacttgggtagaggtcaccaatattggaggatgaacaccttgcctgtttatactagaatcactatatgtatagtctttgaatgtttagatatccctggctcttatttccttctgtagtgatcggcatatccacctgaaagtattgaaaactgtgttaggtggtaggagtcgttctgtgtccctctgctgctttgcttacattgtctcttgcaggtgacttctggtggtacgtgttggtgttttcactgggctttttgggaaaatgctccttgtttttcttatttctctgttgtttcagtagaacagatagccagctatgggtcttaccttgctcaagagtaaaaatgagaaagacattttctgaaggctttttttcctgcatttgttgttgtttttcttctgatctttcagtgtaatttttgggtcttagtcttgtctgtgatagatgttgaacaatgtaagatcatatgaagagtcagttacagtttctttaatggctgtactgcatacgtggtcctcatctattatattgaatttttaagttcacatttctcaaaactgtaaaatcactgacttgagggggcaactcagttagtagagtgcttgtctactatgcatgagcctctgagttgttggaaccagtattcatgaaatggggtatggtagcacatgtggttattcctagcatttggaaggtaaaggaggaagattgatgttaaggtcttcctcacatagtatctagctcattctagccagtctggattatgtaagaagctgtctcagaaacagagaaacagccagccagtgatactggagaccctgtctcaaaacaaaacaaaacaaacctttgaaacattgtatttcctgtggttttcttaaagaattgctgagattagcctaaatgttcatgcattccaagtgtaggagacttactttcaagtggcatgtttagggacatgttatacctaaaaccaagtagtttgctttgtaaattgatttagaactcaaactctttccaagtttttttttttttttaaagtagatttaatgaaagattcctttctgtgaattagcaatgagaatgcttatcttaagttctggaatgattaatcagacactgtatgtgagtgagggttaacacatgccttttattttataatgtcaatgtgggtgtattatcctcagctagcactatccacaatgcctggagtgcagaccgagatgctttagtgagcatcggccaggtcaaacaagacaataaatgctgagtttgttttacattatttgtctcatctgattttgtgcagtttccttgcataacaaggtttgttttatattaatgatagtttgaatcttgatgtcctatcatttctgtggtgatatatatattgttaggctattctgctatgaggctatgcaagaagtgaaggacttccttcactgtcttttccagtgctgcctggtgtccttttgtctctgttgatggtgctctaggactccttttctcctcatgcagttctgtggcgactgaagaaccttgagaacacttcgatattttatgggtactgttgttgtcatggagataatcatggagataatcaatattttatggatactgttgttgtcatggagataatcttttgtgtgtgtgtgtgtgtgtgaagtgttgttttgacaaccatgtttagatttttccagaatatgctctgctgagtctgtctggcgaggaggcattaactttagtgcctgcttgtagttcttgagaagactgcgagagtgttcaccattaagtctgttgagatcctgggccattatcacctgtttaagtgggatttgaggacatcagtaattcttttccagtttctgctatagttgatatggtcttacttctctttgcatcttttgcactgggtttgatctggcaaagaaccattttttaccatttttgggttttgttttgtttttttatttttttgatttatcattatgtgtctcctttctttcattctcactgtgctgtgactttttttgtttttgtttttgctttttttgtttgtttgtttttttgtagcatgtgcaattttaatataggaatcgttcaatagcctggtcatttactttaaaacatgtcattgttcatcaacaaatactctcttactgtataatttagtgagaatgttctcagcataagaggaatatgctaaatttcatttttttccaattttttattagatattttctttttgtttgtttttttctttgtagaccaggctggcctcgaactcagaaatccacctggctctgcctcccgattgctgggattaaaggcgtgggccaccacgcccagctttttttttttttaagatattttcttcatttacatttcaaatactatcccaaaagtcctctataccctccccccacctccccaacccgtgctgtgactttttatttaagtttgccaaaatcttgtgatgatgaagatgatggatccttataccccttttcactatggtgtccaggtctctaatccctgggcttcaggagtctctctaccttcagcctctgagtagctgagctcgtacacactcctttatttttttttgaggcaagtcttgtatcatagctctaaatctggctctatatggccnnnnnnnnnnnnnnnnnnnnctccctctctctctctctctctctctctctctctctctctctctctctctctctctcttgatagggtttttctgtcctggaactcactctgtagatcaggctggcttcgctcagatctgttttctctctcccacccaagtgccggaattaaaggagtagagtgtgccacttcctcctggctcactttctcattttaaaaatcagtttctgtccctgtattttgttctaactttgtgaatgtagctactaagaatctggtttgtttttgttttttttttattttgagtaggagatttagggcaatggttctcaagtggatcacaaactacagttgctctcaggttgtttgtccagtgcctctgagaaaactgaggccagtgagatctagacaagtcatggattgcatacgtctttgtagctttgttttcacaacaatcacaggagaatttactcacagaaggattataagcctagatgtccttagatgtcatttggtatacattgtccaagaacagcagctattagtgtcatcacagggcctagaccaagtaagtcagagctcttagaattggtccaaagtatctccatgcccatggtggctagaagagtgcatggatcccctagagctggagttacagacagtgtgaactgccatggggtcgccgataattgaagttggtttcttttggaattgagagagaaggctgtgagttcagaaactcacagtataggatacacatagaagtgtatttcagttctgtgtgttgttttcatagaaaacagcaggttctattggagaagtcttaaattttttaaatttttttgttttttgtttttgattttgtttgtttttggtttttgtttgttttccgcacacacatgtggtgctgggaacttacctcagggcctgatgtgctttagacaaattatctgcgactcagccactgaaaagttctctttaaaaagacattacaacttgattcttaagtgcggcagtagcaaatatacaggaatgtttcatggagaagaaagtgcatgaatcttccacatgaaaactgtttgaaaagtcttttgaaagcttagtgaattttagtgattgacaaaatactccatttaaaagcaggcctgctccttgccctgcagcctgtctgcccaggatgaattttttgtgtgctctttagggtctaagtagagccgtgctgctttgcacactcaggcttcatttcctgctttctttccccgctcctgtgctatccagctttaggacaaagagtttaaatgaaaagggggcaaaattaaaccctttgtttgcatagttgtagcactgatagctgaatggaaggtgttaggagcacagatggctggagactaagtgttaaagaacacagaagcactaaggatggaggtagctgctctgacagcactagacctcagcctcagtggagcaggactaccattgccctttgcactaaagagttgactgcagtacggttcccctggtattaactaactgggctccaggactgctgagcttccaacattgctcacaattgtctttggactgtttggacagactgacaacagtaccctgcctcttgataaatagcaactatgttacttgagagtgaataaaaatagaaaaataaaagaaatccatagaaaacttctataacaaggatgatatatcatcctgaggacaaagaagaaaggaactctgaaaattgctttctatagcaaataaaagaatgttttagaaaactaacaatctaagataggatacaaggaatagattaaagagcagattgtaagtaagctccgggtcttcaaatgaacattcagcagaatacaaaagtatacctgagcatccttggaacagctggaaaacagcagaaactgatattttgtctttctggactttttactcatagatcataaaccagcacaatagttgtcttaaatgactgtgggggaaaagagtagattgtaaacccatggtttctaagccaaattcagccccatcaacatgttttgtgtggtttgcacattgcttttagacaatctgaacaagtttgccagcatttacaatagacttcatatagaaattcagatttgtaacttctaaaaaacaaatctttgggagggaagattgagttgcattgcactttcttgccaagaggacattgctacggtgagcggaagagtgacagactagaaacttctgtcacaggctatagcatacaaaggaaatagaagaaaggtggttgtgggactctctcatgcatacctgcaacccaaggatggtcagagactgacgagaagccacgtgcagtgtaaaccattctaagttcattttgaattcaaaacaaaatcaccctctttctgttttctgttccctctcttttctttcatatttttggggtggaggtggggaaaggattgagacagaatctcctgtggcccagtctagcctcaaagtgagtattagttgaggctaaactcctgcttctcctgccttcatgtccctgttgctggaatcacagacataccaccacatctggcctcctcctcctcctttcattacttttaattttcacatcctgggtatttcagtgttctgtgtaccatggatgtacctggtatctgcagggcccagaagacagttgttagatcccttggcacttcagttccagatggttgtatgaactaccatgttgattctgggaattgaacctagatcctggaagagcagccagtgttcttaaacactgagctatctctccattgcctttacacaaaaacaaacaaacctaaaagtgtggggcgggtttgtgtgtgtgtggtacgtgcatacgtacgcatgttgaacagtttgttcctaaagcctttgggtgattctaagcaaggtaggaatccatccaaggtgtgtacagctgtagaaccacagagatggctggcttacaggtgagtcttatgtggttaggagggtgtggggaagagcacactgtggcatggcatcccccaagtaatggaaggtgagtgccatgtcagagtacaagtggagtgagcgggttctacagtgagttgcctctcccatgtagaaggcaagttccatgtcagagtgcaagtaggttaaggaggggtcttcctaggaggagaaacactacaaggaaccaggcttcaacagcaacatgggtggtccgggactcaggtattgaaagaacaagatgaacctggaagcttttgtgtcacaaagtaagtccttaaagaacgaggtggggagagtgtcaaaaaccccatggtaatggtggtattgggttataacccattgtatagagtaggaaacgccaaaggaacagtaagtaagtaaatgataatttatggggaatggaatgtatacatagttccaaattacatctccataaaatactcattgattctacaaaggaaaagtatattgttgattaagtctggtgaataacatcacaatcaagaaatcaaggttagcatcagagtgatgaagtcagagtcatatcccctgtgttaggacgtggtaaaagagtacaagagcccttttgtgatactcccgatgcttggtcagaatctgatcatatgaaacaccagagaattcaaagtaggttgttacaatcctgtattaacaactgccctgaaaatgccaagtgtccaagttttaaaggccagagggagctgtgctaccctccagaatgaaggtcagcagtagggcccaacagcacatggtgctgaagatgtgatgagacgtctttgatgaacaaggtctatccaggaaaatactcttatatcttagatttaataagaatttgtgcgtatatgtctgtctatctctccaaccatctgtctgtggtctgcatgtgcatgtgcatatgtgggaggccagagtttgatgctgggtagtgttttccacttttgttgttgttattgagatagggcctttcactgaacttgtagatttctgattgacaaaactgcaagcccaagagattctcttgtctctgctccacagtgctgggattatagatatatgcttttacatctggctttttagtgtcaagggatctgagcttgggtcctcattttggtgacaagacaggccctttaccaattgagccctatgttatgggactttcatggggaatagtgtggtgcataaagctgggtccgatttttgaaagttctttgcactgtgcttacaacttttcattatattagcaattctttcaagaggaaacaaaaggtttttttttttttaatatgagggaacttacgtatgcagaaaaagtgacttggggtgttttgagatagcatgtgtttttattttaggatctgggtaaacagtacagagttagtaagttgtgtaaagcctcagatgatagaggcgttttgaatgttttgctagaaacaatgagtagtaattgcataagtgttacagtaatctgcattaaacccagtgtggacattcagaaattgaaaattgtgaatatttcatatgatggatgttagtatctgctgtcttaaaacagtttaattctgttcctgtcaggctcactggtgggcagtactgcttatgggaattgccctgatcatgttaatggctggatttatcaagatttgcagtgttcacactccaagtagtaatccaaagttgccgcctcctaaaccacttccaggtaaggtgctgagcgctgggtgctgctgtgagcagagccagagctgtgggcagggaggacgcagcctcaggaggctttagtttagtaactgagtttagagggctgtgtttttgataaattgcctgacaaatgattcactggctgtgtaattgttcgtcagtccaatctagttattgactaccattgtaatgctgatctatcctgagtgccaagaaacatttgaccaacattttgatttttggttggatcctccttccttgtttttgtctcagtctcttgccataccttgtttgtgttactgtagtggaggtgattttaaattattggcctttgtatctaaatagttaatggctctgataccatttgtaatgtctgtgttcttgaaatagtttctggtaggaagcacattttcctctgcaagaggcttactgagaaatataagtctgcatgtagggagtcttagcttcagatgttaagaacctgtcagatagtctccacccttccctctggaggacactgccactaggacaagtcaactttgagcatttgaagaagacagaaggggatggctgttttgttgcagttagtctgatcagtttccccttcccctctccaaggtgtggctagtcattacaggtgtggggaagactgcctaaggcagtggcagggaagccagggctgtgtgctactgtgtggcctcctcaggagagccttgcctcagagtggtttcttctactttgtatttcccctcagctgttccttgcattttcccgtgttaggacaag

SEQ ID NO: 1334 - DNA, 1724 bp, Mus musculus
ccgtgaggaggcggcggccggggaagatggtgttgccgacagtgttaattctgctcctctcctgggcggcggggctgggaggtcagtatggaaatcctttaaataaatatattagacattatgaaggattatcttacaatgtggattcattacaccaaaaacaccagcgtgccaaacgagcagtctcacatgaggaccagtttttacttctagatttccatgctcatggaagacagttcaacctacgaatgaagagggacacttccctttttagtgatgaatttaaagtagaaacatcaaataaagtacttgattatgatacctctcatatttacactggacatatttatggtgaagaaggaagctttagtcatgggtctgtcattgatggaagatttgaaggtttcatcaagactcgtggtggcacgttttacattgagccagcagagagatacattaaagatcgaatcctgccatttcactctgtcatttatcatgaagatgatattaactatccccataaatacggcccacaggggggctgtgcagatcactccgtttttgaaaggatgaggaagtaccaaatgactggagtagaggaaggagcccgggcacatccagagaagcatgctgctagtagtggtcctgagctcctgaggaaaaaacgcacaactctggctgaaagaaatacttgtcagctctatatccagacagatcacctgttctttaaatactatggaacacgagaagctgtgattgctcagatatccagtcatgttaaagcaattgatacaatttaccagactacagacttctccggaatccgtaacatcagcttcatggtgaaacgcataagaatcaatacaacctctgatgaaaaagaccctacaaatcctttccgtttcccaaatattggtgtggagaagttcctggagttgaattctgagcagaatcatgatgactactgcctggcctatgtcttcacagaccgggattttgatgatggtgttcttggtctggcctgggttggagcaccttcaggaagctctgggggaatatgtgagaaaagcaagttgtattcagatggcaagaagaagtcattgaacacaggcatcattactgttcagaactatggctcccatgtgcctcccaaagtctctcatattacgtttgctcatgaagttggacataactttggatctccacatgattctggaacagagtgtactccaggagagtctaagaacttaggacaaaaagaaaatggcaattacatcatgtatgcaagagcaacatctggggacaaacttaacaacaacaaattttcactctgcagcattagaaacataagccaagtgcttgagaagaagaggaacaactgttttgttgaatctggccagcctatctgtggaaacgggatggtggaacaaggggaagagtgtgactgtggctacagtgaccagtgcaaagatgattgctgcttcgatgccaaccagccagaggggaagaaatgcaagctgaagcctgggaagcagtgcagtccgagtcaaggaccctgctgtacagcacagtgtgcattcaagtcaaagtctgaaaagtgccgggatgattctgactgtgcaaaggaagggatatgcaatggcttcacagccctttgcccagcatctgatcccaagcccaactttacagactgtaacaggcacacacaagtgtgcattaatggg

SEQ ID NO: 1335 - protein, 574 aa, Mus musculus
VRRRRPGKMVLPTVLILLLSWAAGLGGQYGNPLNKYIRHYEGLSYNVDSLHQKHQRAKRAVSHEDQFLLLDFHAHGRQFNLRMKRDTSLFSDEFKVETSNKVLDYDTSHIYTGHIYGEEGSFSHGSVIDGRFEGFIKTRGGTFYIEPAERYIKDRILPFHSVIYHEDDINYPHKYGPQGGCADHSVFERMRKYQMTGVEEGARAHPEKHAASSGPELLRKKRTTLAERNTCQLYIQTDHLFFKYYGTREAVIAQISSHVKAIDTIYQTTDFSGIRNISFMVKRIRINTTSDEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDDCCFDANQPEGKKCKLKPGKQCSPSQGPCCTAQCAFKSKSEKCRDDSDCAKEGICNGFTALCPASDPKPNFTDCNRHTQVCING

SEQ ID NO: 1336 - DNA, 174703 bp, Homo sapiens
  misc_feature (1)...(174703): n = A,T,C or G
aaagagtttcactttgttgcccaggctggagttcagtggcatggtctcggctcactgcaacctctgcctaccgagttcaagcaattctcctgtctcagcctcccacgtagctgggattacaagtacttgccaccacgcccggctgatttttttttttttttggtattttagtagagatggggtttcaccatgttgcccaagctggtctcgaactcctgagctcaggcaatctgcccatctcagcctcccaaagtgctaggattacaggcatgagccactgtgcctggcctaattttttatatttttagtagagacggggtttgaccatattggccaggctggtctcgaactcctgaccttgtgatccacctgccttggcctcccaaagtgctgggattacagtcatgagccacggtgcccagccagcttagctatttgtaacagttactttagaagataggattcgttcagtgtttaaaagaagtgagagtaaggctggaaatagaatcaaagtctgaataaatgcaaaaaaaagtggtctaaacaattatattattcccaaagaaagcatataataactggaagggagacggtggtctgcatggagtccagagaatatcccacagtgtaagggtttgctgaagtatgctttgatcaccatctattgtggaggtcccctgaacatgtggatggtctggtacctatctattccctcgatagattctactgtggcatggtaagttgaatagttggatgaattagccagcaaaatcattcagttaattttttcttcagtgatgccttgcttactaagccactttgaattatgctttagcttctcaactattgacaagaaataatgcattgacttgctaacatgaatagctaactcataaaattatgaggtgacattttaagacctaagtcccttaagagtttagctcctataaattagtgcttgtcagttgatcaaatcaggttgcactgagaaaaatctagcttctgggccttgaaagctaacaggtagattctggaccatggcaatgataataaggatgcatttacccagtaattcaaaagaccagactacaagatttggagtcaaacaaacttcgattagaagcctggtctgcctgtttcctcatctgttaaatgagatatatctaattcatagcattgttacaaagagtaaatggaatcatgtacataaatttcttaccaaggtacctggtaccatgtcaggatcatgttttgttttgttttggtaatctggaaatccccatagtaggaacaaaataaatacttgtcaaatgaatgaatgattattatcattgccatcctgtaacgttgtgggttgtcctctgctttgcctcaaaactttcctatctctgctgtccttaacactgggataatagaatttccagaaagtaacacatggttaattgcagatgagagatataaatcataggtgtttcagactaaaatgtgattgagattactatggcaagggggatctaggaaaaaacttcaaggaccattttgaacttggtctagtttttaaaacgggtcataaactcaaatactgacagggataactggagtggggttagattagacaaaccctgtccaaagagggcagcctctactcagtttctgccaattgattctgtgcaagaatctaggtcggcttgacctttcagtttccacagaaaatctagaatcttggtttaaccatgaaaccttacaattatttaatattgatgaataattgagaaaaaaaatttttggccaggctcgatggctcatgcctatactcccagtgctttgggaggttgaggagggaggatcacttgagcccaggagttcaagaccagcctggacaacatagaaagatcctgtgtctacaaaaaaaaaaaaaaaaaaaaaatagtggagcatggcagtgcatacctaatacctatagtcccagctacttaggaggatgagggaggaggatcacttaagcccaggagcttgaggctgtggtgagtcccactgtactccagcctgggtgacagagcaagactgtctattccattagaatagacattctaaatagaatagggaagatattttaaaaaatacaatatagtttgataaagctacattagaattatgtaaatggtagacattaagttttgtctagagggcaagtttaaaattttacagaagggaagaagcctgagccatatatttaagaatgtctattcctttacattttaagggaatgtgttctaattgctgtaagttataaataccgtatttcactgttctcttttccctagacgtggatttttttttttttaattttgagacagggtctcactgtgttgcccaggctggagtaaactggtgtgatcatagctcactgcagtctcaacctcctgtgctctagtgatcctcccacctcagcctcccaagtagctgggagtacaggcatgtgccaccatgctcggctaattgttttattttttgtagagacaggatctcgttggtcaagcacggtggctcatgcttgtaatcccagcactttgggaggttgaggcgggcaaattacctgaggtcagcagttcaagaccagcctggccaacatggtgaaaccctgtctctactaacaatacaaaagttagccgggaatggtggtgcatgcttgtaatcccagctccttggatagctgaggcatgagaattgcttgaacccaggaggcagaggttgccttgagccgagatttcaccactgcactccagcctgggtgactaagtgagactctgtctcaaacaaacaaacaaaaaaggtcaggcacagtggctcatgcctgtaatcctagcactttgggaggccgaggcgggtggatagcctgagctcaggagttcgagaccagcctgggcaacacggtgaaatccattctctactagaacacaaaaaattagccgggcgtggcagcatgtgcctataattccagctacgtgggaggctgaggcagaagaattgctagaacctgggaggcagaggttgcaatgagccgagatcatgccagtgcactccagcctggactacagagcaagactccatctcttaggaaaaaaaaaaaagaaagaaacagaaaaagaagacagggcgttgctatattgcccaggctggtgttgaactcctggactcaagaaatcctcttgtccgggcctcccgaagtgctgagattacaggcatgagcccccgtggcccaggcccagaagggatttttaaagtccttttcttctctgattcctcttttatacagaaagtaaaatcctaacaaaaaaagtgtcttaaaatgaattattgaaaggattctctgagcctaatttcatagaatttataggataaatgggagaagcattcctcctggagggaataacatgtgcagagatgtcgaagaggaaagtgatatgtgtttgggaaaccaactgcagttgaacagcagcatattgtgattaaagcacatgctcttgaggcagatctaactttaggcattggttctgccatgcaccagctttctgattttgggcaagttatttaagttgccattaccttaccactcctcgaactcccgacctgctagctattattgttattgtaatttttgcaattgctacttttagaagataaagtaggaaagagctggacattggggacagcagacttttcatcctagaaacatggcccagtttgtctaaaacattactgagaaggccccaacaccaccaacgaacactgctgtgacttacttgaaaacctggttggctatattttggcactgtgccaaggttgagctggttcctccaagtcctgcttagattcctagttattcagagctttaaaaaaaatagctgggcacggtggctcacgcctgtaatctcagcactttgggaggccgaggggggcagatcatttgaggtcaggagctcgagaccagcctgggcaacatggtgaaaccctgtctctacttaaaaaaaaatagaaaaattagccgggcatgctaattacgtgcctgtaatctcagctactctggagcctgaggcaggagaattccttgaagccggaaggcagaggttgcagtgggccgagatcgcgccactgcactccagcctgggtggcagagcgagactctgtctcaaaacaacaacaaaaaaaccactcagtaactctcaaactgatagcttcaaacagctcacagttaaggaagctatgctgaatggtttggtggccactgaggtgtggatgtgattttatatccaagagcacaaaggcaaacatggcatcactggctataatgtttgaagaccagtcttaaacatctgattctctttcatttattttttgagtattcttggactatgtgtgatcagactgctttgtgtcaaaaaaaaaaaaagagtggtgaaagacaaagctggcaaggaaaacaatgactagatcatgaggtcttgttttttttgttttttttttgagatggagatggagtttcactcttgttgcccaggctggagtgcaatggcgcaatcttggctcaccgcaacctctgcctcctgggttcaagcgattctcctgcctcagcctcccgagtagctgggattacaggcatgtgccaccatgcccggttaattctgtatttttagcagagatggggtttctccactttggtcaggctggtctcgagctcccgacctcaggtgatccacctgcctcagcctcccaaagtgctgggattacaggtgtaagccactgcgcccgactgaaggtcttgtattttatcttgcagataaaaggatctatattttcaaaagactggcaggtggggaagcggtgggcaggaggtcaggcagtgggtatgtgagacaggaagaccaaggcttgggcagtggcagtaaaggtaggtagagggacttcatacaatggagaataaaggtgacttgataatctatctactgggatgggagtttaggtaattgagtggatggtgttgccattaacctaaatagggaatttaggaggaagagaaggtttgggtaggttgatgtaggggtttttcagtttgggacatgttacggagtatggctgtgtaatttcaggtaggagatgactagtaagagttggatatgtaataataacaacatctaaaatattttataatagtaattgtatgctatgcactgttcttagtgctttacatctgttaaattatttgactcctatagcaacgctctgaagtagataccactattttccccattgtaaagattaggaaactgtgcaacaggtgccttaacttacctaaggtcaggtggctaggaagttgtgcaactaggatatgggtcttgggtttgggggcataggaaatgttccaagaaaaagtgattggaatactgttccaggaaatgtgctgacaatgtgataggcattgtcaagacagacccaggctttgttttcacggagtttatagcctaatgagttgcatacatttgggggtagtaaaatatcatgcaagtgaaaatgagaagataagaaagccaagggtaaaatcttgaagatcactaattgtgcagtaaagagaagaaaaagtcacaggaaaaagatgtagaggaaagtacaattaaagtaaagaagaaagtccagagtgagtgaaggtttggaaactgttagaagagggagttttgaggagagagtgttgtctgaaaggtccagtaagataaggagtgaagatgtctagtggaattgatcactaacacatctttgatgtctttgatggccctagcaagagtagcttcttacaaagctaggtgggaacaaattgcggtggattaacaagcagtttaaaagcaggaccaaaaggaagagagactggagtaagggatataagttaggtgttctgcagcaatctaagctagataaaatactataattaaagtaaagcagtggtccaaacttgtaacactggaatactttcagagtgctagccaatcagagcaacagcagtgagaaggggagcattaaaggcacaaagacatttttagggaataatcaatatgacttggtgacaaaagaataatctaaaatgattcccccccttttttttttaaatagagatgggatctcactatgttgttgaggctagtctcaaattcctgggctcgagtgatcctccagccttggccttccaaattgctaggatttcaggcgtgagctgcagtgcccaggctaaaatgattccaggtttctgggatagtggtagtgccagtatcagagataagaagttaaatatattgagtttggcatgacagtgggacatccagcaggcagtttagtagaatttggaaattcacaatgtaatcgttgaaatgtttaccagcattggccttcggtctgtgcaacaagcattctcctctagtattacttgtctattacactgtataatatatgagcatttgcttaaaagctgaatttcccattactaaaacttgaggataacttttattatactggtaatatcaaaactgtattgttcctgaggaaataatgctattaaaataattacggctttcaagtggatgtttgagtgttcatgcagtgaccataatagttacattttttttacttaatagttacatagcaattattatattccaggtctattaactaatattagaagataattagttaaaattattagttaaattagttaaaagtaactaataacagatattaactaatttaaatgtaatcatcaaaacaatctgctgaggcaaatattttttcattgtcattttacaaaagaaatattgaggccaggtgcagtggctcacacctgtaatcctggcactttgagggggccaaggtgggcagatcacttgagcccaggagtctgaaaccagcctgagcaacatggtgaaaccccatctctacaaaaaatacaacaaattagcccggcgtggggcccccccatctgcagtcccagctacctgggaggctgaggggaaggatcacctcagccctggaggctgaggctacagtgagctgtggttgcaccactgcaccccagcctgggtgacaaagtgagttcctgtctaaaaaaaaaaaaaagaaaagaaaagaaaagaaatattgaggttagaaggcaaaaaaacttggcaaaagtcacacggtttatagatggcagagctaggagtgaaacccaggcagtctgtgatagtgtagatgcagaccttatactttaatatttcatcagttttccatacatttgcaaaatatcaataatgaattaagttaaaatagtagcccaaacttgtaacactggaataccattcattatcatgctggtatgtaatgccattcgtgcatgctggtatgtaatgccattcgtgcttgacaaataaaaaaaatacagtttttctttttttttgagacaaggtctgtctgtgttactcaggctggagtgcagtggtgtgatcacagctcaatgcaacctcaacctccagggttcaaacagtcctcccatctcggcctcccgagtacctgggactacaagtgcataccactgcactggctatttgatttttatttttaattaattaattaattaatttttttgagacagagtcttgccctgtctcccaggctggagtgcagtggcgccatctcgactcactgcaacctccgcctcctaggttcaagtgattctcctgccttagcctcctgagtagctgggattacttgcttcagcctccagaatagctgggattacaggcacaggccaccacgcccggctttttttttttttcctagctctgtcgctcaggctggagtgcagtggcgcgacctcggctcactgcaagctctgcgtcccgggttcacgccattctcctgcctcagcctcccgagtagctgggactacaggcgcccgccatcacgcctggctaatttttgtatttttagcagagacggagtttcaccatgtcggccaggctggtctcaaactcctgacctcaagtgatctgcggaccttggcctcccaaagtgctgggattacagctgtgagccccgtggctggccaaaataaatacattttaaaaattaaaaaaaaaaaaatacagtctttataaatgtaattttcagtaatcatcttagtaatgcaaaatatggctttggagttttttccagttgaattttaagggaaagtgccatttgcctctaatcactggaattcattataaaaatactgtgcaacagaaaacatgctataaggtggtttaagagctggaaaataaaaatatcatttgttgacagcactaccacaagagattagtaaaaagcacaggtgatatgagatgtaatgtctgcaggtaactatttcctaagactgaatattttaatgaaggaaaaaaaaaccattcgtgagattctgccatcctttgatgattccatgtatctcattataaatggatacaattatgatggttttgaaacgtccgtttttgagcctattaatgttgcagcaaaactagaatcattcatttctcaaactgagaattaaagaagactcttatggccaggctcggtggctcccacctgtaatcccagcactttgggaggctggcgggcggatcacctgaggttgggagttcgagaccagcctaaccaacatggtgagaccccgtctctattaaaaatacaaaaaatttgctgggcgtggtggtgcatgcctgtaatctcagcaacttgggaggctgaggcaggagaatcgcttgaacctgggaggcagaggttgcggtgagtcgagatcacaccattgcaccccagcctgggcaacgagagcgaaactccgtctcaaaaaaaaaaaaattctcttcacttatgttaatggtaataaatggtataaaatatacaggtaacagtataggaattccagtttattacagtatcaataacattaaggccgagcgcagtggctcacgcctgtaatcccagcacttgtgggaggccgaggcgggaggatcgcttgagttggaggttacagtgagctatgatcacaccactgcacttcagcctggcgagacagcggataccttgtctttagaaagcaaaacaaaacaatttacacacacacacacacacacacactctccctaattcggcttgagttggaggttacagtgagctatgatcacaccactgcacttcagcctggcgagacagcggagaccttgtctttagaaagcaaaacaaaacaatttacacatacacacacacacacacgcacacacacactctccctaattcggcctactcaagcacgataccaaatagatgaagaatatctaattaaatggccataaaaagttctagttcatgacatccaagtttaaagaatcaaaatgagttacgagaaaacaaacacaagctttaagaagttggggagaagatgtgcgtggattcgcttcaaagatgtgacagagagaaaagaggacattttctggactggagattcaagacagtctggttcaggttgcatgcttttgcaaaggctaaagccttagtctgtgacataaatttgtaaagagctcggaaaattacatctcggacatggtgtctttttttcctgctgcttgaaggtctttgcatttatgttcgcatcactggggcagctgccgctataattactgcttgttgggactttttgtttacttggtagctgtggtgcaccaagagaggcagaaaaagaagaaaaaaaacctctgttacttgtgactttaagaagtcgaaagcagccctgcttacatcttccacggaccattttagcccaagggaaggtcctcagcagctctaacacgtagcggagcactatctccgcgtaggagcgctcccgccccggggcgggaccaggacaaaccccgcctcccaagcccaatcccagctctccgccggcggacaggaagcggcggcaggcctagcagcacgggaaccgtcccccgcgcgcatgcgcgcgcccctgaagcgcctgggggacgggtaggggcgggaggtaggggcgcggctccgcgtgccagttgggtgcccgcgcgtcacgtggtgaggaaggaggcggaggtctgagtttcgaaggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtgaggcacgactgcgagcgccgggggcgccgcgaccacggcggagcggcggccgggccgagcggagcccagtcgcgcctcgcggcgtgcgcgtcagtcagcccagccggccagcggcgccactctggcgggccgcgctccccgctccctattgtcccccgcgccccgaccgctttcccttcggtggcgggccgaggaggctcccaagcctccggcgaggccttccccgccccccaccgccctggcggccccgggaggcgggggtcgcctcccagagaagcgaagtcggggcatccgcgtcgcctggtgagagcggtggaacccaggctggtggctgcatccctccagtctgctcggcgggcgccggtgcaggcagccgcagcgaggctggcggtctcgccgtcctcgttcagcgctcatcctgctcaccattcctcccccagcccctgcccggtggcggattccgaagtcctctccgccgccgagacccgccgcgcagactcgtgggaagttgtgttgtttgcagctgggctcgtgtattgttctttacccggcgcgccggtcctgaccgaccccattctgcagaggggccgcccgtggagtggcagcagtcatcacccgcttatctgagactagtggcctcggttcttcctgtgtcctgtgtttggagagagatcacaggagggtgtgttggtgttcttgaaaacattctgtcgcccaggggaaagggtttggtcgggagaagggtaaaccatttggggatgttctttgatttgtaggctggattgggtctcttagagtagaagttcggtccctgggtgacccaacttgaagagtttcgttaaactttcaggtggagtagatgtacagtgtagttagtggattgtcaaaacagtgccccctcccccctgcacatgaaagtcaaatttgctaaaagcatgtcatttcttgtttcgggttttgaagacaacgatttttatttccggtgtgttctaggaccagctgcatcattttattcttgcttaaagtgctttattttaggtaagctttttgacttgccccagagtaaacttaaaaacctcaaggtgtgcctaaaagcaacgattgaaaaaatttgaggaatgctttggatgagtgtctgtagcctttgataatttagaaaatatctatttcatgtaatgtattgtttctgtttttttctttgccactttgacttatgactgcaggaccaagtgtatttctgtcctgtattctaccgagtccgagggtggtactgcgtaggcagacttctgttatagtttgtagtgttcatttttttgttacacgttttatttaatttttttcaatccaattcatcaagcaagacacacattatagattaagagctgataatagatgtttagttttaaaaaggattatgtgcgggagactctctgttagaggagcctttttcatctgacatttgttatttctgttctaaacgtggctttcaacaaatcgttttcctatcttttttcactttttgtgattaaattcaggagttaagacactgttctctataaggtaataaaaagtaagacaaacacatgaggcactttactgagtagtagtatactaaatgttcttttaaaaataatgaaaacagtaagaaactgatgtagtcttatatttgaagaaaaaacaattgaataacatgtttgtgggttaaaactcttatacaaaaattttctaaattcatatttccagagtcctttattgcattaagcattggttaaaaggctaatttttggtgtttttgttaagcagaactttttcaaaaaacataagacaagttttattagttttattttaaaattagtatcaagattctagcttttgggtacttggagatacttgtaattttattgtaactatggggtatttttatctactaatctgagctatttttggtcacttgtaagatctttgtatgatgatttgtagacttcagcacattgagattgaatgtatttgttttagcatatgagagaaaggagaaatttgtgtagattagaagttgtggtggaaatttaacttaaaatgtaaatcattttcaggtagttaataaatcctttttgttgcttccacctccccaatttgtcagtcactgttgtgtgtgaaatttttcttgctctgtatattactaggatgggaagctggaaggaataattaaagtgtttagaatcataaaacaaactttcctaatggtgtccatttccagcacagccccatcctatgttgtagttgtaggagcaaaccatgtttttttattttatttttaaaatttaactggtgtgtttgagagcacaaaaggcatttcagctgtagcagtaaattccataatgttttggtttgatgaaatcatgcccgaaatgaacttcagagtatgatatgtctcttacatttaaaaatctgatgtaagtgcttagctttgtacattactgctcaatagaaataagttttctggaaacttgaccagagctttaaaggtagtagagcttaagcagttaaactttctctgactctgagtcggaatctaccagcaaataagaatttaatgaaagagacagactaattttgtctttatccttaaggatctctgactcttcatctttttaaaacttcagtttgagtccagttaactccatcatcttttttaaaaaatgttttattttgtttatttattttaaaaagtagtgatggggtcttaatacgttgcccaggctggtctcaaactcctcgtccctagcgacccacctaccttggcttcccaaagtgctgggattgcaggcatgagccaccctgactggccaattccttgtcttaagacatttttcttaacaagaaaaatttacatattacatattactaggatgggaagccagaaggaagaattaaagtgtttagaatcataaaatgtaaactttcctgatggtgcccatttccggcacagtcccatcctatgttgtagttgtaggaaggtaccattgcctacattaatggtattttctgtgtgtatgtgtacagcctctcccagcaggcatggcaggcacttctctgatgtgcttttagtaacttgtttaagatcttcaaggatgtgtattatctgatctctttaaaatttttctaaggaccttaagggttgtagggcttggggcaaatggaacatttccatgatgccttttgtgtgtctaatactgtgttaggagtttcacttttcaacagttatgagagaggggtgataggcagttgaagaaacagacttggaaatataatttttctagcatcatccaccacttagtggtgaattggacattcgaactcaagctggtttgaccttaaaccctaataagctttttatccattgccccttcatgccttttttgaaagcggctttcatacattagctcaaaggtggcctctggactaaactaccttagagatatgttttattcacagtgtctttaagtttgagctaatgattaacattgaaaaattgggatatttctcagtgaaattcatggatttctggattttcggggaagacttggaaatccagatactagtgggctgtattcctattgtgcagagctgagcagtagggcagtagccaccctctttaaactgggtatgtgcttaccggttactgcagtccccatcattcctaatgatacacctggcctttttcactcatttttgttacctgcttgggtactgtgggtatgttgttcccatctctgccttagctttatcttgtatagatggctccaacttttaaaaaatgtttgactgtgaccccttatccaacttttaatatttttttgcaatgttttctctgtagtcttaaagatttgtttaaaaagaacatggtatacacaatactttttattcagcattaggttattagatgttttttaaaaaaacccgttttcataatagtagcagcttgaaggtctttaatatagaatgatcgttacagtctctccacatttctttatctaaatgggtaagtaagaaaccatttctttttctactgggatgagaaccacagaaaaaattagttgagggtcatattaataaaaaccaatttaagaataggatacaaacataaactctgcttttgaaattaaggtgatgaaatggaggaacaataacttcagcaattagctacattttcctaacattgttggcagatcagtggttcagatatgagatgatgtccatataacaaactctgggaatacacttttatttttttgagatggaatctcgctctgtcacccaggctggagtgcagtggcacgatcttggctcactgcaacctccgtctgccaggttcaagcgattcttctgcctcagcctccagagtagctaggactacaggtgcgcaccaccacgcctggctaatttttgtatttttactagagacggggtttcaccatattggccagactggtctcgaactcctgacttcaggtgatctgcccgccttggcctcccaaagtgctgggattacatgcatgagccactgcgccccgctgggaatacaattgtaaattttttgtgtttttgttgttgttgttgttggtcttggttagagatgaggtctcactaggttgcccaagctggtcttgaactcttggctttaagcaattctccaaccctggcctcccaaagtgctgggattacaggtgtaagccactgtgcctggccagttttgggtgtttttgatggaagtttttctaaaatgtggaaaatttactgtagacacatttactatctccttaaaatggactgaatttaaccttacatgattgaagtttaatatggagaacagttgttattctgggttctattgtagtttctgtttttaatttttccagaaatgactgaaatggcctggtagtttattatttttctaaatttattctagatgattgtggattttattcttggatctagttgtagcaatatttccaactttttggttaggtttctttgctttcttgtaaactttgaagatgttaccttctaattggttgtttctagtatgttttatgtaggaaaactaaataattatatttgagaaacatgcttgcatgtgaaatgaaataaataaattctaaatcttctgtggaatgaagtacatgggctttaggtagttttttctttctccctgccccccacccctacccctcacctttcaatatgtatagcttggctttgtagagtttagcattgaggttgcctggatcgtaactttctaaacagttggaatgatgtggtactaatgtgttttgctagttacagttagacagggaagaatggagagaaaaaactgatgaataaccaggcaggtacagcaaataaaatgtattctcattaggttgcagatagatcgtgtcctagagctaaatcatgagtactctggttttatactaatatactagattattggtattaaacatactctaaaatgtccaactgtaatattttctacaggaatagaaattgtgaattaagaaaaagtgttggccagacacagtggcttacgcctgtaatcccggcactttgggaggctgaggcaggcggatcacctgaaaggtcaggagttcgagacaagcctgcccaacatggcgaaaccccctctctactaaaaatacaaaaaattagcttggtgtggtggcaggcgcctgtaatcccagctactcaggaagctgaggcaggagaatcgcttgaacccgggaggtggaggttgcagtgagctgagatcgcaccactgcactctagcctgggcgacaagagtgaaactccgtctcaaaaaaaaaaaaaagtattttgtttaaaggaaagtcagtgaaaggtagatgacaggggcttatggtactgtgctggtttctagtaagtagctgtgttacagcaactgtgttaccattttggtgatttttacatttgtataaagttaaatttcttgtctgtctttaattgtattacattataatggttagaaaaaaatttgctaaagttggggcattgttttggaagggtctagcttaaaatatggtctatgtggagtaccagaaatgtagtttgtgtggagaaggttgtgggcaagggcagtcattggccactgctgccaacacaaagtttcagtgagaggcctatgtgagataaattgtggataggaaaggctgcagacagaaaaacacatagtgatttcaaatctgaacccccgccccccgccaccgaagcccaaaatcacaggggcaggccttccaaattgtaggaatgatttgcatttcatttggtttttacacgggcagctctatgtgacatgctggggtaaagaggcccaggtttttgttgttgttttgtttgtttttgagacaaggtctctttctgttgcccaggttgaagtacagtggtgtgatgtcagctcactgcagccttgacctctgcagctcaagcaattctccaacctcagcctctccatagctgggaccacaggcacacgccaccatgcctggttaattttttgatttttttgtagagatgaggtctcactatgttgcccaggctgtgttgttgttttctaaaggagtaattgatttaattaatgatcgttaatgctcttccaagcaaccctaaaaactctgcttgttctgaacaaaaatctagcagtggtaattctaagtagtctagctgttgatttttatattaggaaaaaggaagcaatgttaaggacaagtggaaaaactataataaccctaccacttggattcctgtaagggcagtgacgttgctgtccagcaatgtgaagattttgcgttagtattaggatagcctgacccagctagtttgcaggaaatagcggtgctgagaatatttctcagggaatgtagtctccctttgatgctgagtgaattcattttgaagctactacagatgctccttgactcatcataagttgaaaatatcgtaagtcgaaaatgtatgtaatgttggcaacagagatgatggttcagtgtatgatttttcaactttgtgatggtgagaaagtgatacacgtgcagtagaaactgtaaccccatttaagttttaaggagctctcctccacttaatgtggggttatgtcacaacccatcataagattgaaaaatacgaatcatagtaagttggttaacatacatacagtccacttgtactactgcaagtaaacaatgtgagatgtatacagtgagaacattgctgtttagtcaccaggatttattatgtgtctatgactgttaggagtcgtgaagccacagtattaagtgagaagaaaagtaaaaaatactgagtttgttggagtaaatgaaatgccaaaatataaaaatatacttccaattatatattgtagttgcacctgaaatgaggatttgttaagcttgagggacatcagcaagcggggaaggctttctgaggtagaagagaatgacacataagatgcttgtaggtttacttgcctggaatcgatagtctgtgtcaggaaataaggagaattgctaactgggccatgataatcaggactgattattctaggccatgataactatgagatagaatattatggactgttgggtggagtccctgttgaggagttaggttatgattgacaaattgggtgattgagtcttggattagaatgatcgtagaaataagtaaggatagaacaagaaatgacatggaagaaaaactgataaaactgggcaaatgtttaacgtgaaagtaacaaaacttatagagggctcactctgttgaatttaaatattaggctgtttcattggagtgagtgtggttttataaaactttgaagacctcagtcgttgaagttgaaaatgtcttaagattttgagtctggatagaagcttataggttgggatgggtgtcagcgtctgggattttattttatttgcatgctaatacttgggaactggataaaactttgcatagatctttaatctctggctagttatttgggaagcagtgctttaggtagctggattatagaagtttagtgaatttggagtggagatagagattagtttaaagatatactaacacttttttttcttacttaagttggaattaggctattcagttcaaaaatatgattgacactcttgatttcatgtgaactatgaacttctgtttccaagacaaataggggaaaataatgcgatctttgcattttaggcaaatttgcatatgtgatttgtggagcagaatttgcttaccatctgtttttgcttgtattgatgatggcaggacacacgtgtgcatacatttgaactttgaatttagctttcaaaagaacacatagaattctctatgatttgatggggtattaatttactaccccttttcctaggaattaagtgggataatttgtaaaagtgctaaagactttaaagtactatataaatattattaaaattatgtcgtttccagacctgctttcatttggaatctattagttacaaaatacagatggataaaatctatttttagtagttggaatattagaacatcattaccaaacattagaaaatagaattaaagaaaatccgtaattcctccttcaacacaattttatcactttttaatattaatcatgtagtcttttaaaatgcctattacgaatttatagtatttgtgtagttctgtatacctttaaaaaactaatgtatagttaatggctgggtgtggtggctcatgtctgtgatcccagcactttgggaagctaagctcggaggattagtttaggccaggagtctgagaccagcctggttaacatagcaagaccctgtttctatgccaaaaataaataaataaatacaagaaaaatgtaaagtgtagttaaaacgcataagtatgcaaagcagacactgagatatgtataagtagtaaaaaatgaaatcatgtcattcctgtttataccatattttttctattttatagatattgctgttcttttttttttttcttccctagagacagagtctcgcgctgatgcccaggctggaatgcagtggtgcgatcttggctcactgcagcccctgccttctgggtttaagcgatttttgtgcctcagcctccgagtagctgggactacaggcacttgccaccaggcccttctcatttttgtatttttagtagagacggggtttcaccatgttggccaggctggcctcgaactctagacctcaagtgatcctccttcagcctcccaaagttttgggattacaggcatgagccaccatgccgagctttgatattgctgttctttatttcaagctttatagttaagttactgatctgtgtcttcactagaaagacaatgttaagagggaagtaactttattcttagtcttcatgttttaggacctagcacagtgtctcactcacattaggattttataatatgtgttattaagactacagaattgttaaatacattgcttaggaagtggactggacttctggatacatgttatgcacccgttttcattcagcagatattggcattagtgaagcagccttcatggtactggctgtcagctatattatggaaatagtctcattacatgaaactgaatgtcataatgatttttgttaaaattggaatattgctgtagtaaaattagaaagtgacctcctccaattagtacagcatattatcagaaccctcaaatgtgtattataaaggttaggtattctaatctagcataacggagaggacagttttgttgacagctttggagatggattggcactgatgcttataaattggttcggaaatcagaatttaattttggcaagaatttataaaatttaagaatttatttttttaaaatatttatttatttatttatttatttttttgagacggagtctcgctctgtcaccccggctggagtgcagtggtgctatctcggctcactgccagctccgcctcccaggttcatgccgttcttctgcctcagcctcccgagtagctgggactacaagcacctgccaccatgcctggctaatttttttttttttttttgtatttttggtagagacggggtttcaccatgttagccaggatggtctcaatctcctgacctcgtgattcacctgccttggcctcccaaagtgctgggattacaggcgtgagccaccgcgcccggcccaaaatttaagaatttataaattttcttggtagcccataaaattcacttgtatccatccagtagcagaaatctcttagtaactccatgatctctaggagcagtaggccatttagtagggaggagccctttttctttaatgtagagcaagctttggcatagtggttctcagctaggggcagtggcggatgttttgggatatcttatgggaaaagggtgagttaatgacaatgggtttaagatgaaatgcagggagtgggacagatgtatatcaaaagtgaggtggtggctgtgtgagtgtgaaagtgatgtaggcaggttgaaagtcatactctattactgtctgtacttgtgtcttattagaaattgtataaaagattcaatataacccacaggttcagaaaaaaagaataaaaaaagattgtataaaagaatttcaaatcagcatagaaatcttacgtacacatttcaattttttgatttttaaattgtatttcataagttagtggtataaatttaatacattcaatagattttaatcattcgtgttttcagccctttgtatataatttataaaagagctacttagacttctgagccagcttgtgttatttttacttcttagagactagctgatttcaaaaagtgggtatgttgaaatacgcttttaattgtagacactccctcctatcttgaactttaacttgtaactgttaggtgtagctgtttgcttctagaagatgatttgactgatttctagtgaaaaaataggtactggcttaagtttgaattcacattgtagaagtagcttttcaaagagtgcattaaaggcacttaaatatattgctggaatatagggcatgatagttcctggaagcctacctttgtcatacaggagaacagttttgttagtggtatttagtgcctgaagatctgagtgaatatgtattatcaaataaaggaagcattggtcaacacagtatgatgcctatgacatgtagttgatgactcagtaggaaggaaatatatttttatgttggggaaaaatgctgttggtacctcattttgaaattatgcaagtgaaaagtctgttgaaaacaagttgattacaagtaattttttttgaggaatgcaaatatgccatgcttagcttactcttatatcctctcatttattgtaattgagtttttctgtaaataggaagatctgtaatatcaaaacattattgcagattttcctctcccattcttaagattgtatagccaactttttgggtatagataggaaaaaacttgcttgttatatgatatttctgtctcacaccaaggtgatgatggtgacccactatcagagagttattctttgttttttctcctgatgttaatgaaattttcattccgtatttttttgcacaattctttaatttagtagattggaacagaagattgtaagttttgggttcaaggattgggaaggaagcttttgcttagaagggtacttgggaagtaagatgctacctacccatggaatatggaaaaaaatcacaatggctggcatttgttggggtacttaatgccaggcactgttgttagatcattttgtgtatcatatattaacttggtcttcacagcatctctatgagatacgtgttgttattttcattttataaatgagagaggaggatcagggagggttacttatccagagtcaggaaagtcaaatagtagttatcagttgagggaagccagatcttgcctttacatgtaggctaattttacccttaaagcgtaatttaggttctttgtacttacagtatttgaagaatttgccttttagtcagtcaggttctttatagaaggtattttattttttggatgtgaaaaaatgtttacatttgaggggagaaaagcagcttacagaaagaacacgcataaaaccatttcagttttgtcatagataaatatatatgtaatcatttttagagaacagataccaattttctgggtagtaagattcataatgcacttctgtgattaggaaaaataattttttaaaaggcggattggtaaataccagtatcctggcgactttgagaaaaattaagggaaataaaaatactgttctcaaattgtaaaaagggagagctctcctaagctctcctgtgacaaggaggccaagttatgttttttctatttcttagaacctgctggtcatttttctgccactcttgcatgtgattttttggtattacttagtcttcccccttaaaaaaaaactagagatggggtgttactgtgttgcccaggctggtcttgaactcccgagctaaagtgatcctcctaaacaatcactttcgacttcccaaagtgctaggattacataaaatttgataaaggatctgttttctctatctcgtagatccaatctagttattcttctggcagttttacatagaggcttttttcgatatactgtgtttctttttttaattcttgaaaatttttatactttctaaaagattgcaggtatgctagtagttaatatttgtatgcctttcacctgaatttatgaatggttacctttaccacatttactctctttttaataatatattatttttttccctctgtttcatttgaaaataagttgtactctaaatacttcagtatgcttgcatttcataaaagtaaggacattctgctacataactaaggagatttttttcttaagtgtggagatgttcaaatttcccatggggcttataagtattaggtgccatgtgactgtagtatatgctttgtagtatatgcttttcagatttcccatggggcttataagtattaagtaccatgtgactgtaatatatgctagctttttggcaactaaaactgagaacaagaaagttaaatgctgttggtgcgcttttctgtgtaggtgaaataaagtaacagaagagaaaggagaagacgttgactttgcagagtaactatcttgtagggtggagctgtttttatgtaggaataatagcacaataacatagccttgaggttactgcatcattatggcctcttctggtgaagatgttaataaggataagcctggcttaacaagaacatgttagagtaggaggaaaattaatcatccatcaaatagaaagatatttagcaagatataattacctagaaactgtccttagtggaagctgtcattttccattgatgtcagattagtaacattttattgtcctctaggttaaatgtattttattttcatcattgtcaggtagcatgtatttctccactgttaaagtctttatgtgaaaatgccttttgtaagtatgtataaaaccatttcagttttttcatagataaatatatatgtaatcattttagagaacagataccaacttgctgggtagtaagattcataacgcacttctgtgattaggaaaaataaatttttaaaaggcagattagtaaataccagttgaccctctgtgtctgtgaattttgtattcatggattaaaccaaccacgaatgaaaaaattcaaaaaatgaaattgagtctgtacttaacatgtacagacttttttcttgttattattccctacacaacacagtacaacaactatttatataggatttacattgtattgtgtattataagtagtctagagattatttaaaatatacatgggtatgtgcataggttgtatgcaaataccgcgtcattttgtcagggatttgagcatcaatggatttggatatctgtgggaagtccttgaaccaaccccccagggataccaagggacaattttattttattctttatcaggagggataaaattaggaattaagattggcattctttgagtccttacttgttgttcgttttgtcctgcgtaggtaatatatctaatagtgatgaaagaacctggactgggagagtctagcaagtagtaaggatcaggatagagtaggtgataaggaatcggagtaaacgattaggcagcttggaactagggaatcaggaagatctataacaaggagagattcccagatacaaaggtgagtgggtcagaggccaagctgtgttcagatagagatgggtgaatagttaacatgtttcagtgagatttgatgataccacatgctctatctatactttctgagctcttgactgattgctaaagtttagaaataaatctcagttgataggtccagtctctgcatgtgggaacaggcaattttgtgatgtctgactgaggtagtaagcagtacaagggttgaagattagtcagggctcctgtggagtaaaccatgcccatttcaatcactagctgtggaaatcaagggtatatgtatatgtatatttttctgtctataagaagtatattcttctttagtattgcattgcttgttttccccatcttagaggtagacgtcagtttagtttttgaaaggtttttgccatgtgctgtattttgataattttttttcttttcagttttttttttttttaattttgagacagggtctcactttgtcacccaggctgcattgcagtggcacgatcttggctcactgcggcctctacttcccaggttcaagcgatcctcccacctcaaccccccaagtagctgggatgacaggtgcatgccaccgtgcccggctgatttttgtatttgttgtagagatggcgttttgccatcttgcccaggctgtcttttcagttttttgtcatatcagaaatatggtgacttaccttgtttatgatgaaggtaattcgactcatcgtagattaacatgaaatcattgaaatcaaagttgagttcttggcactgcctcctgtttgctatgtgacactgggtttgttacatatcactcaaacctcagttttctttaaaatgggctaatagttctcacttgattgggtggtttaaatgaaaaaaatgtagagcagtacagagcctggcagatagcaagtgcttgatacattttaattatcatgacatccaatttataagcattattgtttaatttagttaaacaagaaattgatgtaatcaggatattgttctgtacatggtaagatttcagggtacatttaagaaattaggatacttttaaaaataaaataggatatatagtttgggatttttaatttttcccctttaaatatgtgaaatgtgaaacttaaaaaatcatttaaaaatgtttgttagccagattttaatgtgaatttgaatatattggatttctaaaacaagaatgagaagcaacagccttagtgtaatattatttttatatatatatatataatgtaatgaaaaactaaagatattctattaaagtcagggacaaagtgaacatgcctacacttgttattcagcatggtttggtactcctagttagtgtagtaagttaaaaaacagataaaattataaatagatgaataaaagatttaaatatgcaaagcagaaccaataaaaggccaagaaagaaaataaagaatatttttggaattttgcctgcaaaatttaggggctcatgaatcccctatagaggttatgcagtttctccctcagtatctatggggattggttccatgaatgctcaagtcccttatataaaaaggtatactatttgcatataacctgtgcacatccttccctgtactttatttttgttttaaagggttaaacaataaggcctttatctgcacaaatcagggtagaatgaggcaggcagttccaggattggctgattcggaaactggctagacaaatccatctcagctaccattgtccacaaaaaagggggacctctggaaatccacagcagaccccaacccaggtcttttgggcaggagctgggtcatttccacactgaaaccactctgagggaggggatgaagaaccaccaggttttgttcactcacctagttgtaggtaatctctacattgtggatagatggagcagttcaacttctggctgacagctcacattcagaggtcactgtcagctcttctcttttatgatcatgctattttgaacaatgagacaacatctgccatgcactcttaaggcctctgtccagtgtgaactctaatgcctaatgaggttaggccttgactgtatgcttttttacatccgctacacttctacatttataaggcctttctctgtgtgaactttcatgtgccaagcaaggtggaagtttctgcattcccatatttcctgcatacataaggccttgttccatcacgaattctcttatatgctgtaagataggaattgtggctgaagaattttccacatttacaacacttagaagtctcttttccagtgtgaactttctggtgctcaacaaatgtgtctttatagataaaaagacttgtcacatgatctgcactcataaggcctttctccactatgaattctctgctgctgaacaagataggatcttctaataaaggatttatcacattaagctcactctttttttttttttttttgagatggagtcttgctctgttgcccatgctggagtgcaacagcaagatctcggctcactgcaacctccgccttcctgggttcaagtgattttcctgcctcagccacccaagtagctgggactacaggtgtgtaccaccatgcctggctaatttttgtatttttagtagagacggggtttcaccatgttggtcaggctggtctcgaacccctgacctcaggtgatctgccctcctcaacctcccaaagtgctggaattacaggcatgagccaccatgcctggctttaagctcattctttgtatgacctctttaaagtatgagggttggaggtggagccaaataatttcccgcaatcactgcatttataaggtatttctttgctgtgaattcttctttgtactgtaaagtaggagttgtgactaaaggttttctccacattcaccacactcctaaggctttactccgtcatggattttctgttgctgaacaagtttatctttgcagttgaaggctttcccacatcactgcacttgcagcccctttgtccagtgtgaaaggcctccctactctcagtactttggtgtggcttcttccccattgggaggggcctggtgcttgaaaacttcaaagctattcaagaagtattttccacccttcctgctagtgaaaaccttctttgacatgtaggatctgcagatcttcacaaacaccaggctcttttccttctagaagatttctgtctgctgcctctgaatctggtctaggttacagtgaaccagaagtctccaccccatgactcacatgtgtgtggttgctattcagagaatgttccccttgtccagctagatggaaaaacgtctttcaagaccaggccgcacatgtcatggggtgggctttctgacctgccttaggaattctcacctgtgacactcttaaagaaacaccctgcttggaaggtgcatgttcatcctccactccataccagttaccttgggtggggtcacctcagggtgcttgttgccttctgagcctcactgcaaaatgccctctcatacttgaattttaatttttttatttttttgagacagggtctcactctctcactcaggctggagtgcagtggtgtgaatacggctaaccccagcctcgacttcgtgggctcaggtgattctcccacctcagcctcttgagcagctgggacaacaagtgtgtgccaccacacctggctagttttttgtattttttttgttgttgttgagacggggctttgctatgttgcccaggctggtctctaattcctgggtttaagcgatctgcccgcctcggccccccaaagtgttaggattacaggtgtgagccactgcacctggcccctcccatatactttaaaccatctccagatttcttataatacttaatataatgccagcacttcatttgtgtggattcagcatagtactcagtgtacagcaaattcaggttttgtcttttggaactttgtggattttttttccccttcagtattttgaatccacagttggttgaattccactaatgcagaacccatgaatacagaggactgactctatcagtgagggttttccagagagacagaaccaataggatatacatatgtacagatagatacatgagagaggatttattaggggaattggcttacacgattatacagactgaaaagtcccatgataggcagtctgcaagctggagaccctaggatgctggtagtatggctcattttagtcttaatgtctgggaaccagggaagctgatattttaactctgtctgaggctgaaggccgcagaggctggagtcctgatgtcccgaggggaaagagagggagaattttcttttcctccacctttttgtttttttcctggcctttagccaattggatggtgcctgcccacagtgcaggtggatcttccccagtcagcccaccactccacccgccagtcttcactggaagcaccctcagagacacatccagaaataatgctttaccagctctctaggtcttccttaatctagtcaagttgacacctaaaattaactaacacagaggtttgtggatttcaggttagtattcctcttgtagaggaaaaaaaggtgaattataaccaaaggcagatgaaactaagtgtttaagtgacttaccaaagatttgatacctgttctgtaacattttgtaggatgaaactaagtgtttaagtgacttaccaaagatttaatacctgttctgtaacattttgtaatacttcgcttattcaactctgctgttgtgtgaaagcagagatagaaaatatgtaaatgaatgagcatagcagtgttgtaaaaacaggtggccagctggaactggcctttgggtaacagtttgccaacccttcttctacgttatttggaaactttttctactcagtatattgcctgagacatcagttgaggtattttttgcttaaatggtagcacccatggtgtacctatccctattaatgtattgttaaatgcttacattaaagcaagtgtgtagaaataaggatatacaggttgagtatccttatttgaaatacttggaaccaaaagtgttttggatctttaaattttccgattttgggaatatttgcattatgcttacgatttcctaatgtgaaaatctaaagtgcttcaatgagtttttttttttgtttgtttgtttgttttgtttttgtttttgtttttgtttttttttacagagcctcgttctgttgcttacgctggagtacagtggcacggtcttggctcgccgcagcctccgcctcctgggttcaagcggttcttctgcctcagccttccaagtagctgggattacaggggtgtgccaccactcctggctaattttgtatttttactagagacggtgtttcgccatgttggccaggctgtctcaaactcctgacctcaagtgatccgcctgccttggcctcccaaagtgctgggattacaagcgtgagcccctgcgcctggctgagcttttcttttcagcatcatgttggagctcaaaaaattttagattttggaacattttggatttcagatttttggatactcaacctgtatagctgctggtagaagtcacggaatttctgaatgaagaaaggttacagtgcttctcaaacttgaatgtgcatacagatcactctggggtagtctggggtagagcctgagtcatttgtggggtcagtagatctgctgggagcctaggattctgcattgctaacactttccccggagatacctatgctgttagtcgctgaaaaacagtttgaattaacaagattctgtgttcagaaaattgtaaaatgctagatacggaaaaagatttaattggataaagacttaaacatccataaacacaatttccagtctcagtgatagtagttgaaagaacttgttagttgaacacatagtgagtagtaggcctccatattttcttttctttcttttttttaaaaaatagagacagggtctcgctatgttgcccaggctggtttcaaactcctgggctcaagcagttcttctgccttagcctcccaaagtgctgggattacatgtgtgagccactgcacatggctcatattttcttttattttagattcagtgttgaattggaccttctggtcttctaagaagttcttgaaaatggcttagttgctgttttctcaatggatattttgccttgatgttggtttcccccaatgttcttttaagacctgtggtcactggttgtcatttaatcttttatttccccatctcttactacttatgtcctattagcaaactacagttatgtaggaatattgaatcattacaggctgcttagtattggaagtaggtagaatgttaattcatttattttactgagaagataacttggaatattttgaattctctttttgatttgtctttgtttttgatcctggattttaaaaaattttgtaacttagggaaattttataacttttgtaactttataaattttatatcttagggaaaaagtaggaaggccagaaacccatatacctaccactttgctgcaacatttttcttttttcttttctttttttttaaaaaatagagatggaatctcgctatgttgcccaggctggtctcgaatgcctcaccttaagctgtcttctttggcctcccaaaatgctgggcttataggtgtgagccaccacacctggcctcaatatttttatttaaaaaaaaatctagtcagctttattgaggtatagtttacatacaataaaattcaacaattttttaagtgtacgaattcataaattttgagaagtatatttacttgtataactacctccataatcatagaacatttatatcaatccaaaaagctccctgggctatttgcagtcaactcaaaatactttctaatttccatttgatttcttctttgacccatgaactacttagaaatgtaaattcctaatatttggggattttctgcatatctgttattggcttaattctcctgtagtcagaaaacatactcttagattttagtcttttaaaatttgtggaaacgtgctttgtggcctaggattaaggtctatctttgtgactgttccatgtgcccttaaaaagaaatatattctatctatctagtcaagttctttgtgtttaagtttttaataatcttactgatttttttgtctgcttgttcagaaaggagtggtatgatttccaactctagttacagagtctgcttttttctgttctatcaactttttcttcacatactttgaagctttttttatgtacataaatacttaggcttgttgtgttttcttcttgaattaggaaatgtccctctttatccctcataattttttttgttttgttttgaagtttgttttttcagctattactgtagccactccagctttctttggattagggtttggatgttatatattttcccgtcctttttactttaactcatctttatttttgtgtctgttagcatatatttacattttccttttttaaaaaataacaaggctggcgtgtcatctcatgcctgtaatcccagaacttcgggaggccaagccagtaggattacttaataccaggtgtttgagaccagcctagacaacatagcgagtccccatttctacaaaaaataagaaagattagccaggctgggcgcggtggctcacacctgtaatcccagcactttgggaggccgaggtggttagatcacttgaggtcaggggtctgagaccaacctggccaacatggcaaaaccctgtctctgctaaaaatacaaaaattagctgggtgtggtggtgcatgcctgtaatcccagctactggggaggcttaggcaggagaatcacttgaacctgggaggcagaggttgcagtgagccgagattgcgccgttgcgctacggcctgggcaacgagcgaaacgctgtttttgggaaaaaaaaaaaaaaaaaaaaaaaaaaaaagattagtcaggcatggcatggtggtgcaccagtttccagttactcagaaggctaaggtgactgggttgcttgaagctaggaggttgagggtacaatgagctatgatcacgtcaccacactccagcctgggcaatgagtgagaccctgtctcttaaaaatcaaaaagcgaaatgacagcttttgccttttaattgttatgttagatcatttactttcccttctgcttgctcttccccttccccttcgtcttctccttttccctctcccctcccctcccctcccctcctctcccctccccttcggagatggagatctctctctgttgtccaggttggaatgcagtggccgttcacaaatgtgatcatagtgcattgcagccccaaacttgggctcaagcagtcctcccacctcactctcctgagtagctgggaccacaggtgcacactaatgtactcagctggatcatttacttttaatgtaattattcatatggctgagttttaaactgtcatctttctatttgttttccatctgttcatagttcttgtccccctcttttcttgcatttttcgggagtaatatactttttttttttttttttttttttttgggagactgaggtctcgctctgtcgcccaggctggagtgtagtggcgcgatctcggctcactgcaacctctgcctcctgcgtttaagcgattctcatgccttagcctcctgagtagctgggattacatgcacctgccaccatgccccattaatttttgtatttttagtagagatggggtttcaccatgttggccaggctggtctcgaactcctcgcttcaagtgatccacccgccttggcctctcaatataaacttttaaaaatgattcaattttatctctgctattggctttatgatgatatacctgttgtattttttagaggttgttcagtgtacaatatctataacttatcactgtatactttcaaataatattacttcacttcatatggagtatatgtacactgtgtttctcctctgttttctgttgtgctgttattgttacacattttaattctgtgtgtcataaattccacagtagattgtgtgtttaaaaaatgtattcgcttaactttgaaagagattaaaaatgagaaaataaatcctttttattttcttatatattcattatttctgtcacttttattatttgcatcagtgtaggtttccatctggtattattccttctatctgaaaaactttatcatttctattaatggaggctactagtgatgcattgtaagctttgaagcccagaagggcttcgtttcacctcctcttctcaccttcatttgtgaaagttattttcactggctatagaatcttaggttgatagagttctttttttcttgtagtactttaaatatgtggctgcattttcttctgacttaacatagagtgtgctgtcagttttatctttgttcctctgtttataaaatgtgtcttttttttctggctcctttagtgcttccctacccacagatgattttaagaatttttttttctccctagtttttagtcattagcttatgacatgcctttatgtggtttttgtttatttatttatatttttaattttaatttttatttttgagacagggtctcactttgttgctgaggctgttgtgatcatagctcactgcaaccttggactcctgggctcaagcgaacctcctgcctcagcctcctgaatagctgggattacaggtgtgcaataaaaagtattcctggctaatttttactttttttttttttttttggtagagacaaggtcttgctatattgcccagctgatcttgaacttcttggccttgaacagtcctcctgccttagcctcccaaagtgctgggactgcaggcatgcactaccatgcctaattttcttttattttttatattcatataataaatacgatttatttatttatttattttgtttgagacagggtcttgctctgttgcccaggctggagtgtggtggcacgatcatagcttactgcagctttgacttcctgggcttcaagcaatcctcctacctcagcctctcgagtagctgggactgtaggcatgtgccactgtgcccagctagtttttatatttagtagagacagggtttggtcatgttgcccaggctcgtcttgaactcctgggctcaagcaatccacccgccttggcctcccaaagtgttgggattataggtatgaaccaccgtgcccaggctctgtggctaatttcactccactagtaaggtgttatttttctgaggactgtagcaatgctccatacattacaaggtctttcttctctagatggtagaaatatgaacattttccagccctgtgtgagctttgaggattgttttgcttccttctactggtggttcattttttctgaggcgggagtttattttctcacatgcttagatcagtagtcagccaaacccttagggaacccccacttgaggtggctggagctctctctctgttcagcttcctcctttctgacactctggcacatagattctaaatacctgatctccctgaactcagaggttgtctcaattaagtggaaacttcaggctcttggtttcttctccctgtcatttggcctggagactgcttacaggcagtaagctgggccagttgtagtagatctcacttcatttgtttctcttgtcacatcttttatctagttttctaattgtttatggtggtaggctaaattcagtctctattactcctgaagtagctagtgatttaataatttgcatatttttttcttttttaccctgcctcccaccctagaatctgtctagtgtgagttatggacatcgtgtcattttacccttaaatatttaaaatgaacctcccaaaatttagaaccttctccttataatcacaatgttgttgtactaaggaaaattaatatgaatttctttctttttttttttttgagacggagtcttgctctgttgcctaggctggagtgcaatggcacgatttcggctcactgtaacttctgcctcccgggttcaagcaattctcctgcctcagcctcccgagtggagacagggtttcaccatgttggccaggctggtcttgaactcctgaccttgggtgatccacctgcctcggcctcccatagtgctgggattacaggtgtgagccatcacgtctggccaatatgaatttcttaatataatctaagactgattctgctttgtctaggattgtttccaaatgtcgtttgttttcttctcaattggattctttttctattttccttttattgtttctttcatggtttttttctccagtgtgtttttacaatgttatgttcatggttgtgtgtctcttctctacccagatattctttttgctatgatataaagtgggtgagtttattttttattttttattttttgaggtggaggctcactgttgttgcccaggctggagagcagtggcgtgaccttggctcactgcaacctccgtctcccgggttcaagagattctcctgccttagtctcccaagtagctgggattacaggcgtcagtcaccacggcaggctaatttttttttgtatttttagtagagactatgggtttcactatggtttcaccactctgttggccaggctggtctcaaactcctgacctcaggtgatctacccacctcagcttcccaaattgttgggattacaggcatgagccaccacacccggcttgtgatttcttttttcttttctttctgcctctgagaccagtgtattttttttccgccttccaatcttagtttgaggggctgattattttgtgttttattcacgtttctgcagtcacggggctgtgatcatatataatttttttgagaattccaggactcccattctcttgagatttttaaataagtgaattgtgtggcatctgagggctaggggcaacatcagaagtccagtgtgccatgctttcctacattttcattaaaatattatttcattccttggctgcctgtttgaaagattatattattaggttatgaccagtgttgtatttagcacactgtcttgaaaaaagaaaaaaaaaatcctctgatttggctgggtatggtggctcacacctgtaatcccagcactttgggaggctgaggcaggaggatcgcttgagcccaggagtttgagaccagcctggtcaacacagtgagaccctgtctctacaagaaatacaaaagttagccaggcatagtggtgcgtgcctgtagcctgagctactgggaaggctgatgtaggagaatcacctgagccctggaggtcaaggctacagtgagccttgatagtgctactgcactccagcctgggcaacaaagtcagaccttgtctcaaaaaaaaaaaaaaaaaaaaaaagttctcaaatttgtagccttttcaatgtcagtttccatggtggtgtaaatactcccttcatggctgatttcaagctacaaacataatgttacagagcatgaagttgggaagggaactgacactcatgagcatgtatcagccaaattgcttatctttttttatttgatttcagttcttttcttttttttttttttgagatagggtctctgtcatctaggctggagtgcactggccgttatcatagctcactgtggccttgaactcttgggattaagtgatactccctcagcctcttgggtagcttggattacaggtgcatgccatcattcctggctagtttttttgtattatttatttatttatttttacttattattattttttgtgacagagttttgctcttcttgcccaggctgaagtgcagtggtgcgatcttggctcactgcaccctccaccttccgggttcaagtgattctcctgcctcagcctcttgagtagctggtgttatagatgcatgccatcacgccaggctaagttttgttatttttagtggagacgggggtttcaccatgttggccaggctggccttgaactcttgacctcaggtgatccactcgcctcggccttccaaagtgctgggattacaggcatgagccaccgtgcccggcctattatttacatatatatatttattatttcagacagagttttgctcttgtcacccaggctggattgcaatggtgcggttttggctcaccgtaaccttcgcctcccgggttcaaacgattctcctgcctcagcctcccgagtagctgggattacaggcacctgccaccatgcccagctattttttgtatttttagcagaggtggggtttcaccatgttggccaggctagtcttgaactcctgacctcaagcgattcacccccctcagcctcccaaagtgctgggactacaggtgtgaactaccacacccggccacctggctaatttttaattttttgtagagacaggggcctttctatgttgcctaggctggtcttgaactcctggactcaagtgatcctcccactctggcctctcaaagtattgggattacaggtgtgagctactgcatctgacctgatttcagttcttgaagtttgttctatgtgtgtgtggggtgggggcagaggggcaggtaggctgctttatcctctacccatggcccccttatttccctcttcattaagtattagggaatagaaattatgtaattcaatttcatacattatcttaatataagtttttttcccacagtactgagattacacaaatactgatatttaggcataattaagataaacattcataggtcttatatagaagatgataatgagatggacttggtaactgtgtgtcccggggaagtgtttttagctttcccaattaaaccctatgaatcatgttctatctcaattacaaagattcagaaaatcattactcaggtcttttgccagtgaaagtgaatagtatgttgcttttataaaatttgtgtgtgggacagagaaaagatgactttgtttaataactctcccagtagaatttcagctgtgtaaatcgttgagcttttgtcatgagtgcttcagaacagcaatagttattgttttaagttatcaaaagtgacagaatactttatctgaactgcgacttaaaaacttgactttttcctgatttaagcagcagagacagaaataaaaaccagcttgacgcctttggtgccgaaaaaggagtggaatccacagttctgcaaagccaagcttgtgctatggcaactcagaccacttaaatccaattcagtaatccagtggaaattttcaaaatgaaagaaattattcaaaagttctcattcttccccattattgatttcttcttttttgctaaactcaattatactacatttataagtatgtttaaaggatacagaagatgcattggtatatttgattccattatttagtcttgatttttaaaagttccatgctaggccgggcgtggtggctcatgcctgtaatcccagcactttgggaggctgaggtgggcggatcacgaggtcaggagatcgagactatcctgactaacatggtgaaaccccgtctctactaaaaatacaaaaaattagccgggcgtggtggcaggtgcctgtagtctccagttactcgggaggctgaggcgggagaatggcgtgaactcaggaagtggagcttgcggtgagccgagattgtgccattgaactgcagtctgggtgacagagcgagactctgtctcaaaaaaaaaaaaaataaaataaaataaaataaaataaaataaaataaaagtttcatgctagtgggttttattatctcttagacattggcttcactgaaatttctttgctacttgtgaagatagttttggactcattcttctcacctctcttgggaggagtgtgttcaagaggagaaggaagtaactcaatagtagtttaagttgaattgtccttttatgccgctctttgtgctcgtaagcattttgcatgcatttaaggtaggcattgttgtctccattttacagattaaaaaaccacctcctgagatttaaaaaagttaaataattacttagctcatgtggttatggctaggaagtgtcagaattcaacccagttttgttttttcttcctgaattcttggcttcagtgtgtgtatattggtctgaaaggcaaagtgtgggagaaggaagaaaaggaggaagggggaagagatgatgatgatggataatttattgaaccttgcctctttggtaggctctctaatattaattgtcacacatggtttaaatcatttaatctgtgagtcttaagagagagctactctagtttcttcattttatggacaggagactgaacctgagtagttttctattcgatctgggaaacaactaatgattgaaggtagtggtattcaaacccagatcatttttttttattctagtaaaaaatgcttaaggtaaaatgtactgtcttaaccacttctaagtatacacttcagtagtgttaagtatattcacattgttgtctaacaaatcttagaacttgaacccagataatctgacatcagagtttatgcccttaaccacatagtgcataaacagaaaatttagtgttggatcacagaatttagtgttggataatagatgaaccatttttagacaacttgttttataaaagaggacaatttagttaaaaattttacttgatttgtcaaagaatcacttttttttttcttctcttgaagatggagaaataaggattaaatttactttcctgcatgaaaggaaacaaggaaaccaggaaaaatacagaaagacaatttttttttttctttgagacggaatttcactttcgttgcccaggctggagtgcaatggcatgatctcggctcactacaacctctgcctcctgggttcaagtgattctcctgcctcagcctcctgagtagctaggtttatatgcagccaccaccacacccagctagtttttgtatttttagtagagatagggtttcaccatgttggtcaggctggtctcgaactcctgaccttaggcgatccacctgcctcggcctcccaaagtgctcggattacaggcgtgagccaccacgcccagcgaaacaatggtttttaaggcattggtcatcaggtagtgaaggaccctgagaggggaaacagtaaggttggcccttcgattgtgccagctttctgccttgagagatttatgggttgtggtactatgagagggaacctaggtagagtccagggaacttcctcagttgaagagatgaagctgagggtcaggggagaccaaagtggctggagttcacagacagaatatcagggtgaagagagagctgcacagaggatccctgagatctgcagaggcttccactgtagtgttcagcagagctctaatcagcccatatgtggaaactacctgaggctaaagaatcatcccaaaagattagattgaacggtacctggtgctcagatagggctataagtagtgccttttcttaccaggtagactggaaaaactcagttcatggagcattgggtagactactgagataggtcttgcctcagtagtgggaaataattagccccagactgagcactcattctacataaatttgtccagagaattgaagaagaggtaatacttctcaacacattttttttttaccccaataccaaaacttgacaaagatagtacaagaaaagaaaactgtaagccggtatataccctgaacacagaaaacaaaattctaaacaaaattacagtaaattgaatctgacaacatgaccaagtagggtttatctcagtaatgcaaggttggcttaacgttcaaaaatcagtaaaatttaattcaccatattaatacattaaaaagaaaaaatatgatcatcttaatagctgcagaaagagcaggtacagaaataagcatttgttcccgatagttttttaactttttatttatttttatactttttatttatttttattttattttttatttttattagggatgaagtcttgctatgttgaccaggctggtctggaattcctggcctcaagcagtccttccatctcagcctcctaaaatgctgggattacaggagtgagcccctgcacctggtcctgatagtttttatcagcaaaatgtgaatagaagagaacttgctcagcttgataaaggacatctaaaacaaacctatggctaacatccaaacttgtgtgtgcggttggaattaccctcacaataagttttaataatatatgtgttaatattaatgcagaattcataatagtgctgggattagggagaagttgtttcatacatattcatagatacttgaataatcgtgttagaactagaaggggtcttcaagatgatactaattcagaatgttgttttttttttataggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaaggtaagtaaatttattgctgactgtgtctgaagttcctctatattcaatctaagttaaagaggagatttatatccttaattttccttctctaatgcaaggtcttcatttggaaattccatttccactggaatttggtatatgcattaaaaaatgacttattttaaaatggattgcccttttatattgttgaggaaacagtcaaatttaaatgtttttgaatttatgaatcagatcttacattagtaaaagatatgtctttaaagaagattctgtgtacatagtttctgactactttttatatgttttatggtcaatatatctatctactggtgccagcagtgaaggtaactacttatatgccattgaatacatcatttactcagttttaccagttctaaaatgacagctggtagacagattacctgctgttttgttcagttctcaaacagaattgttaagtgataaaggggagtcaagggagagaggttaaaaaaaatcacttattgagtacctgttgtgttctagatgctttatatgcattttcttgtttaatcttctcaacatccagacagaggtaaatagctttttatatccgaggaaactaaggctcagagaagttaaataacttacacagcactgattttaccgagacctggctgaacaccccttattttttctctatctgttagggacacttacagaatcttggggatctttgtgaagccctctctgtcttatgtgtaattattaaatctattccttttgtactttttgtactgatgtaaccctgattgattactgtagtgttcacttcctaataagtttccccgcttctgctctgtttatcaataaagctattctactgctatgagatgacttttctctaaatacttcttttttcatgtcagcttattgatctaaagtcttcaattaatgattgttagccagattttcttaatttgacttttaagtttctctgtaaattaatcctagtctattattctaaacttactttgttttacttgccagcatcaagtgtgtatttcacccagaatgatcttctagtctgtgaatataccatgtaaactttgttctgtgtcatttgtcctaaatcctgatcatcttttaatgtacaattcaacttctgcctcttagacactttactttttaattccgtctaaactttaaagttacttatctgaatcattggcatcatttgtgccctcttcctttttgtgggtacttcttattaatttttccataaccgtgttttctgttcctcacagcaggcatcctggctactatttggtattatccattatattgcacatatggtacacgtgcttaaacattttaatggatgaaaaatcagataattaggaatgctgtgaaacttaaagtattttgtacatgaaaataaatgtgtcacttaaattaatgtattttccgtattacaaaagtaatgattattgttgaaaaaattacttttaagttataaaatcttctttatctgaaggagggaaaaagatttatttcagggtcttttcttctagataaacattttagtgtatttatgtactatgaaattacaagcaatcattagtcttactgtttttaatgagcatctcaaaatatacttagtattattaattatattaatctataccaaatatggtttgactgccaaaaggaaaagattttagctgcttttggcttaaatatctattcctattatataattagatttttgttagctgtgtcatgtaattcatattgaataaatggcaaaactaaatccctagctcctttgtgtgtgtgtcagtgagtgagagagagcagggaaagcgagagagtttgcatgagtgagtgggctgccatgtagttgtccaaaaaatgtttactgactgctagtgaaaagttacttagtatagactgtgggtgatagaaacataaatcaaacatagatctcataggagcagttagatgtgcctgttattgtataaggcacatgtgatgtgttacattacagataaaatgctatagatattcaaaggagggagaacttcttgctgaggcactaaaaaaggacctgaaaccaggaaatctcatgtaatgtggtctcatttatacaggtcattttagggtactttttttttttttttgagacagagtcttgctctgttgcctgggctggagtgtaatgatcctctcttggcttattgcaacctctgggttcaagtgattctcctgcctcagtctcccaagtagctgggactacaggtgtgcgccaccatgcccggctaatttttgtatttttagtagagacggggtttcaccatgttggccaggctggtctcgaactcctgatttcaagtgatccgctcacctcggtctcccaaagtgctgggattacaggcatgagccaccatacctggcccattttagggtgcttttaacacaaatctgcttaattaactatacaaacttactgtattttctgtaattcatccaatttcagatattttagtttattttcccaatttttatatattcactctgtctcagaatttctgccctaaaccgtggtcattttaattaccttttaaaatactttacttaaaaatgtaaagggctgatgatcttgttcctccctttccttgaaaataggcctacaaaatgactggagtagtataattacagatttcctgctaggtctttcttcctcttctatcgtctaacaaatattagtcttggtacactgtaactcctcctaacaggatttctatctgtatataaattatttattatttgttaataacattttgtattttatttttataaatttttattttttgtatttaatacgaatatgttttatttttatttttaggtagattggctcaacacataataaatataactttgaaatgactttgagttagagttacttgtagcccagcctataagatgtgtactatcttgtagcccagcctataaaattgtactgtcttatacattgtggctagaattgttttctgtatttcaccctttaaaaaatatcaagtagagtttattttttttattcacataataggctttagtcccctagaatctgatcagtatactttaacacataatagaatatattaaatactgtgcagttaacttagacataccaagaagaatatacttggaaggggttttgcttatacagttgtgacttacatttctgggtagtagcacagcttctgtgtgtgtgtgtgtgtgtgtgtgtgtgtgtgtgtgtgtatgtgtatgtataagtattaaagtaattttttgtggtttttatgtctaagcacatgaacacactttcagcatggcttccaagttttctgattaacagagtatattatatgccatgtttacagatgttactgttaaatgaagaaacgtttatatttttccaaaccaaaagtccattcttaagaattctatggccaggtgcggtggctcatgcctggaatcccagcactttgggaggctgaggcgggtggatcacgaggtcaagagatcgaggccatcatggccaacatggtgtaaccccgtctctactaaaaatacaaacaattagctgggcatgcgcctgtagtcccagctactcaagaggctgaggcatgacaatcgcttgaaccagggacacagaggttgcagtgagccgagatcacgccactgcagtccagcctggcgacagagcaagacttcatctcagaaaaaaaaaaaaaagaaaagaattctatgaaaagctgttgctcttgaaataaagcttaaagttgtttgaaaataaaagtaccatttgagtcagtgccatagtcgttaaggaaacaactccagtaatacttactagaagattaaactgttttgataatagatattagggtaaaatacatctcttagcttggctgagaaattaagaatcagttttctgagtttcagaaatcactgaataagttctgatgaattggattgctcacttagcaatgctgtatatatgtcagttatggcatttattttattataactttatttacatgcatatgtcctctactccttgtgaacttgaagtgcagagtgtgaatcttactcatctttttgatgtcgatgatggtcattttagttatattgagtgagtgaattgctggacatggtggctcatgtctgtaatcccagcactttgggaggctgaggtgaaaggatcacttgagcccagcagtttgagaccagtctgggcaacatggcaagatcctgactctacagaaagattagaagaaacttagcaaagtgtggtggtgcatgcctatagtcccagctacttgggaggctgaggtgggaggatcacttgagtctaggaaggttgaggctgccgtgagccatgattgtgccactgcgctccagcttgggcgacaagagtgagaccctgtctcaacaaacaaaacaccaccaacaaaacatttaagtacatagatactaggaaacagattttcttcttaaatattttatactctatgtcatcctcatcggtaattgttcttaatgactaagtagtaagcagatttgtcatattgtgggatgcaggatttttgttcgaaatttgttttctctcagtcctcgtgttcatgtgaaagtgcgtgatgtatcagggactgtcttgtaatttcccttctcttgttcttagataccatgttgtcctgccgttcctgtcttgttcttttttttgaggcggagtctcgctgtgtcacccaggctggagtgcagtggggggaacttggcttactgcaagctccctctcctgggttcatgccattgtcctgcctcagcctcctgagtagctgggactagaggcgcccaccaccgctcccggctaatttttttttttggtattttttagtagagacggggcttcaccatgtgagccaggatggtcttgatctcctgacctcatgatccgcccaccttggcctcccaaagtgctgggattacaggtgtgagccaccacgtctggccttttttttttttttgaaacagggccgggctctgttgcccaggctagggtagagtggtgagatcttatttcactgaaactcttgcctcctggactcaagccatcctctcacctcagcctcctgagtagctgggactacaggcacacaccaccatgcctagctaattttcatatttttttttggtagaaatggggttttgccatgttgcccaggttcccttggcctcccaaagctgggattacaggtgtgagccaccgtgcctggccattcctatcttaaccatcatgtactttagcatactataatttccagaaatttttcttacgtggtttttgtaaaatgcaggttaatattgtttatgttttgattctatataacatgttggaatatctctgtatcacctatattgatataggtgaaaataagaataaatatctgtcttagatttaacaaaggttattaatatagcatgagaaaaacttcattgcaagattgatcgcttttatagcttttagtatgattcttacgttgtatgtatatatatattttaacttatgccttttgtttgcacctgtcattgaagagaagcataagggatcactccactctttcttcttcctaatagagcttgtaggaattttctgaaacaccgtttcaaagtgataattaaaaaaataagtaaaatgaagtatctgagactcttacttaaaacgattgtctgttatgatatagtttatctttttggtaggaagtatatatacactattatattgaattatttttgtggttgtatgtatatgtacgtttaaaccttttcattcttcatatcttgttttccaaattatgtactttggggtaggcatcttgtctttattttctggtcttctcgccactttgctaacttgactgtctttgatagagttggtagcttacagccaccaactttgcatttgagtaggaagccacttagtaaagaattttgtgattttatatatgtattggagtagtcataaactggatggagaaaggagtagtgtggttaattcagactaattgactttccttctgacttgacatgaaatctagagatttcttctgagcctcagtttcctcattagtaaaaccttgaagtttagacaagataatatttaagctcctttatgctttaaaattctacaaaatatattagtatactaagtttaaaacattaaaacactagtcagtaataaaccatatttttctgcctgtgtatttatttgggtacctcagtccatacatcagaaatgatttttatgtaatatgtgatttgtatataatatagaagaaaccaaaaactttccttaagtgcaatataattgtttggagaatatacaactttatttttttctgaattgacaaggtaattcttcctgtagccttaagagtaaatttccaaactgtttaaaacaaatgattagacatttggttggaagttttctttgtggtttgggatttgagttctccctactcctgaaatatgaaggtttcaagaatatggcccaggtaacctgtaaaaggcataaatattcccttcactggttcttgcctggagttgggttagtctggagatgtctgtgacttaatctctgttatatcatgagtcaggtagcagaaatctagggcacttttaaatctgtagacaaaccagcagactttgagaagcagaggtaagaatctagggaacacaaatgaatgcctgatcatagagaagagctagggaataaatttgaatggtgtaaaaatactattgttatagatgtttaaaaacaaaaatttaaaaaatactgatggtagttaaatctcttccaacaaaatttgagcaaaaattcccaaaggaaaataatatttatttagtacctacttcgtgtcaggtatagtgcaacatacgttagttaaagtacattttacattgctttttatctcagtattggattttctaggatatggtattctttattcttgcctgattccgctttatacggaaattaaaatcccaagaaagctgtttgtaaagaaatctgaagggataatggctacttgaattacttactgaagcataaggaaaaggaaaagctgatctgtgttcatgttatttttgtatgactaaaagtaactaatattgctgacaaaagggtatgtgaattttatatgactaaaggttattaggagctgatcattgctttgagtttagtgtcttagatataattttaatatgaaatatcaattttattttccacatttttttccaggctggggtgtagtggtgtgatcttggctcacgcaacctctgcctcctgggtttaagtgattctccagcctcagcctcccgagtagctgggactataggcgtgcaccaccacacccagctaaatttttgtatttttagtagagatggggtttcaccatgttggccgggatggtctcgatctcctaacatgatccgcctgccttggcctcctagagtgctgggattacaggcgtgagccactgcacctggcctattttacatgtttttaagcactaaccaggccttacctggaagagagggaatgagggtttttgttgttgttgttgttttaaaatataaactcaactttctccctcctcctttgaaaagggtatggaagtaagagcgtgaaagtatttttctggctgtttttaattctttggagaaattgtttcctctaaaaggtaatctaaaacaggcttatatctgatggcttatttagtggtgtattttttattttttatttattttttgaggtggagtcttgctctgtcacccaggctggagtgcagtggtgcaatcttgtctcactgcaacctctgccacctgggttcacgcaattctcctgcctcagcctacctagtagctggcattacaggtgtgcaccacgacacctggctaatttttgtatttttagtagagatgggggtttcactatgttggccaggctggtctcgaactcctgacctcagatgatctgcccaccttggcctcccaaagttctgggattacaggcgtgagtcaccgtgcctggccagtggtgtagtttttaatgccagagtttctagagttggtgacctagacagtgaatgtcagaaattacgtatatgcctagtagaaaagcctatatattgtttttcttaattatgttatatttcatgctaaaatgtttcatgttcagttggatcttttgtgagataagtaccctagctcagattttatctagattcatagtcaaccttggatttttctgttgttcaagtggttaagctccttataaggttgttgtggcgttttcttaaaggtgcagcaaggattttatgtgactaaaggttcttttaatgtttatcctatttcattatacctgaaaatcttttatagtaactgtgttgaatatgtttagtttattggtttgaatatgcttgtttggtgtgttttattaagcatcagggaaaccttgtattatagtgtaatagctttaaactgattaaaaattctttggtcatcatatatacagttccttttagatatagcttctgaatacttattcttcagttaattgtattataacctgtttaatttcttaaagtcattctgtacctctgcaggttgacatacatttttgatacttgtatgcaggaataaagttgttaatttgtgtgcatctctgaaatctgaaattataatcactttgcactagtaagtttccaaaatagtctatattgaaccaacaagtcaaatataaacacaaggtctagcaaatcaagaatcttagttatcatggtgtgggacagatagttgtgttatatgccagtatcaattgccaggttggtattttattatttatttaggatggaatgaatgacagggtcttgctttgttgctcaggctggcctcaaacttctgagctcaagcagtcctcccacttcagcctcctgagtagctgggaccatagatgtgtgccattatgctcggctaatttttaattttttttgtagatagggcttcttgctgtgttgcccgggccggtctcgaactcttgggctcaagctatcctcctacctcagcctcccagaatgctgggattactggtgtgagccaccgggtgtggcctcaattattttttttttatctgtcaccaggaagatgttcagcattttgccatcctgggggctcccttatatatcctaagcaaggaattatagtttgatgtgacggaaagactgtttcagatttaaactctgattttgtgtgctcttggtcaagtccacttcatcagtttgttaaattagtaaatttaggtgattgttattttatacagttggtttacattagatacctgaacagtggaagtctccctctattcttaaatcctgtcattgttttattgttttgtttttgtttttgtttttttttgagaccgagtctcgctctgttgcccaggctggagtacagtggcgcgatcttcactcattgcaacctccacctcctgggttccagtgatccttgtgcctcagcctcctgagtagctgggatcataggtgctcaccaccacgcctggctaatttccatatttttagtagagatggcatttcaccatattggccaggctggtcttgaattcctgacctcaagtgatccacctgcctcgggctcccaaagtgctaggattacaggtgtgagccactgcaccaggcccttaatgttttatacatagtagtttacttgccaattatttaattacatagttgtgcgaggttggaaagtgtttatagaaaacttttttcttttcagtagataaatcaacttattctgtaatcatgtataataggtgtaaccatgtgttctgtaattatgccatcatgacaggttctttccattggccctcctttacgtgagactcacgttgttgttctgtttgtcttcttacataggatgaagttactcattttaagttttagttttacttttatcttccttaggaactcttgtagatttgtgtttatgtatttttgcttattttgaggtaattcatttacttcagggccatcggttaagcctggaactgtgttttccttttcctttttcttgttcttgtttttttttttttagatggagtctcgctctgctgaccaagctggagtgcagtagcgtgatctcagctcactgcagcctccacctcccaggttcaagtgattctcctgcctcagcctcctgagcagctgggattacaggggcacgccaccacgcccggctaatttttgcatttttagtagagatgggggtttccccttgttccccaggctggtctcgaactcctgacctcaggtgatctactggccttagcctctcagagtgctgggattacaggcgtgagctactgtgcctggctgagctttttttcccccccccaaagtttatagccctagaatttcttttcttttctttttctttttatcttttcttttcttttttttttttttttgagatggagtctcactctgtcacccaggctggagtgcaatggcgcgatctcagctcactgcaacctctgtgtcctgggttcaagcgattctcctgcctcagcctcctgagtagctgggattacatatgcacgccaccatgcctggctaatttatgtatttttagtagaggtggggtttccccatgttggccaggctggtctcaaactcttgacctcgtgatccacctgccttggcctcccaaagttctggaattacaggcatgagccaccgtacctggccgagccctagaatttctgtggaagatgcctggtggggtgtacattggctgactctctaccctttcccccttcctcctctgcagacctgttcctttcccttccagttcctctcctcttcccctcctcctctccttttcctttcccttccctatgataacttgaaaaaatgacttttctattttaaaaagtatactagtggaagataattggctcaaaataatatttgttgttaatattggcaacttatcttaaaaaataatttgaatggagactctctcaagcatcttaattaggaaggtgaaagttaagaggaaatgagtatctggaaacatcagaaatgccttagttaagtacagttactcctagtaaccactaacccaggcctgtcataggcctgcttcattttagatatgatagaactctattcatgaacacactgcttgtctctgggactcctggattactctgatagtacctcgaagcaaggattttgccctcaaatttcctctctgtattggcaacgtacttcattagttggggctttatgtcccattatgacttcagttaaaaggatgcaccctgtattttgttttcttctgagtattagaaccatactgtctttagctaaaatagcaaccccttgggaaaaggcaacttctttttagtctacagtagtccatccttgtttgcagaggataggttctagattccccaatgaatgcctgaaactgtggatggtactaaaccctaaatatattaaattttcctttacataaatacctatgataaaggtcagtttacaaattaggtacagtaagggattaacaacaataacaaataacaaaagagaacaattatgataactactgtaagttatgtgaatgtggtctctctcaaaatatgttactgtcctgtactcacctattttcagaccacagttgactgtggataactgaaacaatgtgggtaagaggggactactctatattctaactattctaacctatagaaagtatttctgtatattaagatgtaggaggtacataaccttcctgaaaacttatggaatgacatcctaacataatttattttgttgctctgcaccaaaggtggttctggtatgtctattatttgtctggtttggatgtaaaatgcttttctaaagcttgagaaagaaaaaccagctattactacgacgtggtaaaactgcatattcagagcactaagactagggactcagtatctgtttggtgcattttaaaaatttgctatcatttgttaaactgattttgtcctcctataacttcactccattctttacaattttactacttagccaatgccaaaaaaagaatcataatagaaccgctataatcaagatgagaaacataatacttactgattcataaaatcaatacagtggttaaatctgagggtaggaaaacattcccagtggaaataatgttctttatacaggacatcttacctcctcaaggaaatctacagtttatttttgatgacggtgtagtatattataaaataataaaaactaaacttgctgaaagaaacatagtagtggacagagtttagccatagtcttgaaagtggctcaagcattaaaaatcaaagagagttttttgtggtaatattgtaaagcacaattttcagtgaaagccaaattaggttataatttttatttctatatcttacttgcatttgttcagttttcaaagacttgctggagactaatgatgttactttaagactactacaacactccgcatgtgttagcttgactttttccatcatatgcttgagaggcattcttgatacagtagaaagagcaatatgcggcaaccaaatactagagttctactcctaattttagtcttacgaccttgagtcataccctttgattaaaatattcatcgtgtctcctttgtactgttactctgagggtaagatgcagtaatatatgtaaaagtgctctgaaaactgcaagcctctatgctgtatacatttaagaagaatgttgtaatctcatcattatcttcacataccatcttcccaaccaaatcccttgagactttaaccattatgaaacatggccacacaatttgattttataccccagctttttggaatgcagtgatttttaaaaatttatttttattgtagtaaaatgaaaagctaccattttaaccatttttaagtggtaaagagcaagatttttgccctgtggtttcctctctgtattgccaaagttcattggttggggctttatgtcccattatggcatcagttaaaagaatgcattaaatggcattaagtacatgcacaacgttgtgcaaccgtcaccatatccatcatcacaaacagaaagtatgtactcattaaacagtgactccccatttttctctccctccagtccctggcaaccaactattctactatctgtcccagtgagtttgctattctaggtacctcatatatgtggaatcatggattatttatgactgacttatttcacttactgtattagtccattctcacattgctagaaagaactacctgaggatgtgagggcaatctggctgcaacatttgtcaccccattaatctccagcgttcattcgactgatctggctggctagatgggtgtccccttcctccctcactgctccatgtgcatccctcctgaagctgcatgcttggtcgaagaggacgaccatcctcgatagaggaggactggtctttggtcaagggtatatgggtagctgtgctcccctgctagaacctccaaacaagctatcaagaactacctgagactgggtaatttataaagaaaagaagtttagttgcctcatggttctgcaggctgtacaggaggcttggctggggaggcctcaggaaatgtacagtcatagcagaaggagaaggggaagcagggacaatctcgtgagaactcactcgctatcagaagaacagcaagggggaaatctgcccccatgatccaatcacttcccaccaactcttcccccaatactgggaattgcagttcaacatgagatttgggtggggacacagagccaaaccatgtcactcaccataatgtctgagttatttcactgacttatgtctgacttatttaacttatcatgatgttttcagggttcatccatgttgtagcaaaaatcagagtttggttgctttttagggctgaacaatattctattgtatgtatacatacatactttaaaaaaacctattcatctgtttgtgaacatttgggttgttttcattttttgtctgctgtgttgctatgaacattgatgtgcaactatctgagttcctgctttcagtttctttgggtatatacctacaagtggaattgttggatcatatggtatttctgtgtgttttttttttttttttttttgagggaataccaaattgttttcctggaatacagtgatcattataaggcaatatatactgcagtttttctgactgttgagtcgaagtctaaacaattaaagaatctggttgttttcagatagctttttattgagggcttgttaaaaaactaaaaaggtagtatgtggttgggttgttcctgtcagctactttttattattatttcatgacatgttatccaacaggaatattgcaaagatttacattttataaaatgctaaaatagcataaagatgtggactgtcaaacagattgtagtagaattaaaattagaaagctataatccagtcgcttggttaacggaataaattatgtcaaattcctgattattcatttgtggttttactattttatggattgtgacaatctttaatttgttctggcttctttctactatttacctgccttctgggctctccctcattccttcttctgttcatgtatgttttagatacaagttaattttgatgttaatagaagcagtgaattttgatatgtgatttaaatttgatttttaaattatctgcactgctacttgactgcatatatacttgagaactgattttatatgtggttttaatccaatttaaatcaatactgggaatgttttgtatcttagacattattttgttttaaaaattattttaaaaaatttaaatacataatacttgtacatgtttctggggtacttgtgatattttgttacatgcatacaatgtgaaatgatcaattcatagcatttagggtgtccatcacctcaagtattcgttatttctatgtgttgggaacatttcaagtcctctttttttaaactattgtgaaatatacaatgtattgttgttaactgtagtcaccctactctgctatcaaacatttgcactttttacttcgatctaattgtatgtttgtacccattaacaacctctcttcatctcccctcaagccccacccactcacccttgctagccactggtatctatcattctgctgtctaccttcatgagatcaactttctaatctcacccataagagtgagaacatgggatgtttgtctttttgtgcttggcttagttcactcaacataatgacctctagttccattcatattgctgcaaatgataagatttccttttctttttcttttttttgagacagaatctcgctctgttgcccagtctggagtgcaatggtgcgatctcggctcactgcaacctccgcctccctggatcaagcgattcttctgcctcagcctcctgagtagctgggattagaggtgtgcgccgccacgcctggctaatttttgtatttttggtagagatggggttttgctgtgttggccaggctggtttcaaactcctgaccttgagagatccgcccacctcgtcctcccaaagtgctgggattataggcgtgagtcactgctccgggccttattattattatttttaatagtcaaattgtactccattgtgtatatatgctacattttctttaaacatttatccgttgattcacacttagttgattacatatcttggctattgtaaatagtcctgcactaaacatgggagtgcaggtatcctgttgacatactgatttcttttcctttggataaacacccagtagcaggattgccggatcatgtggtaattctatttttgttttcttgagaaatctctatgctgttttgcatagtggctgtactaatttacattcctatcaacagtatagaagagttactgttgcttcacattctcgtcagcatttgttatttattatctttttaataacagccattctaactgcggtaagatgatatattgtggttttgatttgcatttccctgatggtaagtaatgttgagcattgttttttataccttttggccatttctatgtctttttcttctttattttttcatctcaaaggacacaaaccaacatttctgtgtcttcttttgagaaatgtctgttcatgtcctttgcccactttttaatgggatttttttttaaactattgagttccttgtatattctgggtatttgtcccttgtcagatgaatagtttgcaaatattttcttctattcaacaggctatttctgtttttttttcttgattagcaagtggtcattgattttatttatcttttcaaaaaaacttggttttgtttatccttcctattgttttttgagtgtctgttttgttgaattctgccctgtttttttttttttgtttttttgtttttttttaagttggaattttgttctgtctcccaggttggagtgcagtggcatgatcatagctcattgcaagcttgaactccagggctcaagcagtccttccacctcagcctcccaagtaactagaactacagggctctgggctgttttttttacatttttttagggatggggtcttgctatgttgctcatgctggtctcgaactcctagcctcaagtgatactcccatttccacctctcagggtgctgggctttcaggcactgagtcactgagtcaccttgattattataatttattttcttctactaattttgggttttgtttgttcttgctttactagttccttgaggtgcttcattatattgtttatttgaaatctttccatattttttgaggtaggcatttattgctgtaaatttccctgtaagcagtgcttttgttgtatcccatggattttggtatgtcgtgtttcaaattttcattcgtttcatttgttttttgatttcttccttaatttctttcttgatcagttgtctttcaggaggatgtttgtttaattttcatgtatttgtacagtttccaaagttcttgttcgtggtttctagttttattcttttgtagtctgacttgatatgatttctatttaaaaaaatttgttgaaacgttttgtttcctaacatatggtctatcctcgagagtatttcatgtgctgatgagaagaatgttgtgtactctaactgttgtatgaaatctgtaaatgtcttttaggcctatttggtccaatgtgcagtttaaatccaatgattctttgttaattttatgtctagatctgtttaatgctgagagtggggtgttgaagtctaccaactattatggtattgcagttgatatctccctttagatctaataatatttgcattacgtaatgggtgctctgtagttgggtgcatatatatttagctactcctgcttgcttttggtttccatttgcatggaatatttttttccatctctttactttcagtctgtgtgtgtctttacaggtaagatgagtttcctgtaggcaacatatagctgagtcatgtttcttttatccatttagccaatctttatcttttaagtggaaagtttcatccttttacagttaaggttattactggtatgtgagcgcttattcctgccattttattaatttcttgttgttttgtatattttttggttttctttggcttttttgagatgggctctcactgtgttgctcaggctggagtgcagtggtgcaatcacacatggcttactgcagccttgacctcctgggctcaggtgatcctcccacctcagcccttcatagttgggactaaaggtgtacgccaccatgcttggctaatttttaaaattttttgtagagatagggttttgccacattgctcaggctggtctcaaactcctggtctcaaactcctggcctcaagtgacctgcctgtttcggcctcccaaagtgctaggattacagatgtgagccactgtgcccagcctgtatattctttgttcctttctttttctcttattgtttatcattgtggtttggtggttttctttagtggtaacatttgacttctttttctcatttgtgtatctgctctaccagttagctttatatttctgtgtgttttcatgatggtgatcatcatctttttgcttccagatgcagaattcctttgagcatttcttgtacagttggtctagttgtgtcaaattacctgtttttgcttgtgtagtaaggactttatttctccctcatttctgaaagaaagttttcctgggtgtaatcttggctgccaggtatttttttcttttagcactttgaatatatcatcccattttctcctggcctgtaaggattctgctgagaaatctgctgttagtctgataggagttcccttgtaaatgatgagatgcttttctgttattgtttttagaattctctctttgtctttgacttttcacagtttgactataatgtgccttggcagagaccttttcgagttgtatctatttgaaggtctctgaggttcctatatctgggtgtcaaaattgctttctagatttgggaagttttcagctcttattttgttaaataggttttttatcccttttgttttttctttgccttctggggcactgaaaatttgaatatttggtcactttatagtgtctacatgtcatgtatgctgtgtttattcttctttatttttatgttattggattatttcaaaatacctgtcttaaagttgtgaaattctttcttttgcttgatctagtgtattgatgaagcttttgaaataatttttgtatttcattcaatgaattctttacttccagtagttgcatttcgttcttttttatgatatctgtctatcttttttttttttttttgagacaaggtctcactctgttgcccaggctagagtacattgatgcgatcttggctcactgcaacctctgccttctgggctgaagcgatcctcccacctcaaccacctgagtagttgggactacaggttcacgccaatatgctgggctaattttttttttttttttttttagagatggggttttgccgtgttgcccaggctggtctcaaactcctgggttgaaacgatccacctgcctcagcctcccacagtgctgggattacagatgtgagcctagccctatgatatctgtctttggtaaatttctcattcgtattctaaattttatgatttcttagtattgtgtctgtatattgtacctcacttagctttttaaatattattttgaattctttttctgggatctcataaatttctttttcattggaatctattgctgcagaattatttaggtcatatttccttgctttatcatgtttcttgggtccttattgcgcatatggtataacagtcacttcttcccagttttttgaattcgctttctgaggcgagggctttttcctgaagatgtgtttatgatgttgattgggtagggcattttggcatgaatctgggtgcatgcagtggtgtagtctccgtataaattattcggctgtttacagcgttaatagtgtctgattttctcagtgatgtagggtttggtttgttagtggagtctgtggtgaggcttagctggggacaggttcaccaagtgggcctgtccttgggccttagggcaacatatgctggcactggtgttagcaggtccaggtgggctgattcttgggcctccaggtggcttacttgggtgttggtaggggcagtggttggccagttgggtgggcagattctcaggctcctgggcagcgtatgtggcatggttgatagtgggaaaaccctctgtttcccaggtggtctgtgctgataatggcagtggctgcaatgggctgggcaggccagtctccaggcctgcaggtggtgcatgtggttggggaccagctgtggtatgtaatggcagattgagtgggctaaatctcaggcccctaggagaagtgttcacatgttaacggtggtggagggggctgggtagacctgtcctcaggcccactagtaatgtgtgtgggtgttggctgtggtaggcaggggtggggtgatccccatggccccagtggagtgctcgagtggggccctgccactggggagggaagggttgctttcagtggcaccagacataaacattcagctgatgagtgggtctttgggccccaggtggcagctgtgggcagggtagtctgtcctcaggacacttgtaaaggtgtagtagctccactgcttggggcagcagggtcactgccaatagtttgtggtttagcaccagtggcagcagccagcaggagtggtggctttgggtggtgggagtcttacagtctaacttaggcctccttggggcacatgaaaatgcatagcagctctgctgctgggggcagtggggttgctgccagtggtttacactttggcttgggggcagcatgggatcacaacagtggctgtaggtggggatgtaagtggactccagggatatggagatgccggggctgtttggccccagggcagggtacagccttgttggggctgggctctcaaaacgtgctgtgctctagctgcttaggactaaggagtggaggggaccgttcatgagcagtatcatcgtgtggtccccaggcagctccctttgtcagtatgagatgattttcttattatgaaatcgatattggccaggtgcggtggctcacacatgtaatcccagcactttcccaggctgaagtgggtggatcacctgaggtcaggagttcgagactagcctggctaacatggtgaaaccgcatctgtacaaaagtacaaaaattagctggtcatgatggcagatgcctgtaatcccagctgctcaggaggctgaggcggaagaatcacttgaacctgggaggcggaggttgcggtgagccgagatcgctgcattgcactctagtctgggcgagagagagtgagactcatcttgggaaaaaaaaaaaaagaaagaaagaaaaaaagaaatcagtatcaaggctgtaaggggcctacttcaagtgttcttaacttctgttttccttctaagttgtttatctagcttgtacttagacaccttaatagatacataaatatttctttgggtagggtgtatagcatacaatgtttttttttgttgttgtttttgagacagggtctcactctgtcacccagacttggagtgcagtggcgtgatcttggcccactgcaacctctgcctcccgggctcaggattctcccattttagcctctcgaagtgctgggagtagcgtgtgccactaccgcccggctaatttttgtatttttattttaatttttgaggtggagtctcactcttgttgcccaggctggagtgcagtggtgcaatcttggctcaccttaacctctgcctcctgggttcaagcgattctcctgccgcagcttcccaagtagctgggattacaggcatgtatcatcacacccggctcattttgtaatttcagtagagatggggtttcaccatgttggtcaggctggtcttgaactcctgacctccggtgatccacccgcctcggcctcccaaagtgctgggataacaattgtgagccaccgcaccctgcttaatttttatatttgtaatagagacagggtttcaccacgttggccaggctgatcttgaactcctgacctcaaatatctatccgcctcagcctcccaaaatgttgggattaccaccaataccgtgccaggccagaatgttcgttcttttttttttagacagagtcttgctctgttggccaggtcttatattaaaacttaaatatctttttgtagcttttgccctcaatttttttttaccatatagaatactagtgctttcatttaacaggggtttcagggtgcaattttgctgaataataaattttaatgacgatgctgttttgagatagtgtttttatagtaactgtaaatgtgtaaatatgataatgatttttcaaaatagtgtgtacctttataaacataatttatgtatttacagtcacatatatggcctagaatttcctatcagtttgcaaaagtaattttatgaaaatacatgataggcagcaaaagttgaggcaggatacttgtttgttcaggagagtctatttttaagtttgtggagttctcatttagaagatgtgttgggctttgttgattacttaacagcagtagcttgggtccttaaggctttaagtagaaagcctggagttcttgtacctgggaagccctgggagttatttggcaagaggaatgtgagtacagcctcaaactaaaagggtgccaagactgacgtgaaatgaaggaaaagagaaaatagacaatgtttaaaaatgtacacagttttcaagctagtaaatgtatgctactgacccctacttacataaaatatattcatgttaggtatatagttagaggtgcattttggcaaatgtatatacttaggcaactgccattgaaatcaagataaagaatgtttctgtcgtatcacaaaattccctcattactttttactcttagtctccaccctaggcaactactgatttgcttcctgtcactactagatagattttgactgttccagaattacatatcaatggaattagactctgcattcttttgtgtcttaacaaaagtgcgtgttttcaatagttggcttttttttttttttaatttctgagtagtttgccattatatgaatacatctttctctttacttgttgatagacatttaggttatgttcagtttttggctattataaataaagctgctgctaacatttgtgttcagttatttgtgtggatatatgctttatgttttcttttttcttgagtagaattgctgggtcataagctttttttgtttgtttgtttgttttagatggggtttccctcagcctcccaaagtactgggattacaggcactagccaactcgcctggccttgtttgtttttgtttttgttttgaaagggagtgttgttctgtttcccaggctggagtgcagtgtcgtgatctcggctcactgcaacctcctcctcctgggttcaagcaattctcttgcctcagcctcccaaatcactgagattacaggcacctgccaccacacctggctaattgttgtatgtttagtacagacggggtttcaaacatgctggccaggctggtcttgaactcctcaccttcagtgatctgcctgtctcggcctcccagagtgctgggattataggcatgagccactgtgcctggcctggtttttatatgtttgactttgtaagaaagtgctaaacagttttccaaagtgatgttgtcattttccattcccatcagcagtgtgtgagttccaggtactcaacaccctactaatatttggagatgttattctagcaaagggtatgtgataatatattattctagttctgatttacatttctttgttgactaatgatgttatgtaggtttccatatgcttgtttgccacctgtgtatcttctttgtgaagtattttttcacattgttgtttgtctttcaatggttgtcttattattgatttgtaagaggtttttaaaaagatattccgaatataagttctttgtcagaccatatgtattgcaaatgttttctcccagactgtggcttgcctttttttttttttttaaagctatttctcagcggaagttttgaatttttaagaagcccttttaatgaaaaaatttttttcttttatgatttttgcttttgtttcttaaggtagcattgactaccaaggccatgacagttttcttctagatgtttccagttacagttttacatgtaagtctgtattgcaattcaatttaatttttctttatgatagaggtaagggtcaagggtaatatttttcacatggatataaattttttagcatcactttttgaaaaacctatcaattctttgaattgccatgatctatatatgttgagacctatttatatattcttaggtctttcatttcattgatctgtctatatttttatgccactgtttggttactgtagctttatggtacatgtgctaagcaaggtccatttacgaggcagaatccatacagtaaattgaagaatgaaattttagtataaagaattagctcttgagtcacccctgtgcagccttggtgccgtgtgcattttggacactcagcccaccttgctctctagtacttgtaagccttttcctttcaagatgcctgcagaggtgtaccatggagaaggggaggtggcgacttttgccttttaggcagaaattgcccaactcatgtctctcataatcaataccttctattccaacaaggagattttccttcaggagttgatctctaatgcttctgatgccttagacaagattcgctatgagagcctgacagacccttccaagttggacggtggtaaagaactgaaaattgacatcatccccacccctcgggaatgcatcctgactttggtcaacacaggcattggcatgaccaaggctgatctcataaataatttgggagccattgccaagtctggtactgaagcatttatggaggcttttcagtcttgtgcagaaatctccatgattgggcaatttggtgttggcttttattctgcctacctggtggcagagaaagtagccatcacaaagcacaatgacgaagaacagtattcctgggtatcttctgctgggagttccttcactttacatgttgaccatggtgagcccattgacagggataccaaagtgatccttcaccttaaagaagatcagacagagtacttagaagagaggtgggtcaaagaagtagtgaagaagcaccctcagttcataggctgtcttatcgccgtttatttggagaaggaaccagagaaggaaatcagtgatgatgaggaagagaaaggtgagaaagaagaggaagataaagatgataaagaaaagcccaagactgaagatgtgggttccgatgaggaggatgacactgataagaataataagaagaaaacaaagaagatcaaggagaaatacactgatcgggaagaactaaaccagaccaagccgatttggaccagaaaccctgatgacatcacccaggaagagtgtggagaattctacaagagcctcaccagtgcctgggaagaccacttggcagtcaagcaattccctgtagaaggtcatttggaattcagggcattgctgttcatccctcatcaggctccctttgaccttttttagaacaagaggaaaatgaacaactctgtgtccatcatgtgtggatcatggacagctttgatgatttgatgccagagtatgtcggctttgtccgtggtatggttgactcttaaggatctttccccaaacatctcccgggaaatgctccagcagagcaaaatcttggaagtcatttgcaaaaacattgttaagaaatgccggctgggcatggtggctcacgcctgtaatcctagcactttgggaggctgaggcgggcagatcacctgaggtcaggagttcaagaccagcctggtcaacatggtgaaagcccgtctctactaaaaatacaaaaattagctgggcacaacgcctgtaatcccagctacttgggaggctgaggcaggagaattgcttgaacctgggaggcggaagttgcagtgagccaagatcatgccactgcactaagcctgggcgacagaagaaggctctgtctcaaaaaaaaaaaaaaaaaaaaaaaaagaagaagaagtggcttgagcttagcttctctgggctggcagaagacaaggagaataacaagaaattagatgaggtattctctaaaatctcgtggcttggaatccatgaggactctattaactggcgacacctgtctgaactgctgtggtctcacaccttccagtctggagatgagatgacatctctgtcagagtatgtgtcttgcatgaaggaggcacagaagtccatctgtgacatcattggtgagtgcaaagagcaggtagccaactctgcttttgtggagcaagagtggaagaagggcttcgaggtaatatatatgagtgagcccattgatgagtactgtgtgcagcagctcaaggaatttgatgggaagagcctgctgtcagttaccaaggagggtctggagctacctgaggatgaggaggagaagaagataatggaggagagcaacgtaaagtttgagaacctctgcaggctcatgaaagaaatcttagataagaaggttgagcgggtgacaatctccagtaggcttgtgtcttcaccctgccgcattgtgaccagcacctacagctagatagccaatatgaagtggatcatgaaagcgcaggcattttgggacaactctatgatgggttatatgatggctaaaaagcacctggagatcaaccccaaccaccccattgtggagacactacagcagaaggctgaggcagacaagaacaacgaggctgtcagtgacccggtggtgctgctgtttgaaaccacactgctctcttctggcttctcccttgaggatcctcagacctatccagctgcatctaccacatgatcaagctaggttagctattgatgaagatgaagtggcaacagaggaactcagtgctgctgctcctgatgtgatgtgttcctgaggatgtgtttcacatggaagaagtagattaagagtttatacctgcaaaccttgtgcccttgcatagtgtccccatggctcccactgcagctttgagtggtcctgtcccacctggcgctctctgctgatatctagtattttttctcttctgtccttgtgtctaaggcaggaaacaagggcatcaagccccattccctctctactttgacagcagaattggatgttgtatatcctgtttttttgttgttgtttattttgttctgaaagtatgtaaaataaagaatatgctgtttttatacagtaaaacaacacaaaagattaccatttctggggattagcaactaaaagaggattatttttcttggcttgttgtggtatctgtaacatcatacttaatgttacagagttgcataaaagtggcaagtgtgaatatctttaccttcttcccaatcttaggggagaagcattcagtctttcatctttaagtatgatgttaactggagtttgtagatgcattttatcgggttaaggaagttcctgtctcttcctagtttgctgagaattttatcatgagtaggtgctgaaatttgttagatgctttttctgtacctaatgagatgattttgtggcttttctcccctttgaatgcggtgaattacattgatgattttagaatgttaagccagcctcttattacttcatttgcttatgatgtattgtcctttttatttattgctttgttcagttttctagtttttggttggatttttttgtttatgttcataaggaatatcagtcttttttttttttttttggggggggtctgtctttggttttggaatcagagtgagccacataaaatgagttgagtactcttccctcctgttttcttaaaatagttttataggacatcaggggaaccatctggccctggtatttttcttgtggaaaggccttaaatcatgaattcattttcttcagtagataggggcttattcagattttctatattttgtgatagttttcataatttgtaccttttaaggagtttattttatctaagtaattgaatttattttcattatgctcataatattactttatcactcaatgtctgcagtactggaatgatgttttcttttttattcttcattgacaatgtattttttaatgatcttttttattggctgtagaatttggattgacattgtttttctttcagcattaaaaaagttactccaataatttctagcttgcattattattattattatttttgtggagacagagtcttgctctgtggcccacgttggagtgcagtggcatgatctcagctcactgcaacctctgcctcctgggttcaagcaattctcctgcctcatcctactgagtagctgggactacagatgcacaccaccatgcccggctaattttttgtattttagtagagacaggctttcaccatgttgcccaggctggtctcgaactcctaagctaaggcaatctgcccaccttggcctcccaaagtgctaggattacaggcgtgagccaccacgcccggcctgcttgcattatttctaatgttaaatcagcagtcactctgcatataatcagtctctttgatggattttaagattttctctttaacgctgattttcagcagtgactgtggtgtgttttgtgggtttttctttgtgtgtatctttcttggtgtttgttgagttacttagacttgtgtttatagttttatcagtttggaagttttttatcattttatcaaatttttttttctgtctcctctcgcttctttatttatttactgtttgataggttactgaggctctgggttttttttttttaaactctttatctctctgtacatcaagttagatagtttttgttaccctgtcttcaagttcgctgatattctttcttgcagtatctcatctgctcttaagtcagtccagtgagagagagagatatatatatatatatatataattttttttttcattttagaaattatattttccaattctggaagtttcctcccctctcattcctttccctctctcctctcttccctgtccctccccttccctcccctctttcgacagtttttggtttctccttattgtgcttatattttccccataattctttaacatatttacaatatatagacactaaatcactaaatccttgtctgctaattccgttatcattcattctcactttttttgggggggactaattttcttcttctttgtcacatttctttatagttagtggtttggtttttttaccccttgttttttttaatagtttgtggtttttaattggatatttcacattttgattaatatttagtgtctttttgtcgttgtttgttttttttaaaattagagatggagtcttgctacattgcccaggctgattgaaaactcctgggctcaagcaatcttcccaccttgccctcccaaaatactgggactacaggtgtgagccactgtgcccacctgtgtctggatttttaaaaaacttttaatttaaaaataattgtagagtcacaggagcttctactgggaagtcctggacatctttcccccagtctccctcagtgttcacaatttatataactatattacaacatcaaaaccaagattgatattggtacaatgcatagagtttatttgggtttcatcagttttacatgtacgtgcatgtgtgtgtgcctgtgcataattctgtgcaattttgtcacatgggtagtcttgtgtaattatccctacaatcaaagatactcaatggtagcatcaccagactcccttgtgctatccctttatggccacattcatcccctcccccatctataatcctaaacaaccattaattggttctccatctccataattagattatttcatgattgtcgcatgaatcgtattatgcaagtagtatctttgagattgacttttccactcagcataatttttttgaagtttgtacaaattgttgtgtttatcaatagtttgttcctttttattactaaattctatcctattgtatggatataccacagtttaactgttcgtattttttttttaaaaagtatggagttttgtttgttagatagttgagtaacttgtggatcagcttgacccttttgagccttttttttttttatgattaattaagcagaaattttatttccaagctcttcaaagactgttacaaacacaaataatgtatccttctaaaaaagtgtcccaaattaaatcagattcacatcatcaaagtaaaacccttgtgaagttaagaattcttttaggttgtaatgtttttatgttagtttttaatcatttacaatgttctgtgggtcacattttaaacatttttaaatatatgaaattctgtatttctttaagtacagccacagctacaaagtagaggaacgtaagaatacaaagaccaaatctgcttcatttatatacacgatggggcagcctaatgcacatcataacattaacttttccaaacaagtttgctaagaatctgctcccataattagtgttaaaaataaaacaatcttcccatttagaaaaatcaagacatcagttgattagtaaagcctattcttcctcccagcaatttgtactttctggtcttcatttaggaattgtaaattcatgagaaaagaacaaattttttatggtataaatatcttccaggaacaacagtttacaagtattcgattgtttaaataaacaaaactattttccttcctaaaatgtaaacatccagtaaatgaaacatacatgatattccaggtatagaaatcttagtaactcacttatgaaagaggtgcattttggtatgtttggtggtaaggtttttgtttatcttatgtataaaagtacttgcacaaaaaaacaagctattactatttaaaactctattccttcacccagtttcctcactcaagtagaaactcatgaatttctgtgattttggctataggacggggccacaggaaagggctgaaatatctctaaaagttagggaaaagtgttttcttgagacttgaaggcagtcattcatcactttgtgcttgaaggcattcctcagcaaacttctctcttagagtcttcagagtaaagcacaggatctgggttcccagaaggggttacttccagctagaacacccaccagcagggcatccttgcaggcattctgcatacagtactgttgaagctctgcggctgcctgagagacattgatcctctccacgccagcctccaacttgagctgctccaccaggcactgcagggcgctcgcgctagccccagaggacatggtggcggcgctgggctccgagggcccagccttgtttttaagctttattaggataggtttgaagtagcctttattctaggaatagtttgttcctatttccaaggagtggcttttctgggttctctattaaatgacaacaaagtctgtcttctgtgcttgatcacaacttcgatgtatccctgtctcttgtaagatccagtaattggtcaactaacagctccttaatagttgtttttgggcccacctttgtggagtctctctttatgcatccacgatagtattgagccacagactacaggtgaacgcctgtgcagatttctggagttctttctcattgttgcaccttccttttttcttaaatcatagtccttcactgcttgttgtctattgtctgaaagcagttgtttcatttatgtaactgaaaaactgtatttttgaggtgggtaggcaagtccagtaatggtttctccaccattgtggcaacaaaactttttgtttatttctaagttagtaatttgaaagtcaaaattgattcatctgtccaaagagcagtagtttttgttttgtgtcttaagatgttattttaacttacattttattttttgaataagaaatatgctcgtatgttttaaaatttaaatgccacaaaagatatacaatgaggtatccttccctcccttatttcccagtcacccactttccattcttggggacaaccattgttactagtttattgtgtatctgtcaagaaatttgatgcacattcttataatgtgtatcttactcagaaattctctacacagaaatgtggagatatgtatatatacatatatatatatatatatatatatatatatatatatattctccttcatattcttgtttttaaaaaaaggtaacgtactatattcttttttgtatcttatttatttatttatttatttattggagatggagtgttgttctgtcacctaggctgcagtgcagtggcgtgatctcggctcactgcaagctctgcctcccccgggttcacgccattctcctgccttagcctcccaagtagctgggactacaggcacccgtcaccacgcccggctaattttttgtatttttagtagagatggggtttcactgtgttagccaggatggtctcgatctcctgacctcatgatctgcctgcgtcggcctccccaaatgctgggattacaggcgtgagccactgcacttggtctttttttttttttttttttacttaatataacttagaggtctatgatttgattacatgtaaatattttatatatttttttcagctttgtagtatacagttatatgggtatacccataaatacgattatgtaccataagcaaattaactagttctgttgttactaatcatgtactatttcaaatagtgctaaggtgaataatctttctgggctattttccaacaccagcaaccaattctcttgattctccagacaccaagtgggtgttcaacaattcagcgtaattcagttctcacagtaaatatctggagctagtgcagaccccacagcttaagggcccattcctacaacactgctttccacttcagacaccatttgtaagtcctgcgccacctgtacttcggaccacctgctataaattgggggttccctcaacctcctcctaaggttagataatttgttaacctggctgacagaactcaggaaaacagtttacttactcttgctggtttattataaaggatacaactcatgatcacctaagtggaagagatgcgtaggaatgtgggaggcagcacagagtttctgtgcgctctctgggttcactaccctccaatcaactcagtgtgttcaaccctggaagctgatcagatctcattgttcaagagtttctatagagcttaatctcctgtctctcccacctcactttctggggtggagtcagtggctagggctgaaattccattgctcttattatttgatctttctggtgaccagctctattccaaggtcatctaggggccccactctaagtcacctcattagcataaactcagatgtgagtgaaacagactcattatgaatgagtgaagagacacctatcactgaggatattccaagggttttaggagcactgtgccaggaactggggacaaaggtcaaatagatttggccctctatatctgtggattcagtcagccttggattgaaaataattcgcatggttgcatctgtactgaacatgtacactttcttccttgtcattattccctaaacaatacagtataagaactatttacatagaatttatactgtgtgaggtattataagtaattttgagatgatttaaagtgtacaggaggatgtatatatacaaatactctacaaatacatttgttatatacaaatactgtaccattttgtataagggacttgagcatttttagattttggtatccttgggggtcctgtaaccaatcccccgtggatactgagggatgactttatatttccttctcttttttttttttttttttttttttgagatggagcctcactttgtcacccaggctggagtgcagtggcatgatcttggctcactgtagcctccacctcccagattcaagcagttctcttacctcagcctccccagtagctgggactagaggtgcaagccaccatgcctggctagtttttgtatttttagtagagacggttttgctgtgttggccaggctggtcttgaactcctgacctcagatgatccacctgcctcagcctcccaaagttctgggattacaggcatgagccactgcacctggcttaactttatatttcttattatgccacattctttgtagtatggaagtaatttcacttacatgcaagtatatgtaagatacatttctagaaatggaattcttgtatcaaaggctatgtacatttgtaatttggattttttaaaccagttttcccaccatagagattgtaccaacttattcatgtcacaaatgtgtgaagtgactgtatgtttccccatacaactttatgttacaaatttttattaagtaatttaaaaaacaaggttcttatagtactctgcaaaacatgtatatgtaaaaaaaaagacgtaatactttgttgtaattgtcaaaaaaattaagtagaaattctattatgttcacaattataaaagacttgatatacttttaacagagttgagtaatgttagctaatttgttgccattttatcatatatctccaatgtgccaggtactgttatgactttatatacgttataaaatctctaatatttaaagtaattttacaaggtgtatagaatttatattacctttatttcacagacaggaacctgagctagtaaattctaggcttaagatttgattccaattcgattctaaactctagatttttgtcatatctttaattaattttactttagtattttgatctttcccttttttgtgtagaggactaaaattcctctgatttcagccattatcctggtctttcggcattcccaaattgaattaaggaagatttctataatttgcaagaattagaagccccagggtaaaacaaagagcatacacacttgtctttctgagaagagatgttaaataccccatatagatgctgctttcttctgtattttcttatttaacttgtagaaagtaagggagaatagcaaaatagcagaattactagagagagaagacaggcagtggtagataatagtaattgggtcaggaagcctgttttaatctccaagtaacttatttgctgtttgaatatcttgttttaccatgtaagaatcagtctataggcatttatttttaacatcctagacagttactgtttaattttatctcatttagagtcctaccacagctactaagttgacttttagagcagaatatgtctttaaaaatcttggtcagcgtatttcacaaatagacaaatttcataacagtccacattttgtagactttttaaaataaaaaataattgtttaaaatttggatctttttaatttcagttgttcccccttcccatcccattttacagacatttcaacctacgaatgaagagggacacttcccttttcagtgatgaatttaaagtagaaacatcaaataaagtacttgattatgatacctctcatatttacactggacatatttatggtaagttggaccttaacagaacccttttcttccatttttttttttctacacaaagatactcattttgaagtgtaagcaaatatttcagaaaaggttataaatccagaggaggttgaattcatatgaagggtaatggtctttgagaaatgaagtaatgtttggacctatctttacatgtatgtttaatagtgaattatgaaatatctggcttctgaaaggggtgaaattttgactcagtacctctaaactgttagagttttcaaaagttttaacgacttctgtaattttctgattttccaagtaagaaattaatagtaactttgctgtgttttataagaaaacaggaaaagtctaaaaggaaacagtaaagatgatcttagccaaaaataatgtgacagagtcatctgtaggaaaatcctcccaaggcccttcttcctcagaatctatttgctttattcacaattctaacaaatttctcttgctgcatcaaattgaaaatgcatgttggggggcatcagtggcacacttaacccaatagaaagttacatctactagtagtgttgaaagaacagaacaactatagaagtcataaaaaagcttaaaaaatgaaaatcttctgggggtgttggagagaggcaaaatgtcattgttttataactgtacattagtaagtactcaagatgattctcacttaagacagtgttaaactgtttgagattatttctacacgagtgatttctactgaaaatagtaacatgaaaaattaaatgcttaaagaattttttctcatttttcgattgtgccagataaatgaggcatttctatacttaaactttctcatttgtagaataaacctaatcattaaattctttagcttttttgtactcttacaattctgtaaccaaaatgaagcgtttttcatcagtagattttcaatgtcagactttagtgttatattgtcttcttgattatttatctttctgggcaaataacttagtagttcctgccctttttcgctaggtgatgagatcaagaaaagtccgaggccgtaaatgagattgcagataaaaatcatgttatttaggccaggcatggtagcagttacacctgtaatcccagtgctttgggaggctgaggcaggaggattgcttgagacctggagtttgagaccagcctgggcagtatagtgagaccttgtctctaaaaaacataaaaatttagttgtggtggcacacctgtagtttcagttagatgggaggctgacgtgggaggattgctgagcccaggaggttgaggctacagtgagttatgattgtgccactgcactatagcctgggggacagagaggggccctgtctatttaagaaaacaaaacaaaacaaaaaactccaaatatcagcgtcttgggctcttacctccagtctatgattaattcagaggcaactaattaatgttattctacaacttagaaattgtggaagtcctgatttttattttaatcagagaatcgtaatgggtaaattcaaggtttaaagccctctccctctactttcaccctttatgtcatttgattttggtgctcaccttttcgttgtgattatattaagaaccaaaagtaccttttttcctattatttcctttcactggagaagtgtaattgatgggatagtattacaaatctttgtccaatatctttaaaagtactgttggtatacttttgttcaaagtgcccatgaaatatttgacactgttctatttaaaaatgtgtttataggctgggcgtggtgactcacgcctgtaatcccagcactttaggaggccgaggcaggtggattgtttgagcccaggagttccagaccagcctaggaaacatagcaagtccctgtctctaccaaaaatacaaaaattagctggaggtggcggtgcacgcttgtagtcccagctactagggaggcggaggtgggaggagtgcctgagcccaggaggttgaggctgcacagagccatgagctcgtcactgcactccagcccgggtgacagagcaagaccttgtctcaaaagcaaaacaaaacaaaacacaaaacaaacccctaagcatagcgcagaagccaaaaggcctggcccatgcacaatatatcggatggaaaaggagcttttttcttgtggtacctgtagcaaaattttcaaaagatgctttggatgtctttattctgaaagtgtgtattttatcagtgggtttgcttgcttcttttaagttaatttaacaattaattgttttgttttgttttgagacaaggtcttgctcttgtcacccaggctggagttcagtggtgccatgtcagctcacagcaacctccgcctccagggttcaagtgattcttctgcctcagcctcctgagtagctggacttacagacatgtgccaccaggcccagctaatgttttctgtgtttttagtagagacagggtttcgctatgttagctaggctggtctcgaactcctggcctcgagtgatctgcccacctcggccccccaaagtgctgggattataggtgtgaaccacactgtgctgggccaatttacaattattgatgactactgcatacatgctaggcactcagctaggtgcaaggaatgtggttggtaacaaggcagatactctatttttcattgctgttattagtaattgtatatattttaactaaatactagttgctgttcacatctcacattctgcttgatatattttatgtgaaaatttccatagtaaatttatattcaagatttaaccatatatatgtgtatatatgtatgcatgtgtgtatatatatacacacatatatacatatatatgaatgaatttaacattcatgtgcaaattaaattgtcaagaatttgttgctttcattaataggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattagtaagtacttaagttttatcaagtagcctttttcaaaaggcatatgatagttaaaactgtgtggagacaaatgaagcattagctgttttctttcctgagttactaatcaggctagaacatagtttttactagcaattgctatttaaggaatagtagatatatgtaatgaggcaatttccttgtcagtccattgccagtactactttgctgatatgacataactaattctgtttgaactgtgtgagtcaaccaaatctgacggaactggaaatcgtatattttgacatcagccagtctgtgtaatgctaatacctttgtgtgtatgacctattgaaggtagaagagcatcattactacttacataaatttcagtgtggatatttgtgtagtgtttaaggaatattttaggtatttttgtaatttttaagtccattgagtatttctttttagaatcttaaggtaatgacttgacttcaagagtccacgtttatcatggattttgttctctaccatctttatatgatgatatttttctaagaatagaaaatgtatttagactttaccttttaattctattgtccgtatatccacagttatccagttattgggaatgcttctttgaagtaccacagaaataaatttctctaatttatatagctcttgaatacccatttattattttttgactgtaattagactagtctctcaatttttgcctgctttcctaacttggcagcttcttcctacatacgttttcctttgtatagacagaaatttattgtcaatgattttattcttacccctagtaatacactgacaagcattaaccattttgactttttgctccatcagctctgacagtttttgtacttcatctgtccaactgcttgttatctctgctgctagattgctatagaaaataacatatgtatactaggtaggatgcatttatgatttttagctacttgttaaatcataagctcattaatgctacttccctgtattttcattcaccactatttgattccttttccagttttaactcctggtatttcaaactctacctttcttttcaagctctaagctatcatcctccttcataagtaggaatatgaattcctttgctttcgtttctttctgctgacaaaattattatttacctggtttgtgtcttgctttgtagctttcttagtaatttaacctttttttgcagggttacctcccctatcagggtatgtaagttcttcaggtatagtttctgtttcttttgctcctgtaatattgcaagtatcatttgtctgtgcagcaggcttttcataaatacttaatgaaatactggaatatttttctagaatgttttatcaaaatcaaagaaaaccttttgaggaatgaaggagaggaaaagcgtaatctgccagattattttttcctttctatcatattgtaattatactttctccattgctttctacttgctatcagtgccctctactgtatttgttctgcctgttttgacttctgttattgtgcctctctcatgttttccttcttctgttatctacttgtgtgtagtttaagaatattcttttttcccacttttctttctttcttgtaatataattgtattttttgcatattgcatccaacagtaatttccaaatatcttaataggtgtcaatctttttttttccccaaagatgatgagttagcttggaggatgaatgacactggatgttacttgattttttgttctttttggcatttaaatgctttatcattgatatcagcttttattttatacttgtttaagtaaatatatgtttgtggtaaggagaactttttaacattctttttattattacatatcagtagtggggttagaatttaaaagcagcaatctttaaggtgattttatttgtagcttctcaggtaattgaaattgtaggatatgaggatgggagtacggaaggagttcccttaaacagagtttttaatgtttgcaaatttagacaattacttgtgaaaaactatctaaaaatctgtcaagtgaaccatggtttaagacaagaaaacattcatgtattagtcttttattctaaatagttgctatatttatattctagaccgtggttcgcaaattctctgcagagggacagagagtaaatatttttggctttgagagctgtatgttttattgcagctactcagctctgccattgtagcacgagaacagccaaagaaacacataaataaataagcatgggtgctttttttaaagaaattattatttatttatctatttttttggagacagagccttgccctgttgcccagtctggagttcagtggtgtgatcatacctcactacagcctcaacctcctgggctcaagtgaacctcctacctcagctctgtgagtagctgggactccaggtataagccactgctcccagctagcatggctgtttttaataaaacttcatagacacttaaatattaatttcatatatatttcatatgacataaaatatcattcttttgattttttctttaaccatttaaaaatgtggaagctacccttagttttcatgtcaaacaaaaacagatgggagggctcactaaatttaataattactttaattggttctttaaattctctgtgtagaatatgacaggttctagaagtagtagtagtagcagcagtagtaagaataattattatggcttaatatatacctgacagtgtataaaaatctttacttgcattattgaattgaattctcaaaataacgttatgagatactggcacacctattattcccactttataggtgaaggcttaaactgaggcttagaaaacttatgtcacttgattgtggacctcctgttctttaccctgtgctcttctgcttcactcatggaagaaagctgtaaattctcactgcctttacttcaaggatttctggggcttttctgaaatctgtaagcctctctaaaatcatacatttgcatctattgctgttttaagccaaactctctccttaatatatttagcagtgtttattttataactaaatggcaaaggatgccctttaatgtgtattattatttttatataattggtttaagtactaataatttattttcagaagtaaagtactgcattattgtatcactgtgaatgttcttaattggatttggtatcgttgtatatgttatccttaccaaaaagaagcaaatggtaggggaggcatactaaccttggatataccttttgatgagaatttggctaccctcttcttaatactgtttttgcaactgaaggcataaatgtatagaaccatcatgaaaaatgatactgctattctccagaaccttggggaatggcttctgagactgtaccagaacacagggatagttttcactgaaaatacttaataatttctctagatgtgatagtgataaatatatattgttatcagcttaaaatgcatacttatttaattctgtacttagtaaaaaacactctctcctaggacatggtagtgtgaacagttaatgacaaggtaagaataccacttagtcctctgccccttagcacagtttattttaaagaaactgagaaaaacattgttccataaactagaatagtattgttattaacatgaacaggttttaggaatatctgactatatgactgcttgcaataattcccttacaccttttttgtgtactacctatccaagagctaaaggtctgagtaatttttttattctatacttatagagaaatacttaatctccaaattaaaaaatatattttaattgtatatgaagagctgcagaataatttatttgggtttattgctttcatttcaaatttattatttattttcctttgtggggtatagaaaagcccagagaggttgaatttgcctatacctccgtcgcccaggctggagtgcagtggtgccatctcagctcactgcaacctccgccttctgggttcaggtgattctcctgcctcagcctcctgtgaatagctgggactacaggcatgtgccatcacgcccagctaatttttgtatttttagtagagacggggtttcaccatgttggccaggatggtctcgatctcttgatctcttgacctcgtgatccgcccgcctcggcctcccaaagtgttgggattacaggcgtgagccactgtgcccggcctgaatttgtctataccttatagtagtagggcacccctactttagaatgtgtgttagccatacctatacttatttcttctttctcttgtgcttcaatgggaagacctcctatttcttgttctgaaaaattaagattgttaaactttattttaccatttcaagatggaggcctcttcattcatgtagaagcttcctcatttgtggaaatgtcaggatgttgcatctaaaacttttaaaatgtcaattagttccatattgtgtttttgaagttgttttctgtcactgttagtgacagggagagacaaaaggaaggaatacaagagggaagaataattgaattggtaagtattgataatagctagcattgtttgtatcattcacatataacaggaaaactgttttagaaagcattctggctatacttaggtccagtctggagattggaaatctgcataagcatattgagttgtgacaaactatgtagccaactggaaaagttgagatgtggagtgctctgattgtttgacttctgaactcccacagtgcatacaagtgtattggttaatctctctactatatgttttgaatttgtatgctttactaagcattgatgttagatactgaacttatttaagcacagtgatagtatttgaaagaaatataaaaatttagtggtattgttgactctgtcttttccttttttctgagttaatctcttgggaagtataaattaatttttctaaacaactcacaggcacagaagccgaaaagttgagaaggccacagatatgggagttattttaagaataatatttaattagaaatgtaggatactaaattggaaagttaaaaaaaaatcacaaaaaaagaggcagtggctgggtatggtggctcacgcctgtaatcccagcactttgggaggctgaggcaggcggatcacgaggtcaggagatcaagaccatcctggctaaacagtgaaaccccgtctctactaaaaatacaaaaagttagccgggcgtggtggcaggcgcctgtagtcccagctactcgagaggctgaggcaggagaatggcgtgaacccgggagtcggagcttgcagtgagccgagatcatgccactgcactccagcctgggcgacagagtgagactctgtctcagaaaaaaaaaaagagagagaaagagacagtgaggggcttaattctttttagcagaatctggaaaaaatatgcttagacttttcatattatgcatattatgcatttcatattacgtaacgttatataaataggataacagttgaaaattttagatcaagttcttttctgattagttatatatatgtatgtatatgtatacatgtatattcatatatatttatcttaaaacatcaatataaaatattttagctataatgaaatacaatgaattatttcagaaatataagatttttaaaataaaaaattgttattagaagcatttacagtgtcaaaaaaacagctgcagcttttttttttttttttggcaattacagagtggtattcagttaagagtaatacttattttgtataagctgcatcagagagaaatgaaggtgaaaaactaccatctccatatataactcatttgtgctgtgcaccaataagaacctgctttagattttcatgctggcttacagctctcatactgtttcaggcaaagttagtggttattgaaaataccaccaggatgggctgtctgtccgtctgtctgtccttccatccatctgtatttttttttctttatgctctctcatcaactgactgtcaaggatgggctatctagagacacatttgatagtgtggttaactgttagtgtgttaactgtacagtttaaaaacaaagccttacctttaaaggtttttctttaaaaggagtgagttgtgtacaggggtgctaaataatttataaacaaggacaaacactgcactagaaccaacttattcattatgatcatcttcatctttcttctcttcctcatcctcttcatcttcctccttttccttcttattttcaacttcctcaccttcctcttctttttttttcagcattgacatctcccttttttttttttttttttttttttgctgcatgaggccttcctttagctcagtatgcagcaatatccatttcttagtttttcttcagcttcacagccttttcataaggctgcttgtcatatgcaccatatccacatctttcccagtttctttgaaacatcacgaatggataggtttggatattctccttagatttttgggcagtactcagggcaaaatgaaaagactgaaggagccctcttgggtacattgggatccctaaacttttttgtttcttctttaggagggatgtaagtttctctttaatagccatccttgtccccctttgccatgtcttcagattttcctttctctttagcagatacggctttccacctctctgagcattttttagaaaattccgagaagttaactgaagcatgagtgctgcttcttgttctcctcctggaagtttgcacaaagaatgcatatgatgaccttttgcctcttggcttcttaggatcttcttttaccaagtttagttatttttcctcagagaagcacagagtcacctagtgcacatctggctgccatttgccccagcactgtctccatggaggtcaatgtactgtaatggctatcagaaatacatgattatatgaaaataaaaaaagctttcatgttgtaaagcaactttgaaagtcaccctaacaagtaaaattatatttgaaatttttgttttttcttttgagaactatcttctcatgattttgttttacaaataaattgagtaaggaattttataattttagtattgtaaaaggcactagattcaacactctaaagatgacggaaactgaagtctagagttataaaacttgtgcagtatgacatggatccatgtcttttggctgccactccagtgctttatttctgttacattctgagttaggagagtttaaaggctgctaaaaggccaagaacttaatgacaatagagacaatgacagtaaggattaaaaaaaaaaagttatttttggtatcattgattttgaaggtgagccatatttactactgaaaaagcaaatttatattttaggctcactttaaaaaatatatatatttattaatagagacgaggtctcactgtgttgccaggctggtctcgagctcttgagctcaagtcatcctcctgccgcggactcctaaagtgctaagatgacaggtgtgagccaccatgcctggccaaggctcaactcttataagtgatgagttacagaaaaactagaagaaatagcatttaggagtatgtgtgcgtgtatgtcctagagatactcggagctaaacctcagcctttcacatctctgatagcataattcatagatttatgtttgtaccagtgaccttataagagtgcctgaggacattggtccaggactctggccctctaaaaagctgcttctaaagaggcattgtgagatctggtttattaaagacatgttatattctgttcatgatttataaattgggggattagataatctccataagcagtcttgctatcttgtatttatatttgaacataaaagtctagaatttatagatgtggattttactggttttagcttctagagacttcttagaatcattttttataggcaagcttgtagatctactagttaaaactgttttttggtttaatttgtttgctcaagatcatacaagttagtggtcttggtacatggtagggagaaggcacaagaggtaatatgtcaaagaactgaggcatggcatatatatgaaaagagttagaaatgaaatcaaggtgatatgttagaatagctttataaccttatacaggtaatgtactttttcttggtctcattttcttcaggtataaaatgagggtgttagatcatggtgctaatatctcttatctcttctaaaagttaatggttctaaactacttttcctttaaagttggaaatatcttgattgatcatggctgacaaataaaaagtaaaaataaaaatatttttgtgctgattgggaaatgactatataaaatggctattcttgtatgtaaattaagtatttttcttaagtaaattaagtattcttgtatgtaaattaagtatattaagatgaaatgtgtccaccaccattaacatttttatgaatagcccttcagatctcatataccattttaaatttcatgtacagttatatcttagatctctttctgtgtcaataaacatagctctacatttttcctttaaatggctacataaaattctgctgtttccttgataaatgtattatttaccagcctgccaactaatggatgtatagattgtttcctcttttttactgttaaaaattgcaacaggtaacattcttgcacatattttctcccctcaatatttttatggttatttccttaagattaatttcctagaagtagcattgtcagacatttgcattttgatacatattgccagatatctctttaaaaaggttacacagatttatactcttacacctataaattaaatattgacttaataataccttcatgtatagtctgtggacacacttccccaattacttcacaaaaatgtctcctatttttttttttttaatacaggatttaatcagggtctacacattgcctttgagtgtcacatctctgtagtcagtattactcttttaacagcttaattgaggaaaaattgatagcaataaactgcttatatataaagtttataatattgataacttttgacatatgtttatgtctgtgaaactatcatagcatttaagataataaacatgcccatcacccccaaaagctttcagtgtaattcttctctcctctactccccgctaccctcttgcactaatctctaggttagtttgcactttctgaaatgttatataagcacaattatacattatgtactctttaagaaagtctggctttaactcagcataaatagtttgggattcgtccatgttgtatgtattaaaagttaataactttttgttgataaatagtagtctgttgtgtggataccatgatttgttaatacatttgcctgttaatggacattttggttgggttattacagacaaaattaaggtttttaatattaactcatcaagtattggtcgattaaagagaagataaattttgaagaggcaaggggatgaaataactactaaggaccaaaaaatcttgctctgttgcctgagctctagagagggggcatttggaaacaagacaagcaaaatacccaaagaattttaatttaagctagtagcatatacagcatgtacattctctctcctccaagctgataatacaacttaggtgtaatctcctagaattttttcctgacctcacagttctgggtatcctctctttactgctgtttatgtgttgataagtcttccctatcttttgaatccagtggtttactggtcattgatcatatgactgacctttgagaggcatggaaggaaaccagctgttgactggatgagtaaattaaattcaaccagtgtttaataaactgtggatgattgccgggagaccttaacacttgggaagttggtacttaaatgcctgcttgtttacatgtcagacacctcagctagactgacagctcttgagagtgcatgttctatgtcatttatttttgtatccctttgtttggtatataataatttttcttaattgtttgcttaataaattaatgcagttaaaaataacattgacatatgattaggagatttatgtgtacacagctgttaattttgaatgttctgtatgttatagtcaatctgtaaagcagttaggaatttagaacacactttgccgtagaaacaatttaaagtgttagacaattcctctttattgtaggtggaatgaaggctaaaaggaggttatgggagccagcagtttataggtctttggttaatggatgacctttgaaaagaggcatagaaaccacatactggctgaaaaattaaattcaacaagtatttattggtttgtgaatatacaggaaagagaattttaaaatttcccctgaagattaaaaaccttcaggggaattttcagtaatagagagtcaaaatgtggtaaatgctataacaaaaatgttatcaaagccctggggtagtgcatactacctcagtgagggagctttagggagatttaggaagacttccctggggaggtggaatttgacttgaaccttgaagataaggggtagacttttgattgctagaggagagaatctgtgatcacaggagaagcctcagccctattactctggctgcaacaatatttcttttcagttgtcacagcttgggaactaaagaaaggaaaagagattcgcatgttctttggcctagtcacccattcacccctgtgtatagctgtatagtcccaagtcaaatacacgtaaataatggtcacttaaagttagtatgttacaagttttcattccaagtgtcagttgtaagttttacaggtttaacaactgattaatttgttaataaacattttttgagtgcctaatctgtacaagacacttttagaaactatccatacaataatgaatagggcaaaggttctgccttaaacactttagagtctagtaattctgtttgtcattgatcagaataataaagcaacatttctctggttgacctgactcccattatcctttggctgccaatagtaaccctttctttctaaaacccatggggtgagaagggacatgtctggccctcttcctcatctctgtttccagagagatcagtgttgtgagtgcttgtggaaagtggggtcattttcaacttcctcctctttctagggacaatcactctgtgcttttcttatgcccacttaccctcccaaaacagaaattagacatggggattgggaagacatgagaattggtacccgggagaaacggcctcccatccactggaattaggaggaagaacatttggagttctttcctgtctccaaacttttcatttcttctcaaaagaaaaaaaaaaaagcctatcctttcttctactctccatcagtgaatccttgttgatgtaggcaactttgggaataaatgacgattttcatggacaaggcccccacctcatgatactctggatactaacaaaaataatttttatgcataataatattattctatagaagtcattctattttaaattcaattaatgcagatttttaaaaattggctttggtgattcatggcatattattggagggattaccatccagttttgactattagagggtcatctcatagccaaggccttggatgtttgcagttaagtttctgagctgctagtcacataaggctgaggggtaccctgctggaggtagtgagggtgcaaaaagtgagtattttatgcctagttctgttgacagagaatctgaactgtaaatattcctccttgaaagagtggatgattgagagttaactagagctatttcctgcttgagttagagtcacaatatatgtactatttatatttgtgtcttgaacaacaaaacaaaagcaagaggctggcagaggaactggaagaaaggcaatagatctaaagctgatctttgttttaaataggccgaatattctacacccatgactcattgtttgtgaaagaatatgctgtttggccttttcaggggaactacagtgcatcctatgatttagcatctcaatgagggcttattcattagttgaacaaaggctttttctagaaatgaggattatattgttagtaattttagagggaaaatgtcattgtccatttttatagttaatgtggtgtccaaggaaaacagcatcttttagaaattttgaaagtatatgggaaaaattgcatgcttgaccctttctattgggagagttttgtgctgacagaatttgaagcatatataaatactgttttgttgctttggaaatatttggaaattttttttaccctaagtttcaagctttcaaaaggaatttatatttttaattcgtgatatataaaattcagtttgcgaagaaataaaacactaattcttttaaaatcccaatgttttaagtaacaatgtactaaataaatgtttttttttgttcccctatacattaataaccaatggtaagtgagttttagggttttgacgaaagattttaaaggtcacagaacagttgtaattttttccccattgattattaagatcattttgcatagtttcagcttgcatggtcagttttatgactggcacttactggtgtggcaaagcaaggactgcctggtgttaactaggtgaatgaaattgagaatagactctggaaattcagttgctagctggcattaaggaactgcttgaggttatagatcatgacttttgaatgagactggaattactagtttttctttagcctcattcagcttcaggaggagcttctctctttcatagttacacttctgaagtaagtaagacaccactgcattcaccatcaactcccttcaggggcgttggggtggagcacaagggagttgatggtgaatgcagtggtgtaattataataataattgactgtgggatttaaactgaataaggaagagaaagaatatctggtgatagacaataaggtggtagcattggtggattaaagggtctcactgatgttaaagggttgatggaacctagagggaatgtgctgaaaagataagtggtggaaagaaagtagaatactagaagttgagattatgaagtgctttcagttatcaatagtgacaagttcagaagagtaactatggaaatgagaaactgaggtaggaaaaaatcattggagaaaagaactgagtgtagtggaaggatcatcgtcatgaatgatgaatgatgatgaatgaatgatgaatgatgtcatcagtcatgatgatgaggtggtgtcagagagactgacagtaagtcaggatctaaaaataaggaaataagggcagtaatgacttgggtgacaacaaatgcctgtaataagttggggtagtcagtgatacagtcacgtaactgtaaaactgagctactatgagaatagtcttaatggtcctaagggagaaagtggtagatagttgtgttttgtgaaatgaggggtggggagtatcttcccaagagtaggaagagttttggggttctcttttatatttgctagagtcctcctgatggagctcaggaatactgcagaaggattctcttgacccctgccagatgatggtccagaaacatagatattctcttggtgacagccgaatgcaatatattggtgatagggtcagaataatgagtggttattgcccttttttagaattcacaaatcatctatatgacaaaaagctaaagaccagtggtttttattgagggagagcttaggaacctgctaggttttagcattaaaatgcctagcataatgccttttccataggtgcttaataagcatttatggttttcattagttaagacagttaaatttttacttgtaattctcatttataattggttatacctaaatgtgtgatagtaatgacgtttcttctttgtattttagactatccccataaatacggtcctcaggggggctgtgcagatcattcagtatttgaaagaatgaggaaataccagatgactggtgtagaggaagtaacacaggtaaggattttaacactagcttgcatttaggaaatggaaatgaatttgaggatgtatatctacatttaaaatatatgttctaggatttctgaaagacttaacaccactgtggggaatgttttttaatgctcaaagaggccaggtaacgtgccaataataaagagataggactgaggtttgaatacaaatatatgtgacccaaaagacattacaagtctaaaatatactatcctttacatgttttgttataaaagaaaacaaatgttttatataaatgtaaatatttttattagcattaaaattagagtgaccacttgccttggtttgccaaggtattcctcatttttaacactgaacgttgtgtgtcagcagacaatctggttggtcatgttaataaaaatctcaggacttttcgtattttaattatttttttcccttcctttttctttagtcataggtgacaggttatagttattcaaaacataagttcaaaatgagaaaacattttttcttttatgataaaacatttatcatatattttggacatcctttctaaaagtagtatggtagagttatgtttcttgagccatgaatatttgtattcagatctattctttgatctgtaaaatggcataaacaattctgtttcaggtgggtctttctagtgttaagtgagattttattcttatatgtattgaagaagtacatattgatcttctgccatatgtcagagactgtggaaagttctgggaatatgtggagattaagatgaaggctattctcaaaaggttatcgtttaattggagacacagagaaacaatttagagtagtaggagagggttaagtataggatgatattctacacacaagaggaatagctaatctagccttataagtatttgaaggcaataatcagaccttaagaataagtaggagttaggttagccatgaggatatggaaagactattccaagcaggaggaacagtacatacaaaggccaaggagacagaaagatcagtaaagaatttttaacatgagggtagagtttaagagtagattttaggagactaatgagaagttgttgtagttattcagttgagaagtgatagtggcctgtactaatgtattggcaatttggatagaggggttgagattatagactgttagatatgatagaatttagcatggtgcttgataaaatattaatatacaaaagtaggttgcatttatttataccacgagtagactaccagaaatataatgaaagggtggacattgttaataatgtcagagaatattatatattatagaataaatgtaacaaagaattataagacctatgtaaggaaaatcaaaactttataaaaatattaaggaagattgattttaaatgaatggagagatataccatattaatgggaaataataatattataaaattatcagttctccctttattgatttgtagattcaatggtagtccaatacacattacaacaggcttattcacaacactcaatgggtcaaaaatgttatatggaaaagtaaggactaagaagaagtagggcccatttaaagacgatgaacaggaaagagggaaagagggatttaccctaggaggtattaagacttgctataataattgagagtgtgatagcacaaggatggacaaattaactagcggaataaaaatgagtgcttagaaaaagacccatgcgtatatgaaactttgttatgtggtagagatgcaatctcaaattagtaaggaaaagtgaggaccattgaataaatggatccagaaaaaaatgtttatctatttgaaaaaagatgaagttggatcaccatcctacaacaataaagtccaggctgtaaatgaagtccatatttacaacaaaaaagtctagatggattgaagttttaaatgtctaaaatgaaaactttgaaacttgtagatttccctttcaagctgtgatagagtaactgatatctaactaggctttctacaacaaacaactagaaaaccaaacaaaatatttcaaacaattattttcaaacattagaaaacaagcattgcaggattgatatctgagtgaggaaataaatatctctgtgatttccctgccttcttggctggagtcgaaatttcagatatgacacacagaaggagatctcaagaaggataaaaacacagcagtgttgctgagttgaagagttagaattaagagttcaggaagactgaggtgtctggacttacgggcacaatacctgagaggagagagctgtgttgagaaaaagctccagatatctgcacaggtgttgctttccttgagtcttagctgaatactaagctgtgcctgcctgcacgggatgaaattctttgagaaaaccatgagacaaagaaaaactacctggactctgtgaaatgaacaactgtcaaaaacaatacttgggccaggtgtggtggttcatgcctgtgaatcccagcactttagaaggctgaggcagcaggaccacttgaggccaggagtgcgagaccagcctgggcaaactagccagatctcatctccataatagtaataattattattatttttaattagctgggtgtggtgatgagcatctgtagtctcagctactctggaggctgagacgagaggatttcttgagcccaggtggttgaggctgctgtgatccatgattgtgccatggcaccccagcccgggcagcagcgcgagaccctgtctctaaaaaaattacacttattagatatcccaagccgtggtagtagcagggctaacctagccctagagtagaagctacttcagacctgcccttcctaagcagaaaaacaaacctcaaaaatgtcaaactgcttttcaaataaattagctgtctgtcagagaaaagctcaataatatttgttaaaggaggacactaagtccagttactcagcagtataacattcagtgttcagcattcaaagaacattactagatgacaagaaactgaaaaacgtgattcataataaggagaaaagccacctaaatagaaacacaacgtctgttaattacagatgttaacaggcaaggactttaaaacaactattattagtatgttcaaagaattaaagacatgaacacaaaaaggagagaatggaaattctaataaagaaccaaatggaacttctagggtgaaaaatatattatctgaggtaaaaaatttagtggataggcttaaaagaaaattaattactgcagaactcaatatgaatatacttgagtaaaggaaaataaaatagacagtatccatatctaagcacagagggaaaataattgacgtccagcaggaagagatgcagaaaaaaatatttaaaaattaatgcctccgaatttttagatactaggaaaaatttcaattcatggtccaagaaactcaatgaaacacgtgcaggataaacacaaagaaaaccataccagggtatgttacaattaaattattggaaacacctgaaaatcataaaaaaccataaaagcaggcagagaaaaggagatacatttacatacaggggaacaaagataagtataactggtgacttctcattacacagtacaaactggaagacatagaataacatcttcaaagtgttgacagaaaacctgccaaactaggattctatattcagtgaaaataattttcaaaaacaaggcaaattaaagatctttttaaataaaaattgagagaatttgtgtctaggtgacctacactgtaagaaacattaaaggaagttcttcaggcagaaaaagataccagatggaaactcggatacacacagaagagtgaagaacataaaatagtaactatatagataaatattaagcagttttttctcatttaaaaaaaccttcaagagattattacctaagtccaaataataaggtataatggattttgtaatatacagagaatcaaaatttatgacagtagtgcaaaggacaagagaaagaagaatagaagtatgtttcttaaacaatttgtgaagtgatgtaattttgacaggtaaactgtgccgtgataaagatggatattgtaaaccgtagagccggggtcagcaaactacggcctgtgggccagatgtttgcttttgtaagtaaagttttattagaacacagccacacctattcattgataggttgtctatggctgcttttacattatagtggcagaattgaagagttgtgatagagaacaactacatgttgttcaaaagtgtaaatgtttactattaggccttttcagaaaaagtttgcaggaatttcctctgcccttggagcaaccattgaaaaaagaagaggaaataatttaacatgttaataaaataaatcaaatgtatttaaaaacagttaagagaagttaggaagaagagaaaaaggaacaaaaaactgatgggataaatagaaaataaatagcaaggtggtaagtttaaatctaaccatattgatgactgcattaaatataaatggactgctgaggtgtgaagattgcttgaggccaagagttcaagaccaacctggccaacacagcgagaccctgtctcaattttttttaattaaaaaaatataaatggactaagcacgttaattaagaaactgagatggttagagtgattaaaaaaaaaagaccaaatgagcgtaaaagaaatgcaatttaaatgaaaagacacagttttaacatttaaagagctaggtgagatggttcactcttgtaggcccagcttgtcaggatgctgaagtaggaggattacttgaatgtagaaggttgagactgcagtgagccatgattgattgcaccagtgtactccagcccaggctgcagagtgagaccctatttaaaaaaaaataaaaagaaaaaaaagaaaagaaaatagctaattgttttggatttgggtcataaaatgatggaacagaaattgggtttagttaattatgctatgaattaatttatggatccatattctcagagtttatccttaaagacagtcttaaagtccttaagaaaataaagagagaacggccaggcgtattggctcacacctgtaatcccagcactttgggaggccgaggcaggcggatcacaagatcaggagatcgagaccttcctaacacagtgaaaccctgtctctactaaaaatccacaaccaaagttagctgggtgtggtggcggacgcctgtagtcccagctactggggaggctgaggcgggagaatggcatgaatccaggaggcggagcttgcagtgagccgagattgcaccactgcactccagcctgggcgacagagtgagactctgtctcaaaaaaagaaagagaaaacttcataacacattttatgagggcagtgttactttgatagtcataccagagacattacaagaaaactaagctacagggcaatattcctcagaaatataaaagtaaaatttcttaaaatattagcaagtgaaatccagcaatatatataaaaaaacacattatgctcaaatgaagtttataccagaaatgcaaaattgattaacattagaaaatttgtgtaatccaccacataaacataataaaggatgaaacccctctgattatctcagtagactagtaaaaaagcattgccaaatttcagcactcaacacatggcaaactaaaaatagaaggaagctttcttaggctagtaagagctttttataaaaaacctacagctgataccatgcttaaaagtgagagactaagtccttttcctttgagaccaggaataaaagctttttttttttcttttttgagacggattctcgctctgtctcccaggctggagtgcagtggtgtgatctcggcccactgcaacctccacctcccgggttcaagtgattctcctgcctcagcttcctgagtagctgggattacaggtgcgcaccaccacgcccacctaatttttgtatttttagtaaagatggggtttcaccatgttggtcaggctggtcttgaacttttgaactcatgatctgcctgcttcggcttcccaaagtgccgagattacaggtgtgagcccactgcgcccagccaaggaataaaaacttctactcagcattatacacaaagtcctagccaccataataaggcaagaaaaataaatgaaaggcatacagattataaaggaagtagttaaaggtaatacaagagtatacctagaaaaagttactagaatcaataagcagacttatcaaggacataggctaaaagttggtataatcagtcgtattctatatactggcaatgaatatttagaaaatgaaaaaaattaaaatagcatcaaaatataaaatatgtagaataaatttaacaaaatatgtgcaagatgtgtacatgaagaactagaaaacattgccaagaaaaattaaagattaaataaattgagaaataaactttgtttgtggttggaatcctcaatgttaatatgtcagttctccccaaattgttctgcagattcagtgcagtcagtatcaagacttccagtggacatttatctagtagttgacaaactgattctaaaagttatactgaaaggtaaaagatctagaatagacaaaacaattttcaaaaaagaacaaggatggaagatttaatagtatttggtttttaagacttagtataaagttacagtaatcaagatagtgtcatcttgacctaagggtaaacatgtaggtaaatgtagcaacatagagagtccacatggtcagttgatttttgcaaaagtcccaaggtaatttaaaagaggaaagaacagtcttttcaacaaatggtactggaacaattggatatccatatgaaaaaaaaattgagattcacctgtacttcacaccttatacaaaaattaactcaaaatggaaaatggacctatatgccaaagctaaaactaaaactaggaaaaaacataggagaaatttttgtgacttgtgataacaatttctcaaggcacaaaaattccctatgaaaaacatgtataaactgacttcatcaaattgaaaaaccttgcctcaaaaaacatagttaagaaaaataggaaaacaagccacagactgagaaaatgtccacaatgtctctgataaaaggcttttttccagaatagtaaagaactgttataactcagttaagaaaaaaaaaaaaacacaaaccccaattaaaaaatggacagtgcacctggaaagcctttccaagaaggacaggcacaaataagcccagactgtgaggactacagtgaatacgtaactcttcaatgcccagacgtgaaccaacatccacaagcgtccagaccatccaggaaaacatgacttcaccaaagaaactaaataaggcactggggacaaatcctggagaatggatccagagataggtgacctttcagatagagaattaaaaatagctgttttgaggaaactcaaagaaattcatgataacacagagaaggaattcggaatactatcagataaatttaaaaaacattgaaataattaaaaagaatcaagcagaaattctagagttgaaaaatgcacttgacatactgaagagtgcatcagagtctcttagtaacagaattgataaaacagaagaattagtgagcttgaagacaggctatttgaaaatgtaaagtcagaggagacagaaaaggaatactctaaaagaatgaagaacacctataatatctaggaaatagcctcaaaagggcaaacataagaattatgtccttaaagaggaggtagagaaagagataggggtaaaaagtttattcaaagtgataataccagagaacttctcaaacctagaaaaagatatcaacattcaagtgtaagaaggttatgaagcaccaagcgtatttaacccaatgaagactaactcaaggcatttaataatcaaaccagcaaaggccataaagaaaagatcctaaaagcagcaagaaaaaagaaacaaataacctacaatggagctctgataaatttggcagaagacttttcaatagaaattttacaggccaggagagagtggcatgacatgtttaaagtgctgaaggaaaaaattttttatcctatagcagtatattcagggaaatagccttcaaacacgaaggagaaataaaaactttcccagagaaacaaaaacagatggatttcatcaacaccagacttgtcctacaagaagtgctaaatagagttcttcagtcagaaagaaaaggatgtgaatgagcaataagaaattatatgatggtacaaaactcattggtaataataagtacacagaatattgtgtatctgtgattatggtatataaattactcatatcttgagtagaaagactaaatgatgaactgataaaaaataactcttcaggatatagacactacaataaggcatgaatagaaacaaagttaaaaagcagggggacaaagttaaagtgtaaagtttttattagtcttctttttgcttctataattatgcaatcactgttgtcatcagtttaaaataaggattgtaaggtagtatttgcaagcctcatggtaacttcaaatcaaaaaacatatgatagatacacaaaaaataaaaagcaagaaattaaatcataccaccggagaaaatcagcttcactagagggaagtcaggaaggaaagaaggaagagaaggccgcaaaacaaccagaaaacaaaaaaacaaagtggcaggagtaagtccttacttatcagtaataacattgaatgtcagtggaccaaagtctctaatcaaaagacatagagtagctaaatggattaaaaaaccccgaagatccaatgatctattgcatacaagaaacacattttacctgtaaagatacacatagactgaaaataaaatggtggaaaaagatattccatcccagcggaaaccagaagagcaggagtagctatacttgtatcagtcaaaatagatttcaggacaaaaactgtaagagacaaagatagtcactatataattataaagggggctgggcctggcagctcacgcctgtaatctcagcagtttgggaggctgaggtgggtggatcacctgaggccaggagtttaagaccagcctggccaacatggcgaaatcctgtctctattaaaaatagaaaaattagctgggtgtggtggtgggcatctgtaatcccagctactcaggaggctgaggcaggagaatcacttgaacccaggaggtggaggttgcagtgagctgagatccggccactgcactccagtctgggtgaccaaaccaagactctgttttcaaaaaaaaaaaaaaaaaaaaaggaatatatatatatatatatatatatatatactatatatatatatactatatataatatatatatgtatgtatggtatgtatgtaggtatgcaaagggttctgttcagcaaggaggattaaacagctgtaaatatatattaaaaatggttggatatttgtctcaggcccaaactttttggtgaattgtaatcctcagtgctggaggtggaactgggggggagttgtttggatcatgggggcagatccccccatggctgggtgctgtttttgtgatagtgagttctcatgagattgggtggtttagaagtgtgtggcatcttcccccacagacattcttgcttggctcctgcttccaggcatgtcatgtgcctgctcccccttcactttctgcccatgcttataagcttcctgagacctctctagaagccaagcggatgccagcaccatgcttcctgtaaagcctgcagaacgatgagccaattaaaactcttttcttgataaattactcagtctcagttatttctttataacaacgcaaaaatggcctaatacgtatatgcacccaacactggaacacccagatatataaagcaaatattattagagctaaagagagagagatagacttcaatacagtaatagctggagacttcaataccccactttcagcaatggatagaccttccagacagaaaatcaacaaagaaacatcagacttaatctgcagtatagaacaaatggacctaacaggtatttatagaccatttcttccaatggctgcagaatacacatttttttctcctcagcacctggatcattctcaagaatagaccatatgtttggttgtaaaacaagtcttcaaacattcaaaaaattgaaataatatcaggtatcttctctgactacacttgaataaaactagaaatcaataacaaaaggagtctttgaaactatacaatcacatggaaagtaaacaatatgctcctgaatgaccgataggtgagtgaaaaaattaaaaagaaaattggaaaatttcttgaaacaaacgataatggaaacacaacttactggctaggagtggtggctcatgtctgtaattccagcactttaggaagctgatgtggaatgatcatttgagcccaggagtttgagaccagcctggggtctatagtaagaccttttctttgcaaacagtttaaaaattagccaggtgtggtggtgcatgcctgtagtcccaggtccttgggaggctgaggcaggaggattgcttgaacccaggaggaggaggttgtggtgagaaagattgtgccactttactgcagcctgggcaacagaaggagacgctgtctcaaaaacaaagaaaacacaacataacacaacgcgtaggatacagtaaaagcagtactaagaggaaagtttatatagctataaatgcctgcatccagaaagaaaacttcaaataaatgcactaacaatgcattttgcaagagcaaaccaaacccgaaattagtagaagaaaagaaataataataaagataagagcagaagtaaatgaaatagaaatgaagacagtataaaagatcaaagaaacaaaaagttgttttttgaaatcgtaaacaaaattgacaaacctttagccagactaagaaaaaaaaaagacctaaataaataaaatcagagatgaaaaaggagacatcacaagtggtatagatgaaattcaaaggatcattagtgggtactttgagcaactatatgccaataaattgcaaaatgtagagaaaatggatacattcttagacacatacaacctaccaagattgaaccatgatgttcaaaacctgaacagaccaataacaagtaatgaaattgaagctgtaataaaaagtcttccagtaaagaaaagtctgggacccagtggcttcactgttgaattctaccaaatatttacaatataactaataccaattgtactgaaactattccaaaaaatagaggaggagggaaaacttcaaactcattctaggaggccagtattactctgataccaaaagcagataaaggcagcaaaaaaagaaaatgacaggccattatgtctcatgcatattggtagaaaaattatcaacaaaatactagcaaactgaatttagcaattcattaaaaagatcattcatcatgactaagtggtatttatcccagggatgcaagaatggttcaacgtatgcaaatcagtcagtgtgatacatcataatggaatgaaggacaaaacttatacgataatttcaattgatgctgaaaaagcagttgataaaattcaaaatcctttcctgataaaaatgctcaaaaaattgcgtatagaaggtacgtatctcaacataataaaagtaatgtacagtgaatccatagctagtatcatactgaatgggcaaaacctgaaagccttttttctaagattgggaacacaagaaggatgccttctttcagcactgttactcaacatagtactggaggtcctagctagagcaatcagagaagtgagagaaataaagtgcacccaaattggaaacaaagaagtcaaaatatccttgtttgcagatgatataatcttatatttggaaaaacccatagactccaccaaaaaactattagaactgataaacaaatacagtaaagttgcaggatacaaaatcaacgtacaaaaatcagtagcatttctactgttgtttccagcaacaaacagtctgaaaaagagaagcaatcccatttgcagtagccacaaataaaattacatacctaggaattaaccaaagaagtaaaagatctctacaatgaaaagtataaaacactgtgaaagaaatcgaagaagacagaaaaaaatggaaagatattctatgttcgtatatcggaagaatcagtgttgttaaaatgtccatattacaaaaggcaatgcaattgctaccaaaatgccattgtcattcttcacagaaatagaaaaagccatttgaaatgttttatggaaccagaagaaactcagaataaccaatgctatcctgaggaaaaagaacaaaattggaggaatcatattacctgacttcagattatactgtagcgctatagtaaccaaacaacatggtactggcatgaaaacagacacgtagacccatggaacagaatagagacctcagaaacaaattgatacacctacagtgcattttttacaatggtgccaaaaacatccattggggtaaagacaatctcttcaataaatggtgctgggacaactggatatccgtatgcagaggaatgaaactagacctctatttctcaccgtatacaaaaatcaaatcaaaatgaattaagacttaaatttaagtgctccactgtgagactgctgcaagaaaacgttgaagaaactccccactttcatgtggacaaaaatttcttgagtaaaaccccataagcacaggcaaccaaagcaaaaatggacaaatgggatcacatcaagttaaaagctgcggctcagcaaaggatacgattaacaaagtggggagacaacccatagaatgggagaaaatatttgcacactacttgtctgacaagggattaataaccagaatatataaggagctgaaataactctatagaaaaaaatctaatctgattaaaaaatgggcaaaagatctgaatagacatttcctaaaagaagacatacaaatggcaaacaggcatatgaaaaggtgctcaacatcattgatccttggagaaatgcaaataaaaattacagtgagataccgtctcaccccagtaaaaatggcttttatccaaaagacaggcaataacaaacgctggtgaggatgtggggaaaaggaaaccgccacacactgttggtgggaatgcaaattagtacaattgctatggagaatagttcggaggttcctcaaaaaactacaaatagaactaccataatccagcagtcccactgctgcacatctacccgaagagatacatcatagagatagctgcactcccatgtttgttgctgcactgttcacaatagccaagatttggaagcagcctaagtgtctgttaatagatgaatggataaagaaaatgtggtacatattcacaatggaatactatttagccataaaacagaattagattctgtaatttgcgacaacatggatggaactggaggtcattatgttaagtgcaataagctaggcacagaaagacaaacttcacatattctcacttatttgtaggagctaaaaattaaaacaatttaactcatggagatagagagtagaaggatggttaccagagggtgcaatgagtattagagcagtggtgggggaagtggggatggttaacgggcacaaaaacatgttagaaagaatgaataagacctagtatttgaaagcacagcagggcaactatagtcaataataattaaattgtacattttaaaataactaaaagagtgtaattgtattttttgtaacaaaaaggataaatgcttgaggggatggatgccccatttaacatgatgtgatttacacattgcattcctatcaaagtattatatatcttatgtaccccataaatatatatacctatgtattcacaaaatttaaaaacaaaaaataaaaaaatttaatagataatgggcaaaacatttgaaaagacacttcacaaaagatattataaaatattttggattttgatctggagaaatggtttgaatatgtaagacttttcagtataaaaaagatgaatatatttcactatatgaatattaaaaataaaagacaccttaaagtgaagacaagttataaactttgtataaaattttatgctttcacaatgtataaaattaataaagaattgtttttaagaagtagagaacaactgattagtacaactaatatatagcaacctggcctgaaaataaaaatattttaaaaatatatgtgtatgtatatttccatatacgtgttttgtatatttgtgtgtatttatttgaaggcattggaaagataacatgactgtgaagtagtacgcggccaagatttcagaaaaaagtatacagctagaatggtgatactggtatttggttctaccttttctccaggtgtgtctttgagtttctgaggaggtggctgagagactgagagggagagtagaactgtgcagacacatgaggctgaggatgaaaatattgtttaggatctgcccagaagagcttttggttgggaccttgaaggactactccctaagaataagggtataaattataaaatgttcagtctctcttcacagggattaaagtttcacaccacatctcagtccctaactggattaaggtgatccaggattactagtgcaccaagcctaactctgcttaccagaagtgaaagtaaatcttttgagaaaggtgtcaatcacaacttcacatcaaatctgtggttatccatatacatagcctggcactcagttcaatgtaaccagtatatgaacaaacaaaacaacatgatggaagaacaagagagtcaactgacaaaggaaatggtacctggataagaaaattatctgacacagactttaatatattcaagtcataaagactaaatttaaaattttagcagaaaattgaaaattaacaaaagaacttgatgggaaatttagaattgacaaatgttaacaacaaaaattaggaatttgatggatttagatttggatagtataagaaaatagagcaaactgctaagaaaaggatggaaaatacagaaaagagcataagagaaatagatgataccttcagaaggtctgatatatgtattatgtaattgatgtcctagaaggaggaaaatggagagtcaaggacaggtaatggctgagaatttttccaatgtaacagagagatatcaaacaacacattcattaagccctgtaattagggcaggataaatgctttacactgaaaacaataccatagcacattatttgagaagtccgaaagccaaagatataatcttaaaagcagccggtgagaaaaagtttaatcactcttaagcaacagtaaacatggcagctcatttctcattggaagcagttaaaaagacagaagacagtaggatatgctgaaacagagaaactgccatcctctaggatgctctactcagaagaatagatcaaagtaaaattaacacatttcaaatggaatatataaccatctgacacgctaaaagtagtttttttcctgttgaaaagattgcgggctcaaatgctaacttgtagatgaagtattgaataaagaacacattagataattttgagtattgactgtatactacaaagcactaatagtaaagacttgtagggtggtatatatttgtatgttgtgtatgtggatatagagggagttaaaattggagtgagaaaaatgtaatttaagtgttctgaggttcttttctaggaacaagtaaatgttataatttatatttgattttggtaagtcaagtattagtaaaatatataactaacaagctaatgggggaagggatagaataaaaattcaaaatccaaaacaaggcaagaaagaagttaaagaagactattgaacaggcaggacaaatagaagataataaaattggagatttaaaccccaaaatatctgtaattatattaaaggtaaatggattaaatgcaccgattaaaagataaatattatcagattggatttaacagcaacaaaaccccacaaactgttttacaaaaactgctcctaaaatataaggatgcagaaaagatggaaagtaaaacagcacaagatgtaaactttgatgactctaacaaaaatatgtctattatcagccaaagtagattttaaggcaaaaaaaaagcattactaaaatagatatgtcataatgataaaaagtttagttctccattatgttatagcagcctttaatttgtatgtccgtaatattataacttcagaatatgtaaggcaaaagttgacaaaaccggaaggaataatagaaaaatcatatgataaataagagaacagttgtacaaaaaataaaacccagtgaagatatgggagagctgaactacttgatataataaacttgaacacctttatgttatttttttctgcttggaacactttttcatatttcagactgttttcttatttaaaacctttctttaaatagaattttcacattaaagcatccagttttttttcctttggtctggagtagaaaatctttcacacataaaacttcaccattagctaagataaattcctttttgtgtggaataacatgattgtaaatataaactgcatttcacaaataacatggatttgaaatacttctcaatgtttgagtcatttacaaactgtgtaaactgagacctggagaccatctaaatcaaaatcctgagtggaacagtattcaaggtaggctttggggacagttcccccaaatgttacactgtttcagtagtgttggtacccatctataatacaaattgttttaaaaataagttttattgtgtatatatcaggtatattacatgatgttatgggacacatatagatagtcaaaatggttactatagtgaagcaaataaacatttccatcatttcacatagttacccttttttgtgtgtttggcatataatacaaatttttcattttgtgtatgttcacatggaattattaagggagaaggaaatgtcaaggaagaagaaattgtgacttaaaattcaatttgggttctatattactgtgccatcaaaaatacttaagatgatccttttaggtgttcacaaatgtttgactggattcaatagcagtggtaattctttgaagaaatacttaattgaggccaggcacagtggctcctgcctgtaatcccagtacttcgggaagctgagacaggaggattacttgagaccaggagctcatgaccagcctgggcaacataggaagacctccgtctctacaaaaaaattaaaaaattagccaggcatggtgatacatgcttgtagtcccccagctacttgggaagcttaggcgggaggattgtttgagcccaggagtttaaggctgcattgagctgtgatcatgccactgcactccagcctgggtaacagagtgagactctcaaaagaaatacttggcgggggtggtggctctgtaatcctagcactttgggaggccgaggcgggcggatcacgaggtcaggagatcgagaccatcttggctaacatggtgaaaacctgtctctactaaaaattcagaaacaaaattagccaggtgtggtggcaggcgccggtagtcccagctatgccggaggctgaggcaggagaatggcgtgaacccgggaggcggagcttgctgggagccaagatcgtgccactgcactccatcctgggcaacagagtgagactctgtctcaaaaaaaaaaaaaaaaaaaaaaaaaaaaaatacttagtgtctactctttgctgccaagcctgtgttaggtgatagcattacagtgaggatcaaacagagataatttcttctttccagaacttacattctagtgggtgaagtgggatgtggacagaaattaaataatcccacaaataaatgtaaggttgcactatgtaagagacattggtgtatgattctatggagtggtataatggatgaattgaccttctcgaagtctaaggaaagaaggaagccattaacaagatcagaagaggtagtgtcagcatgtgcaaagactggcaggagatagactgtgtgtggaggattggaaagaaagcttatatagctgtaccacagacagctagagttggctaatgtagggtctctttgtgaagtaatgtggaatgagaaaagctggatagttaagtagaggctgtgtaatgttgatatttaggggagcatataaagaatattgggcttaatcttttagagcaataggaagtcattgaaatacattattgaggtggatgacatattcaaatttgcgttttgaaaacattgcaatatggagaagagatgtaaggccattagtggctattggttgattaaactgatcttactgcagtactctaggtaacaagtaatggtagcttgggctagagtggtggagccagagataatgggtagataccttaggtatttaggagataaatttgacagaactggatggtagatgggtattagatgtgaggtagagaagatatcaaagtagtataagctattatacaacttgctttagatttaaatgaatacatattaaaatacatgttttgaaaatgtttaaaagtgaaggagttccttgaatagatagtaaataatctatatggagaagattatgagacaaagtgattttatgaacttttaatggcagcagaaatacctatggtgttatataaagcagaatatgaaattgtttatagtatgtattcttaattagataaaatgatagtattgaagcatactaattgtcagaaatgactttttgatgtatagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccaggtatttatgattatgcgctattttagtagttcccatattgttttataatgcctattctttcctttaaaaatttaagttagtgtattctctttttgggaaaaagtatgtgttttcagttgtgatgtgataaaatgtgtaagataagtacatggataactgaaagaccagttgggatattttagtgtcaaaagagaggggtaagacaatgatttcctgaaggagatgatgacactgaagtttagctttggaaagagagttgaattttcatttgtggtcttaaaggagggaaagttggaggaatccttccaactggaagtatttaattttttttctgtatttttattgtatgtagcactttctaagttacattattatttgtacttgtgtcttctcaaccctcattaaagtataaatattttgagggtgcccttcaaaatgtccttcgtgtggaaggtacccagtgagaatttgatgaatgaacttttgactcaaaggatttgaaatggagaagatggaggtacgactagtataaatgaatcattttggtggtgaggatgaacttccttttaaacatgtataaaagctaggtagttcttcccttaggattttgaaaatgtgaaactagagcttgagggaagggtagccttgagagattgaatgtggaaagaatgaaaccaaaggagaagaaattggagctatctgtatatggtgaataggttgaggaagagaagctagtgaggaaaacataatagtaataaggtaggagattttgtaggatttaccaaggaacaaataaatttcaagacaaaatagcgtgaattttataatgagccctatgagcagttaggaatttcattagcagtgtttggcagcgtgggctacctttgaaatgattattgttaatgcttttacttgaccatcttgttttatgttttatgtttatgtttttacaatttctttgaaaataactttgagactatacatacatgttttcacataaatggtagcaagagtactttttgtaaatgaagttgggaaggttgtttacagagtggtttagaagtcagaaagtttagttgggggtcagctaggtaaacggatacttttgggtttatcatcgtttatctccttgtagaatttagcaaaatctgaatgtatgtttattatatttgtattatctccctcctttcttccgctactaaagtaagcctctgtaaatttatagggaccttctgtattttgttcaccactatatccccagtgcctaaaacagtgccaagaatatagaaaggggtcaacaaagtttacagaatgtgcagcaatagaaggattaaagtcagggaatgactgtgtgtcctgagccatcagggaagttcttataaaaatgtttgagctgagtctgaaggataaatagagaaggatactctacgcataggaaatatgtgaaaaggaatggacgtgtgacgttgtaggattggattgaggaaacaaaatttttatgtgactgaaacaagagtatatgtttaggccagttgtggtggctcatgcctgtaatgccagcactttgggaggcccaggtgggtgggtcacttgaggtcaggagttcgagacgagcctggccaagatagtgaaacctgtctttactaaaaatacaaaaattagctgggcatggtggtaggcgcctgtaatcccagttgtttgggaggctgaggcaggagaatcacttgaatctgggaggcagaggttgcagtgagccgagattgcaacactgcactccagcgtgggcaacagagcaagactcttgtctccaaaaaaaaaaacaaaaaaagaaaaaaaaaaaccgcaaagaagtatgcatgtttattgttggccagaggagtctggaaaagaaagtagaatctcccttcccagcgcagctcactaatcttttttatatttatgtccagtatataatgttgacattttaaaatttgaatgtggcaggacatgaataattactgattttggaaatggaaatttataatctttttcatatttcaacattgcctctaaaatgttcttttttttaaatcatagatatccagtcatgttaaagcgattgatacaatttaccagaccacagacttctccggaatccgtaacatcagtttcatggtgaaacgcataagagtaaggaacttaaatagttaaaaacacttaaaaagtgaaacagtccagactatgtttacacacacacacaaaagcttgcttttaattttatctttatgaattaagtagtttagtttaattgtatctgttgatgcagttttttactcctggcatttacacacccacacacacacagatacttgggtttatgatttaagaattaaatgtataaggtcttaatccagtctacagtagaggtaaagtgtgtattcagtctgtctgattaacatattattaagaaagctctgacccttcaataactatggctatagtgcttgacttttccccaattatccctcagtttcctaaaatttgctttgtgcagtgtttttcactgtatgttccatttggtgttccaggggagaaaaaggataaatacagtgtttaaataaaattggaagttggaaaaacccttagtactataatcttcttgaaaattcacaactcacagtaacatatatcaagttttgagaagtctttcaggaaagaaacccatatttttctaaatttttgaccatgaaactttttttttagaaaaaatatattaacatcaacagattccaaaatactttaggcattttgagaaaagctgatccggagccatagggtcacgtagtatgagttctaatgttataaattacaggtaaataaataaatattaaattactgacaaatttaggctattttttcaaaagatttctgaatattctaaatatatatgtatagcttttaaagaaacagtatttatatgctaaataaacaaccgaacttaaaaaaaaatcatcctttcacaaaagtatttgccacagggttccttaatatttatgctttcctatttttcttcaaatgtggttggataaaatgtctatactagagaagtttagtatatacattcagccacatagctgtaggtagtccttaaatttagaagcagtgtgattaaatcttaaattggattttcttaaggtgaaatatgatttattgatttacagtataagaattgttcataattaattgctttcatgtattctgtgaacaatataaatccttaaatgagcaagtaacagtgataagaggtataagtgttgctgtttagtaggcagagcaataaaatgcaagtaatgaaaagtagagagcacctgaacacattttagtgacgcacctttgaggaaaatgatatgtattatgaagaaatgcatgtatataagtaaatgatgtggtagttggttgtttttagaccttacctcttattaaaactttagtaaagttttatctgttgaagattgttcataacctattaatttaaaatttctgtcagctatattaataatccatttaaatataggtaattaaaatttaaatgcaatttgttttttttttttgagaaggagtctcactctgtcgcccaggctggagttcagtggcgcaatctcggctcactgcagcctctgccttccagtttcaagcgattctcccacctcagcctcccgagtagctgggattacaggcgtccactgtcatgcccggctaatttttgtatttttgtagatacagggtttcaccatgttggccaggctggtcttgaactcctgacctcaggtgatcacccgcctcggcctcccaaagtgctgggattacaggcgtgagccactgtgacgggccttacatgcaatttttatttatagccagtattagagaattactaggaaatttcatttttatatttagtgggagaaagccatctacagcatgtcttcaagcatggactatctgtaacatacagtgtgcttgcttttgaattgttttagtgttaaatggccgtaactgattgtttttcgttaattgttaatagataaaccagatgttctgaaatctgttcttaagcagttgccctcaatggtgtttttgcctccctgcttctgagcctcttggttttactggagagtacaggtcataaagagacctgtagctcttgttgtatcaaccattatgtcatcctcttactgccaacattttcaaacagactgaggtttgcctttcggtaaaaacatttactttcatattgtaattccttggcttacctggggaaagccaaatcgttctaggacttcagaggagacacacaggtctctgaaaggatgcaggggctaataaataaaagcttttgtttaatagaagtctggtattagaacagattattcagattctgaaggaggaacctgtggtaggagtatagtagctaagtatcaaaagaaacattctggaagaactcagcttcaaagagtaaaagaagtgagtttaaattagcaaaattcttgcccacattcaggaaaaaaaaataaatttgcagttagtttggcttggctcatgtgactctctaggcaaggaaaaccaggaaaatgatttgtctgctgaactgacagtcttgggtttgatacctattttatattctagtaattagttaaaatacagggttttatatccttgtaagtgtcaccatatgtaggagattaggactaaaggagacttgttcagagaattaaatttgaaaaactatacttcctttactaaaggttttgaaagcaaaacttgttttttcttcccaagtgttcagtgttcaggaatctggtgaatacttgctcagaaatttaacatcttcaattttaatttccctacctagcctttcttttttatttgttgttattgttttgccttctgtgatcagctcagggatgtgggcagtgggaacaaccttagaagccttaattcaggcctgatttccatgggagcatattgtccaggtgtacgcagaagaaggtgagcagacattcacactaaagctctgctaacattaattacttactaaattattgttttggattttagatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggtagtttatcatattaaatatgtcttaacttactacttgaaacaaaggggagttttcagagaatgttgaattttcaaagtataggagaaagtgatgcctgtataatatcctaatttatgctacttgagttaggcaagactcataagcataatgtaaaagccacaatagatgaaggagctttttattttgaaacgcatacagggaaatatcctgattcctgacatttgaatggaccaaatgaaataaataattttatgagaaaaagtggtaattctgaaacccaaagggaaatttaatttttccacaaaagttaataaatgttatatatttattaacttttttcccctccaaaatagggtacttagaatcaaaagaggaaaactgtgtcttgctctctcttctgtagtgagataaagaggagagaaatcctcatcaagagtggcaggtaaaaggaaaagaaagcctgcctttattattttatttctagcctttattttaataaaagggaagcactgcatgaaagagatgtaggcaggaagcccctggtacccacaactccattgacatcatcacctgggttcatactctgccgagtctctgccttagccatgaaagctattgtcattgataatgttgggatgggacaatacccttcccattacagtgggggtggagtgttgtggaggagctgtgatttactgtataagttcagttgcctagtttagaaatccaaatttattaattgaaagatgagtggaaaggaccccaggctctttgaatataaattgtgccaagtagagtttaatcaatagtatattatcttctgagctatatacaacagattctccttctgatacttcatttctatgtttttttttttaaaaaaaacttctgctttatccagagtaagagaagcttttgtattcctattcttattagtttattctttgatttgttttgtatattttaagatcttaagtagtgctgtattttcctttgtatttctttctccttttttaaaagtcagtatcttaagtcaatacttttacaatttccatagcttcttttgtttttcttctatgttttaaaatgtactcaatttcatgatgtcattttaaagtataagtttatgtcatgggctgcatattaatagtgcagtacttttggatatttgtcttttatgataatctgtacttttttgttacttggattagtcagcagattgtacagctcactctttcctatgatttttcatgttcgaaactttcatactctgaaacctctttgccccttcaatggttggatgattttatcacaaagtctgtgatttcttctccctattcattagtaagtactactaaaaactcagggtctcatatgattttatttgtatattatccattaatacagtagctgtgaagtctcaaacaagtggttctccaagtgtgatccatggactagcaccatcagcatcacctaggaacttgttagaaatataagttcataggcactaccccggtctcttgaatcagaaactatagatgtggagcccaacagtcttagtttgaacaagttctcaaagtgattctgatgcacagtgaagtttgagaagcaccacattaatatttttgtctctaaagcttgctcacaaaatgcctcctgggtaagtgagtatgtgatcttaaactaaaaactttctgccattttgcattttcagttacagactattgtacttaaggatgtaatgattctgtaggaatttggtaaaattcttcctaaatcttcagatattctcatgtctttagattcagctactcattttgttgtaaaaagtaagctttattttttagagcagttttagatttacaaaaaattgaacagattaggtattctcaaatctccttcctccctcccctgacagttttgaggagtactgatgaggtatattttagaatgctcccctatttggaatctgtctgatgttttccttatgattaaactgtagttatgggtttttgggacactcagtgtttatgtctcattgtttgtgatatttggatcaccatttgtgatgctgctcattttcctgaggtggggagagttctggattgaaaatggtggggcatgttacttgtattttctttttttttttttttttttttgagacagagtgttgctctgtcacccaggctggagtgcagtggcgcgatctccgctcactgcaacctccacctcccgggttcacgccattctcctgcctcagcctcccgagtagctgggtctacaggcgcccgccaccatgcgtggctaattttttatatttttagtggagatggggtttcaccgtgttagccaggatggtctcaatctcctgacctcgtgatccgcccgcctctattttcattattagggtcttcttaaaggtgaaacaagatacttcctgtgtacttcatgagcaaaaatatggtgattggcaaccagaatagaaaacgaagactcccgttgtcaactttgtatccccattttccccccctctgctttttttccttttatattattatctctctttctttcagacattagatgtccgcttccattactctatgttaaacccccaacttcagctcttggaagccatcttctaagagctgctggggaggggctaggcaggcacagaagaatagaggccatagtgggaaagaaaagggatctttgttcctttggtccaactttttcgagtgtaggttacctgccttgaaataacactgccagcttcttcacttgtctttgcacttactactagctgaactgagtttcatatttgacatttttttttttaaaacaaggaatgttatatatttattcttgattatttcaatacccttatgaggtgtaggtattattgtctcccttctacagatgaggaaacttgtgttcagaaactttgtgaccaacctaataccacacagctagaggtggaacaggatctggaatctggaccttttgactccagattcagttcatttggtaattatattactaggtattttatatatatataaatacaatctacacacacacacacagtaacatcttagccttttctttgatgtttcaaataagaagctgaaatgttttctgcttcttagtagaggttatacattggtggaatctgttttcttctttcttgagagagaagagttataaaatcatactaagctataatattttgatataattttgggtaattgtcatggcataatgggaagagcaatggactgagagctgggagacaggattcttgtgtgttttctgtctgtaaattcaggaaaatcattttgcttctggctgttttttcattgtagttctgtctttgcccttcttttgagtcttcatgtttctacctataggtcttatcagttaactgaatgaacatagtctcagttcggcttggtcgttgaatgaggctggctttggaattcatctctacagttagtcctgaaaccttcagtactcctctatttgtgaagaacatcttttgaggcatttcatttggtagaaatagtctcttctgttttctttagattagatgttttagtttgatattacatattaaaatttgagagcgtacagaacttaacacagggttctcgggataacccacagcttattgaattcttaacccatagtttaaaagtataacttcaaatgctgggaaaattacatcattgaaatattgcaataggacacttgctattggcatttaatgcttgtctggatcccttggatatttaacatctttgatccctacccattgcatgtgagtagtgctctccagacttgaaagccaaatgcctgtgctctcacatttcctggtatcacttgtgggagtattactatggtctggtccagaattattgcttacattaatattgtatgatcagcatgctactattaatttttggcctcctcacatcaaaactgtatttatggaatatgtcaaggtatcatattactcttgtatttttttctaagacttttttttggggggtggggtggagtgggtctgttttgaagtttaggacagatactctaactttagctctcaaactatcctgtagatagaaaattgtcattatacttctttgttgcttattgaatccttcatcaataattacttttgacccgaattgaaaacgtttcacccttctcattgttattcacaacttatgtatttgtcagtgataaatatatgtatagtaaaatcttaaatttaaaatatatagcaattgagtttgagttaatggtttagctgtgggtatatatgatacctcattactgagttttctggcatatcaaaactagttgcagtatttaaaaaaattaaaccataactttcagagttacaaatagtattttatttcttcctgtataatcaagttactccaacatatgctattagcctgcaacaaatattaaacttcctttttttttttttttgaaacgaagtctcgctctgttgctcaggctggagtgcagtggcatgatctctgctcatggcaacccccgcctcctgggttcaaatgattcccctgcctcagcctcctgagtagctgggattacatgcatgcaccacctcgcctggctaatttttgtaattttagtaaagatgaggtttcaacatgttggttatgctggtctccaactcctgatctcaggtgatccgcctgccgccgccacccaaagtgttgggattacagacgtgagccactgcgcccggccattttaaactttcatataagcgataatcataaagaccaaaagcagttgtttaagaagttaggcaatatataaattactatatttcagaatagtatattctaatttatgtatactcttctcttaaattagccagaccctaaaagtgcagaaaaatgtatattatcagagatttaaaaatatgcctatttactttttttttttttaactgataaagatttgaagtgtggagtcttctatgcttaattcaagtttgacagtactgcattggaccaatttgcacatgacaaatcttcactaaggcaggatattaatttactatttgtttaaaactatgctgtgtgtacaataattattatatacagaatacttatttatatattttctggtttccagaaataatgatgtgcttctcaggactgagctccaaaagtagaactagcttgaagaaaatatattaaattctcacaaattatttggtattttctctctactcagttgtcagtgtagaaaaggtattaaattttgaatatcataaaagttctcaaccccttgctgggttaaatttgcatgtgactccagctatttgtccggcctatagtctcaggtcactcattttaatgtgcatatacatcacctgaggtgggcagagttctggattgaaaatggtggggcatgttatttgtattttctttctttctttttttttttttttttttttttgagacagagtcttgctctgtcacccaggctggagtgcagtggcatgatctctgctcactgcaagctccacttcctgggttcacgccattctcctgcctcagcctcccgagtagctggggctacaggcacctgccaccatgccctgctaattttttgtatttttagcagagatggggtttcaccgagatgttctcaatctcctgaccttgtgtttctttgaaacacatttttcttttcagctttctgaattttaacagtaattcaaatttgtattttgttgccatatatttattatatttaatgggagcaaggcaacagtcgtagtataatgctgttcttgcagacctattttgaattgccttctgttacatgctttattagggattctaaatactagacttgtttttgaagtggggagaatgggaaggggaggagaagcaatattagactttttttaaatggtttagtaactttgttgtaacttgtctatagaaagctaattagagcagttatcgtaatacgcttatccatttgattgtatttcttttaaaaatcaaatagggaaaactttaagtataaatataaactaaataacttctcactgaaaatcttataataaagttaattaaaagaaaatatgatcttaccagtgtaatgtctatataaaggcatgaattgaccagatggtttctgattttcctattattatttttctgatttctcttaattgattttagctgtgaaagcactgtcatttgctgttaaattctaaagtccctgttaatgaatagatgaagtacaaaatgataaaaatatttaagtggaaatatggtttttcttttaaaatttgatagtgtcctaaagacatactggaacaatcataattcagtttttaatttttttttgaagatttcaaacctgcggaaaggttgcaagaatagtatggtgaaattcttcttcttttttttttttttagacagagtgtcactgtgtcgcccaggctggagtgcagtggcacaatctcaactcattgcaacttccacctcctgggttcaggcaattctcctgcccgagtagctgggattacaggtgtgcaccaccacacccagctaatttttgtatttttagtagagatggggtttcaccatgttggccaggctggtctcaaactcctgacctcaagtgatctgcctgcctcggcctcccaaagtgctgggattacaggcgtgagccactgcgctcagcagtggtgaattcttgatggattaatcaattattaaccttttgtcgcatttgctttctatctctcccttccttcccacccatcttctctttttccttctttcctctaccccctctttttttttttttttaaccttcttgacatgattattttctatttttacaaatacattgtatgtcatatctcaggacagggaatcatgtgctcatgtgcctcactgcttcttgtagaagtgactttctcagaatcttcttgaggatattttgttcaactttcatttaacttaaatcataagatttctttttaaaagatgaaaggatgtacactttgacttagtgtaaatactgatatattcaaattgaaaggaaatgtaaatatttgttttcctaaattaatgggaataacatttgggggacattttgattgtgaagaacattttgtaaaggctgtgtactcagtcctgggagtttctttctgaatgtcattaaaacttttatatgaagtgacttcttagtcttggaccaaagaaacttttgcatatgtgatacgtttgagtaccagttctattttagattaaaatataaaatgttttcatttaatatagcatgtattacctttttgggggtaaggggaaacagatactaatttagccatttttttgttctggattaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccagtaagtattgtctaattattagcttaaaaaatacttattagtctaatttttatgttgagtgatttatttaaaattcaccgtgaaaacaaatgtacttacgagtgtttagtttttatgtcagagcacagtaatgtatttgaccatactgaaagggaggaagatagaatgtttgtggttaaagtaagaaaagtaagcataacagtgctagaattctgtgaaggcaagggatttcatctggcttattcagacaaaatatctatatctcctggccctagaacaatgcctagtacataatgtactcaaatatcttttgaatgagaatcattattcattgtttaaaagtacattttgaatgttcagcaaattgtgagaaattctttttttgttttgtttctgttaaagcatttttagggaatgagattgatattttaaaatcttttctctactgtggaatgagattgataatttaaagtattttctctaccgtggaatgagattgatattttaaaatcttttattaggaaaaaattctaacatacacaaaagtagaacaaatagtgcaacaaagcgttatacgcccatgattcagaacagggatcagcaaacattttctgtaaagggcctactagtaaacattttaggcttcaggggcagtgtttggtttctgttgtacagtctttgttgcttttacaatttgttaaatatggaaaagccattcttagttaagccatataaaaacaggctgctggctactttgtcaacccctaattcagagccaataattgtgaagattttgacatatcttctatctgtatttctttttctttgctaaggtatttaaaggaactctatctatccttacgtatttcagtacacattcctgaaaaaatagacattttctaatacaactacaatgtggttattacacctaacaaaattaacagcgatctttgatattatctaatatccagtccattatattgatcttttaagtgaccttaaagatcagtacaacacagaaatatgaaatactgaatgatactctgtctttgtgattttggtagagcttattaaagataacattttgaaaatgtacacttgaaaactgtatgtaaattcattttactttcaccttatcacttgcaaaagtgcaaatttttatgattttaaaaataagttgtctacttgtagcttaaaatccccaaatgcacttctctaatttttcccatgtttgtaaaataggtgccatctcactaagttgcaagtctttcttcttctacatcccaatcagaaattgatagattattattaatgttcttggataaggtatttaaaatgtgcttaatctctgtaactcttgactgcttttgtgatcttctcttaaaagagtacttggaattttagagatgagcagagaattattgttcatagttgatttgcattttcaagagcagataagtgtcctctcttctccccaagtcatcttggttccaggccttaccaggggaattttagtactcctccagctacttgtctggcctttagtcccaggtcactcatttttatgtgcatatacatcacctgagaatcttaaaacacagattcttttttagtaggtctttgatggggcctgagtttctgtatttctaacatactcccacataatgctgctgctgctgctgctggtgctcatctgtgaaccacactgcagtagggaatctagaccattctcttttcacttcttgtgtaatctctttcctacctagctgccagtgagatgtttttattcaattaatgttatattattgtttaatggagaaattggttcacactctttgcctaccacgctcaatcgtaccccattcttttgcacatgttgttaattctgccatctgtatccgtagtagatggttgtcttcatctgttttgtgttgttataagggaatatctgagggtgggtaatttataaagaaaagaggtttatttggctcatgattctgtaggctgtacaaaaagcatggtgctggcatctactcagcttctggtaagggcctcaggctgcttccacttatgatggagggcaacaggtgctggcatgtgcagagatcacatggtgggagtggaggtggtgggagcgtggggtcaaggagagaggagagtactaggctcttaacagccagctcttgcaggaactaagagagtgagaatgcactcacccacccacctccaacccttcaggaagagcattaatctattgatgagggatctgcccccatgacccagacctctcttgttaggcccactaacaactttgggatcaaatttggggggacagacatccaaattatacaatgcttaataaatatttgttgagtaatttaatagtaagatcagccagaatcataaacacctgaacctgtctcccttaacatctttatctgaaatctctttctctcttatacgtttgtagtaatgtcaatgttactttttctgagtggttcacattatttcttaaatgtatttatcctatctgaaatatttattgtgcacctattataaactgctttataaactttgttgtaggaagttgtaatcataaatgagacaaagttcctgtctctcagggtgaaaattctaatatgtacctactctcaccagattcaccttcatgtaaatacagttctaataatgccacttctgcttactaactcacttctactactttctaatattgctgatacaatttccttatcttaatgtttggggtgtttgataatttggggtttaagtatatttctagtgttatctctcctcatctgtcaaattaattcacagacctttaaaactttcctccgctaggaagtcagttccttcccatgtctgcctgttgaaatcttgatccgtgttgttatatgatgtaaatgaatatggcccttaataaaaattaagaaaatatgaccatcatagttttatttataataccaaaaagttttaagcagcgtagatggccctacagtatgaaaataccacggaatgctctgcagtcatttaaataccaagttttgcagtgctcattttatactgttaagctgaaagaaaggtgtgtataactgtacacatggagggtagctgtggtgactcacacctgtaatcccagcactttgggaggccgaggtgggcagattgcttgagcccaggagttcgagaccagcctgggcaacatggcgaaaccccgtctctaccaaaaatacacacaaaaacaattagctgggtgtgctggactgcacctgtagtcccagctactcgagaagctaaggtcggggaggatgacttgagtccaaggttgcagtgagccaggatcacgccactacactccagcctgggggacagagtgagactctgtctcaaaaaaaaaagttataactgtacacatggtatagtccaaattttaaattaaaatgtgatacagctagatataagtcagataggaaatagatcaaaattttaatagttatagtgcatggtagattatgattgaatttttatttatgcatttttgttttcttaattttctttcttatagttagacaaatttttctgttttcttgtcacaaagattatagtttcttagtgaaacgcttctcttgatttgaactctgaatacttgtgcgagtccagtcaagatggcctttatgttctgttttgtgttttgcttattcatgtgcttgttttattcgttatctgaggatggcaaatagctggcatgcttgcttacaacctgtttccccttctattcctgttaatggtgatctattgtaatatctcctggcctagtaaaataataattgactagcaatatctgtaatggatttatgcagcagcaagtcagactaagcagttatgtcaagatttgctatcatttaaaaatagaaggtaagtgccttgaaggctagggataatacttttctcatctttatatttttatattttagtgcctccttttatagcactggacattcattaatatttactgaattgaaaagtggcaagatattctgtgatgacatcaagagttatacagaattgggatttttttctttcctttctaaaactctaatgctgagaataattctagtgctacacctttttcagaaactgagttgaattttataggttgaaaacataaagcaagataatattggtgaatagtatagagttgctaaatgctgcatctagattcagaagaaaggcaagaggtatcaggaagaataaaggtgatagtagaggacacattttttaatttaacagttgcctcagaagagggaatagaaaatgaaagtaacttagttgggctctaggaaaaaacagaacgtccttgggcagtctttttctttcttgagagtggggttgttgggtatttaaaacaagattttaattaaatagcacaattactctagtgtccagtgttttttgccccttctgatgtgttctgaattgtttgaggggcattgtgagggttgttttagtgcatatccccaggatggtaggggctgctgggatctggtagtagtgttctgttgcttggtctcataagcattactttgagaaaattcagggagctatgctgtatgtatctgactcttcaataaaatttatcaaaaccgaacaccacttatgtgcatttatatgttacgtgtacacagaactctgtttatttggcaaagcagtattttggttttatctctaggcttttaccatttttcatttaaaaatatatcattgtgtttctgttcctagtcagcatttttacttacctttcctatatattggctattaagttagctgtcttagattcctgttctgtgtgtatttagccccatgtcagtctcttgattcttttgtctttccccacctctgtcttctctgaactattcataacatgtaatttaacatatgtgttagagactatttagtagttttaaagtagtttattttactgttactagttttaaaagtatgtgagcttatttttgatagacttttatgacagtctgtcctcaattctagtccctgcttacaaagctataaattgttatggctagacctccactgattttccttcttttctaagacagtgacccctaaaagagcaaattcttttcctactcaaggtgtaaaacaattgtaagatcctttttaaaggagagtccacaagcttccattgttttcctgatgagaacattacgtttaatcagttgacctgaaaaccttattttacttcctgtttatgtaactttatattctttttgacagcatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttggtatgtatattttcctaacgttttgttatgaacattttcaaacattcagacaacttgaaagaattctatagtgattactgacatacccaccacctgcattttactattgctaacactttgctgtattccctttatctcgttatttcttaatcttgccatctctcaattcatgttttattgcaatttaaagtaagttgcagccatcagtatacttcacacctaaacattttagtctgcaaatcattaactagagttcaatattgtttatagttctttttctgttttctgcataagtgaaatgcacaaattttaagtgcatcatttgatgagttttgacagatgcatttacctttgtaaactacctatcaagatacaggacatttctgtcaccccggaactttcttttatcacccttcccaatcaggctctgtcccaacacaccctcagaggcaaccactatctgatttatttcactctacattggctttgtcttcatataagtgaaagtatacagtttatacccttctgtggaaggctgtttaactcagtatacagctttgagattcatctttagtattatactcctttttattgctgagtactattacgttgtatgaatatgtcctagtttgtacatctactctcctatcatgaataccttggatttgggctaatgtgaataaagttactatgaaattatttcttattttagtaaaatatatatagcataaagtgtgccattttaaactgattttaaatgtacagttctgtgacattaattataggtacaatgttgaatgtgaatgtaatcaattacattcactcttcatttgcaaactttttcatcatcccaatggaaattctataaccattaagcagtaatgctctgtcttcccctcagcccctggtaacctctaatccactttctgtctttatgaattggcctattctgggtatctcatgtaagtggggacatacaatatttgttctttcgtgcctggcttatttcacttagcataatattttcaaggtttatctgtgttgtagcatgtatcagagttccattccttttcacggctgaataatactccattgtatgtatagaccagattttgttcttccagtcatctgttatgtctttcttgcggcattgaacatactctaaatatttactttgtattagggtttttttgtgtgtgtgtgtccttgtcctatttcacaagaccataggtttctttaggggaaacactgaggcctattcatctttgtacattaagagcactgaaagaggggttaaacatgtgacagcaaaggagaaagaattcaggaagatttccagataagcatgggattttgtttttaattgaaattttattgagataattaatagattcacatacagttcataagaagtaatagattccctgtacccttcactcagttccctccgatggtaatgccttgcaagactgtagtacaatatcatgaccaggatgttgatattgagaaaatccatagatactattccaatttccctagtttttttttttgttctcatttctctttgtatgtatttagctctatacaattttattacatgcgtagatttatgtatccaccatcacaatcaagaatcagaacagttctgtcattacaaggatccctcattgttttataaccatgcttacctcccttctgttgtcccttcctcccccctgctaccctgttttccatatgtaaaattttgtcacttctaaaaaagttatataaataaaatcagacagcatacaaccttttggaattgccttttctcactcaacataattccctggggattcatctaaattattgcctttatcaatagttcgttcttttttatttctgagtagtattccatggtatgtatgtactgcaatttgtttaaccatccatttgaaagacatctgggctgtttccagtgtttggctattatgaataaagcagctgtaaacattcatgtacaggttttttgtataaacatataagtttttactttgagataaatgctcccaaatcgaattgatggaccatatagcaattgcttgttttgctttgtacaaaactgccaaactcttttccagggtggccatactattttatgttctcaccagcactgcacaaatgatccagtttctctgcatgttcacaaccatttggagttttcacagttttttattttagctgttctgatgggcgtgctgtgatatctcatggttttaatttgcatttctctggtggctaatgatgctgaacatcttttcatgtacttattggccatttataaatcatctttgatgaaatgtctgtccatgttttttggtcattttagtgatcattagtgggacttttttcttttctttggagtattgagaattctttatatagtctagatactagtcctagatactggtttgcaaatattttctcccagtctgtagcttgtcttttcgcccttttcacagttctttcgtggagcaaaagtttcacattttgatgaggtccagttaatcagttttttattgtattgattggcattatctttttcttttaaaagggcagattgaaattacatcttcaatcttcaaaaactgatgttatcatttttgttattgttattgtcagtggttgtttttctaatgcttcttaatgtacaggtacattaagattcttcatttgtaaactgggttttcacagtaaaccttctgaaataagttgacttttaaaaatgtacatattgctttgtaggtattaacaggaaagaaaattttttcttaaattataacaaaatgtgtacctattataatttttgcatttaaacagtatttttaggccagacagggtggctcatgcctgtaatcgcagcactttgggaggccaagacagggagattgcttgaggccaggagttcgaaaccagcctggccaatgtagcgaaaccctgtctctacaaaaaattaaaaaatcagtgaggcatggtggcgtgcgcctgtagtcccagctacttgggaggctgaggcacaagaaattgcttgaacccaggagttggaggttgcagtgagccaagatcgtgccactgcactttaacctgggcaacagagcgagactctgtctcagacaaacaaacaaacagtacctcattgttgtttaaactgttagcaaataactaacttgaagtactaattttatatgaaataaaaattaatatgtagtaaataatgtatgtaacattttctgacttcgttatttgttttcttataaattacgtgtcatgtgaattataaaattattactagacttgtaaaaatcattattcacctagtatatatgtgcagatgcatgtttctagttttttttgtttttgtttttgctttttttttgagacagagtctcgctctgtcaccaggctggagtgcagtggcacgatctcggctcactgcaacctctccctcccaggttcaagcgattctcctgcctcagcctcccaagtagctggggctgcaggagtgcgccaccacgcctagctggtttttttgtatttttaggagagacggggttttaccatgttggccaggatggtctcgatctcttgaccttgttatccacctgcctcggcctcccaaagtgctggcatttacaggcgtgagccacctcgcctggcccccccttttttttttttttttaaatttcactttaagttccgggatacaagtgcagaatgtgtaggttcattacataggtgtacgtgtgccatggtggtttactgcacctatcaacccatcatctaggttttaagccccacatgcattagctgtttgtcctaatgcgctccctcccctcaccttctacccctggactggccctggtgtgtgttgttcccctccctgtgtgcatgtgctctcattgttcaactcccacttatgagtgagaacatgtggtgtttggttttctgttcctgtgttagttttctgggtatgatggcttctagcttcatccatgtccctgcaaaggacgtgatctcattcctttttatggctgtgtagtattccatggtgtatatgtatcacattttatttatccagtctatcattgatgggcacttgggttgattccatgtgtttgctattataaatagtgcatgcttctggtttttgagaacgaaagagatggtttaaagtgaaacagggatgaagcttcgatgacctccaagattttaaaaaatagtcgatgtggttaagaatgaactttctgctttcatctaggccagtctggctctggagagcaggtgcctccacagcaacatccctgggggccctgaaatcagggttcagctaggctcctatgtgccctgagggtctgggttcccagtcctgttgccaagtggctttgtcccagatcctttcttctgggctgatgtgagtgcatatgtttgtgccaagcttctgttttatattgcacatataaataaaggaagataatttaccataaagaaataattatctgaatataaagccagtctttctagaacatttttgatttagataggcctcatgtgggtttcctgtgttgagatgtatgggttcctgtgttgagatgtatgtgttcccttctacttattcaattcgcaacttaaagcctgtacaatgactgttttccatgtcgatttggtgtaggagaaagaaaagagcaccagatcgtagacctagaaaaccctagatatagtctgtgttttgcctatactgggatatatggtccctagcaagttacagactccttggaagttagttttatttcctagaacatttaaggcatttgatttttatcattctctgcagttgctaaagctctttgattttatgatcttacaaagaggagcatttctattccaattttaaattccattgacaaaaatcaaagaactttagaagactgctgaagaaattttctaaaattattcactatgcttagatgagactgtctaatcttaatcaaccaagatctggctcaataccattaaggtctgtgagaatacagaagatataaataatacatgtttgttcccttaaggagcttggtttagttcagcagcaaaactaatgtacataaaaaaaattacctactgattgtattacaatcagctaaatagaatgtgggacatttcatagacaaaatcacccaacttctttaacagatcaatggtgtaaaaataaataaaaatggagaaatctattatacgttaaaagaacataagagacctgtcaaaaagcaaccatgaggggaggagttggggttaggggaaccttgggtttgaaacttgattcacagcaacaaattgtaaagagacatttgaggaaaattgaacatggcttggctgttagatgttattaagcatgctattaattttgttagatatgatcatggttattatggttaggtttaaataagaaaaaaactttatgtcatagtgatacattctgaagtatttacagggacaataatatgttaggtggggttgttttaaaatactccagaaaaaaattgtgggagtaagtgagacaagaacagcatattgttgttgatagttgttaaagatgagtgattggtacatgggaattcattgtacatattcttttattacttttaggtgtgtttgaaattttctgttgcaaaaaaaggcttagtttttttttttcctggttagtgaagcactaacttggtttgtatttgtgtgatatgaatagaacagtcaataaagctcaatgtagcatggcctaagttgcaagttacagcttctagaagggaccctctgtcaaatcctctcactgtacagattgagaaactgaagaccccaagattgcattgctagttagtagcagaccccctgttagaattaggtctcgtaatttccagattcctagtttgttctacttattcatcaaagttttcctttatccctttgttatgatgatctaaagaatttgtgaattttaaataaaattaatgtgtgcacacaatgcttactttgtcttgtttattttcctcagaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcaggtaccttgctaatttcagtgatgttaacattcttgtaaagttacctcaatgcagttatgacaaatttaaaactgagattaagagatgcatatggttttgaaactttgcttttatctgttgtttgttttctttttctgaagtagtgttggttactgctctgttattggcagattgaactacctttttttttttttttttttttttttttgagacagggtctcgctctgttgcccaggctggagtgcagtggcatgatctcggctcactgcaacttccacctcccgggctcaattgatcctcccacctcagccccctgagtagctgggactataggcatgtgctaccacacccagctaatttttgtatttttttttagagacagagttacgccatttgcccaggcttgtttggactacttttaatagtaatttgtgtggtgaatgttaacaaaaggacatactcaaaggacatactaaaaagaatcctaaaaaatacatattcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtggctttgatttgtgtttcccctgatgattagtgatattgaacattttttcatgtacttgttagcaatttatatgtcttcttttgaaaaatgtttatttaggtcatttgtctactttttaatgagattatttagttttttgctgttgagttgagttccttgtacattctatcagtccctagtcagatgaataatttgaaaatgttttctcccattcagcagatcgtctcttcactctgttgattgtttccttttctgtgcagaagctttttagtgtgtgtaaccctatttgcctatttttgcttttgttgtctgcagtattgaggtcttactcaaaaatcttggctcagatcaatgtcctgatatcttttcccaatgttttcttttagtagtttcatcgtttcaggtcttaaatttccatcacattttgatttggtttatgtatgtggtgagacataggggtctagtttcatttttctgcatataggtatccagttttcccatcaccacttattgaagagactgtcctttccccactgaatgttcaaaaatcacctttgtcgaaaatcaattggctgtaaatatatagatttatttctgaattctctattctgtttcattggttaatgtgtctgtttttatgtcagtatcatgctgttttagttgctatagctttgtagtatattttgaaattaggtggtgtgatgcctccagctttattcttttggctattggcttctgtggtttcatatgacttataggattgttttctctttatctgtgaagaatgtcattggtatttggataggcattacattgaatctgtagattgcttttggtagtatggccgttttcacagtattaattcttccagtccatgaacatgaaatgtgtttttttttttttttgacttgttcagtttctttcatcagtgtttcatagttttccttctagaaatttaataaactcacctccttgcgtttattaaacttactcttttttttgcagctattataaatgagattgattttctgctattttcttgtatatagaaacacaactggttttttaatgttaattttgtatcctgcaactattctgaattcatttatcaattctaagagttttcagtggagctttaagggttgtctatatatataagattatgctgtctacaaacaggaacagtttggcttcctcctttccaatttggatgtcctttattttcttctcttgcctaattgctctggctcagacttccattactatattgataacagtggtgagagtggacattcttgtcttgttctagttctttttttcttacttattttacctggtgatcaggaagtattgttgggaaacttttttttaattactgattcaatcttgttacttgtgattgatctgtccaggttttctattcttatttcaatcttggtaagttgtatgtgtccagggatttattaattatcattcggttttcccatttattggcatatagtttattgtaatggtttctaatgattctttgtatttttgtggtatcagttataacgtctccttttttgtttctgattttatttggatattttttccttgtctagttaatggattgatgattttatctttccaagaaaccaactgttcattttgttgatatatttttattttatttttttatttttttattttttgagacggagtctcacttttttccccaggctggagtgcagtggtgcaatctcggctcactgcaagctccgtctcctggattcacgccattctcctgcctcagcctccggaatagctgggactacaggtacctgccaccacgcctggctaatttttttgtgtttttagtagagacggggtttcaccgtgttagccaggatggtctcaatctcttgaccttgtgatctgtccgcctcggcctcccaaagtgctgggattatagacataagccaccgtgcctggcctgattctttgtatttttttagtctcaattttgtttatttctgctctgatcttcattatttcttttcttctactaatttggggtttggttcgttcttgctttttcctgattcgttgaggtgcattgttaggttgtttatctttctactttttctatgtagacatttattgctataaacttccgtcttaatattgctttagctgtatcccatagtatttggtatgttgtgtttttctattttcagttgtttcagagagcttttaaacttcatttttaatttcttcattgactcattggttgttcagaagcaagttgtttaatttttatgtgtttgtacagtttctaaagttccccttgtgattgatctctagtttcattctgttgtgttcagaagagatacttgatatgatctctgtttttgaacatctgttgataattgttttatagcctaatatgtggtctatcctggagaatgtttcatgtgctaatgaaaagaatgtgtattctgccacagctgttggatgaaatgttctgtaaatgtctgttagatctatttggtctaaagtatagttctaatccagtgtttcttgattttctgtctagattatctgtccagtgctgagaatgggctgttgaagtctccaaccgttactttattggagttgatctctctctttagatctaatagtatttgctttatgtatctgggtgctctggtgttcggtgcatatagatttagaattgttatatccctttgctgaatggaacattttatcactatatagtgatcttttttgtctcttttcacagtttttttttggagacagggtcttgctctgtcacccaggcttgagtgcagtggcatgatctcggctcactgcaacctgcgcctcccgggttcaagcgattctcctgcctcagcctccctagtagctgggactacaggcatgtaccaccatgcccaactaatttttgtatttttaatagagacggggttttgccatgttggtcaggctggtcttgaactcctgacctcaggtgatctgcccgcctcggcctcccaaagtgctggcattacaaaatgagccactgtgcctggccctcttttcacagtttttgacttaaaatctgttttatctgatacaggtatagctagtcttgcttactttgtttctggttgagtgaaatatcttcttctgttcctttacttttagtctatatatgtctttagaggtaaaatgattttcttgtaagcagcatataggtggatgtgtcatgtgttttgggaggccgagccgggagttttgcttgagcaggagtgcaagaccaacctaggcaacatagtgagatcccatttctacaaataaatgaatacataagtaatttaaaagctacagagggagaagagattaaaataggcccattcagccaggttgtgtctttttaagtagggggatttcattggtgtatattcatgattgatatcagtaggtgaggacttcctcttatcattttgataattattttctggttttttttttttttttttttcttcagacggactcttgctctgtagcccaggctcgagtgcagtggtgcaatcttggctcaccacaagctccgcctcctgggttcacgccattctcctgcctcaggctccctagtagctgggactacaggcgcctgccaccacgcccggctaattttttgtgtttttagtagagatggggtttcactgtgttagccaggatggtttcgatctcctgacctcgtgatctgcctgcctcggcctcccaaagtgctgggattacaggcgtgagccactgcacccggctgtttttgttttgttttgttttgtttttgcatattcttcttactttttttctctcatttagcattgtggtttggtagttttctgtagtggtaacatttgactcttctttttctcatttgtatatcacagtggcctgtattgtacagctttgtggtaatggcggtgttggtgtacgtaggttgttagcattataattctgtgtgttttcacaatggtgattattggttttttttgcttccaggtgcaggaatcccttgagtatttcttgtagggtcagtctagtggtgatgaatttcctatttttgcttgtgtgggaaagactttatttgtccctcatttctgaaggttagttttgctgggtatagactcttggctgctaatttgtaaactatccttcagaaatgagggacaaataaagtcttatagattcttggctgccaatttgttttttctttcagtactttgaacatattatcccattctctccatgcctgtgaaatttctgctgagaaatctgctgctagtctaatagatgctcccttatatgtgacttgatactttcctcttgctgttttttttagaattctctatgtccttgacttttgacaatttgactataaatcctcaaggaagacttccattttcagctattattttaataaataggttttcttttttttttctttcttttttctttctttttattttgagacagagtcttaacttcatcacccaggctggagtgcagtggtacagtttgagctcactgcaacctctgccttccaagttcaagtgattcttgtgcctcaacctcctgagtagctggtattacagggtgcgtgccaccatgcccagctagtttttttcgtatttttagtagagacgggggtttcaagctcctgacaagtgatccacctgctttggcctcccaaagtgttgggattacaggtgtgagccagtgcaccccagccaaaacaaaggttttctgtgcctttttaaatctcttctccttctgtagcttttaagtgattgattgattggttgcagagatgggctttcactacattgcctaggttgatcttgaactcctgggctcaagtgatcctcccacctcagcctcccaaagttctggcattacaggcatgagttactgcacccaaccttctgcagctcttataatatgaaaatttattcacttggtggtgtcccataagtcttatagactttcttcctttttttttccttcccctaaatgagtaatttcaaacattctatcttgaagttcagagattttcttttgcttgatcaagtctgctgttgaagctgtctattatatatttttattttattcactgaattcttaagccacaggatttttgtttctctttaatgatatttattacttttttgaatttctcattcatatgaattgttttcctagtttcattgaattttttatctatattttcttgtgtcttttccctcaaatcattattttgaattcctttttaggcaatttattgatttccttttctttgggacctgttgctagagagttaattatgttcctttggtggtgtcatatatatttgttttttcatgtttcatgagtccctgtgttcatgtctgtgtgcctgtctggtggaacagtcgtctcatctaaattttctagagtgactttcatggagatatactctcacctgtagctaggtcttagtgtgctggtcgggaagggtgtggtgcttctttttccaggtaggtgcagtggtatagtctccatgcagcttcttcagctgtattcaacatcatcaataactgtaggcacctcagtggtctgtgctgtagaagtttgtggtaatggatgctggtggtgtaggttgttaatgtcctcagtggcaacgccttttggggccctcctattctcatttttcccataatggtgagacttagccaaggggatccctcttggtgtcaggtctgacatggcctacgagcacctgctgcggtgctggcttccagttgcggatgcgtagagtaactgtggggctggagttctaggctcaggatctcacaaacctattatggtacttgtgtcttgcagtgcatgtttactgtctggcaagattgaatgtaggttgcctatagcaccaggatctgtgactctgggttactccctagcaccttgggcccagcgggccagtctgtagctgggattatacactttgtgggcagggtatagcccgggcttgggtccagggaagaggtgctctggagatttgagcccagagcacagtgcatggcagtaatttcggagcctgagccaataggactcagtgacgagttgggtcaccggggatggaggtggtggtgagtctagaccctgggatggtggggcttggtggtatcccaaagtctgtgagaccaggtgcagcaacagcaagtacctcagaatgttcaagcacagctgtcatttgggccctagggggcagggaacagcacagtgatgactactgtggggagaagggtgtctcagcagctcagactctagggggctagtctagctccagggaagcagggtgctagagttgtttggcctgtaggcatagtatcccagttcagccactgatatttccctgggatgtgagttactgtgttggcttagccctggaatgcacagctcctcaacttggccaaggcattattacctgaaggagcaatgtgctgctttatctcataccctgcagggtgtgacttttctgtgtaggcccaggcactgtttctttgggacacacggctccaccagtgcactgtttactcaggagggcggtgtgcggtttcagttttttgaagttgtataccagtaacatacttatcatttaagtgatgagacttaggatttaaaaattggtactatgtctaataatgtggatctaatctaatatctaatagtatatagggaataactagtgatttactttgtttaatcacttaatgtttcctctagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatggggtaagcatttaactatatgttttaaaatttaattttagaaaacttgtttttcagaagaattattgatgcttaaagctacatagttaaagtaattaatcttggtctctgtttaagtaatattccctcacaaaaccatgaatatattatgtggcattcaattagctactaatttgtctttcatctttccatgtacatgtggttgatattctctagagaaacatagttgtacaactcggcatgtgatttgtctataatatttaagttttataaaataatatttcagtagcctaaataaaagaactctttggtcatcttctctgaatatcaaaccttcaaagcttttgtggctgaatatcactttgctctacaggaaaaaaatttaatttttctttctttatagaagagccgtaataaccaacataaaatcgatcctcatctaatctcttgctctgcttttatttcatttttttaagttgccattgctttaaaagatttactatctttcttggatttactgtttttcaaattttttcaaatgtatttatgtaattcagttttgatactcatctctgtttgtttttcactttcatttccatttaaatattttgacattggaagctcatacttgcctgtctgttactataaaaaataggtttgactgtatagggattaaacaatttgtcttttatttttcttctagcaatgtgcaggttctatctgtgagaaatatggcttagaggagtgtacgtgtgccagttctgatggcaaagatgataaagaattatgccatgtatgctgtatgaagaaaagtaaggcttttaaaaacacaagagtataaaatttgcctcaaactattattttctcctaaattttaagtgtaaaactttgacctacagtttggccagataatttccagctaaatctgtcctcttgaggagattataaatgtaacgtagcattgtgtctctattattatggtctctacaatgttttaaaaatgataaactagacaaaacgttgccagctttacagcagtaatttacataaacactgttagactttaagtcatcgtggacactgagtcaagacttgctggttgcttgtttacattgtaacatttaatatgaattactgatggcgttacccagcctaactagagaaggtctgtataacatgttatggtaatgatttcagttttttttccctctttgtatttgcacaactggaaatctgatcttcaacttatatttgaatctgaccttcagcttatatttggcatttcttttccagtggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggtaagtatgttttttatttacaaagaaaacttaaagtggtttgatcttaattttacttggccagaagtcatcaaagttacgagaaaacaacttaactatttatattagaattactttatatgaagatttttaaagttctaatatttctggttattatttccttctgaagtgatcagaatcatgtgtatcattcatagattgcttagtaggtgatgggagtcattctgttttaccgtgctccttagttcatctcctggatgggttacttcttttggtgcatattattagggcattttcatgggacttaaaaaacatttttttttgttgtttttcaagacaacttatttgcccaaatcgtggactaattggtgatttttcctgatctttcagtataatctctgggtctttatcttgtttgtaataggaaatgttgaacagaataagatcagatacacagccttttgtagatctactaatgattatggatgttcatccagcagtaatccactgaacgcttatttttaagcccacatatctccaagttgtacaaacacagaattacctgatgttttcttaaaagattgtcaagattgactatctcaacttaagtgttcatgctttaaaagtgataacattaaaatatctataggaagcttgcaaatgatatatttgagaatgtgctataattgaactgaatgtagtttgctttggaaattgacttataactcacattcccctttctcaaattagtgtgtatgtgtgtgtgtgtgtatgtatgtatgtgtgtgttcagaactatggatgccttaaagcacaaaagatgttgtttgtgtgggatgtcagccttttttgtactcttctaataacattctagagtaaaaattttatagttaaccccagcatttaaaatgatgtttaccgttcctaggacacattaggatatgtggtttttagatatgtaatgatcatggagtagaaggattgttgaaattggatttaggagatctacctaggtttcaaaccaaatacttgagcagttgacttaacttaggtttccttaaaacatgttactctttttttaaattcctgtgcttgttgcgtggtaagttctagtaaatacctgtcaaactgaagttgtcttctggtaccatggtgcagtggaaagagcacatgtttgagaatcacgtaaggattcaaataatctttctggtgtttatcaattctgtgacttcaagcagcttacctttcttggcccttctttattttcaactcagctatttttttttctgattgtctctaataagaaaagttgaaatttggtatacttgtctgctgtagaagacagtgtatacagaaaacgaaaggagatctcagaattacattctactgagtatatattgtgctagatattttagatttttggggtactaagtcatatctaaacatagcatttttttacttttctctgttatctctaattttcactcattacattatttagaatttcaaaagcccatttattttcactttaaaaatatttaatagacatgatcttttaagtatttttaagaccttttctccccatattttagatgtgaggattaatgaaatgtttcacaatgaattggcaacatgaagtcctttcttgtgctctggaactaattaatcagacactttcaagttcatagacgttgactttaagtgtgtgtgggatagaacatgcctttattttatatcattgttgacaggcatatgccagtctttcgaatagcatgctcataatgtgtgaagagtaccgctaggctgttggtgcatttgtgggcattaaccacatcaagcagtaagataataaacatctggtctttacaagttacttgtctcatttgcttatgtgcatagtttacttgcataccgggatttatcatgttagggaagtgcccttccagttagtaatacagattatcaggatgctcttgtgtaagaagctgtgaaagaagtgaggggttagtttcactactttcctttccagtggtgcctggtggcgttttgtcttctttctgtgttacactatggcagcttttctcctcatgcagggtagagtaggaagaaccttaacaatttagaacttcagggcatgggttattgactgctgctactggtaccacggaagtgatactttcttttctgtgttgacaactatgttttgatttttccaaatacatttactgtatttgctgagtgcctactgtgtgtttggacaggataaaatgataaacatcctttggatttatcaaagagtcatctagttcttgaaacatttaagagcattcatcagtaaatctgttgagaccttatttcagcatctccttttctttaattagggattgagggcattggtaattcatttccagtttcttctatagttgatgtgttctgattttctgtatctttcatgttaggtttgacattgtagaaaactacctcttaccttgacttttattgttcaaatgtattgttgtgtttcccctccttttaaaaatcattgcctgatgattttgtggcttttttctttttaacttgttcagatttatcaggagtttgtatttttgtattgctaatttatcaagagtcaaacacattctcattttaaaattagtttctgctgtcatattttgctataattttatgcatctaagtagtaagtatctggtattctttatgaatgaaagatttagagcactgtttcccaaatgcttaacagaacactagttccattagatgttctgggccttcaatggtcaaatgaatctggaaaactactccatactatagacctttcttggagatttgtgagaagacctgcaataaataaatcgtttaaacttcattttccaaacttacctaaccctagaaacttttatgatgaaaagactaagtcctaaatatccttagatgtcatttggaaaaatattgattaatagcagtagttctcaatcctgattgtataccagaatcaccctagggtttggactaattaaatcagaatctcttgggtttaagtatctgggtcttttaaaactctccagttaattctgatgaggagccagggttaagaaccactcatctagaacaggggttggcaaactatggcccatgggccaaatccagcccgtgcctatttctgtatggctcagaagctaagaacggtttttacatttttaaatgattgaaaaaaatttaaaaattatcaaaacattcttttaaaaatcatatgaaattcaaatttcagtattgataaataacattttataggaacatggccacacccatttgtttacacattgtctttggctgcttttgcactttgagtagctgcaacagtgactgtatggccccacaaaacctcaaatgtttatctgggcttttatgggaaatatttgccaactcctgatcgagagcggtgatctcaaagtgtaggcctgagaagcagcatcagcatcacctgggaacttcatagaaatgcaaattcttacgttccattccagacccactgagtcagtaggtgatggtgcgtgctaatagtttgtctgccatttttttcagtctctgtgatatgtgactcctttttaaaaagacttgtaacagaaattttccattttatcatcttgatatgttgaaaatagaaggtggtttcattgctttgtggaacagaccacatagcatagcacttaatgaaactttaacaacaaagatataatgatattgtaaggttttcagcatatagtgaggacacagtatacatttgctagatgaatgaagcagatttctcaaatgtaataatttatatggaaaagagtaaaacttgtgcatattaactttgaaactggaatgttttcaggttcctgttagtggtattttatcttacttgcccaggttgagcttaaagtaaccaaaagtttagtagcaagttgctttctgcttggcagatcgctgttgctgctgctgctagtggtggtgggagtttgaaggataggaggagtatatattcaaagcccagactatagtattatgtcttctgaaaaattgaaaggaaactttctgcccctatagggatgacataatcagtatcatggcaaggagctctgggccccacatggtcttgtgacccatgggaagtccagaatgcatttgctgagagtgagcgttgttgaacactgcagtattcattgaaaggatcatatggttgactttctggaggtctttaagaacagtagattatcttatgtctgaagagacttgagtgcatgtcttccctgtcctcgctcatgcacttttttttagatgatacttgctttgtcattttgttaccatataggttctttttgtttatatttagattatcaaattaaatactattgtaattaatacataataaattagactatttaattttgactttttactttattattggctatgtttaagtgcctgtattgaacatcatctctctttttcttatgtagaattattttctgagttgagaaacttcttgagtttttgaaaaatggttggatgtcttctctttgtccctaaagttttgcttaacacccttgtctctggggtataagaccctggcactcagtttacgctcagtaaatgttcattgaatgaatgacagctcccctttctttcagactaacaggtgggcaatttgtgatcttttcttttgagagaaatgcatattttacatttactaccctagttagtattcctttccctgattttatagtatatttaaaggggatagcatgtaatttagcatttaactcattctttttttaaaaaggaaaactataaaggtggccgtacttactaatattttcagatgcactatttattttgtttagtttttcttactgtcttttgtctattgccatgttccatttccccacacgctaaattcacaaaagctactatcattggcactaaaacatctcaagcattgggcttgtgagatacatagttacctgaaaaaatttagaagaaagccaggaacactgtgctagaaggaactggaagttctgaagggcttgagtgccatattttattatacatctgttgatctaaactgcgactaggttctttttacctttgttttctacagttttaaccactactaaatctgggctttctgtctccaatctgcctctcttactgccatagcgtgtactcgtatggctctttatttaaatctataggccaggtacggtagcttatacctttaatcttagcactttgggaggttgaggagggaaaattgctggagactagcagttgaagaccaacctggacaatctagcaagacctgtgtgtgcaaataaataaataaatgaattcgcagggtgtggcggcatgtaccttgtagtcccagctactcaggaggatcaccacagcccaggagggcaaggctgcagtgagccgtgattgcaccactgcattccagcttgggcaacagagcaagatcctgtctcttaaaagagaaaaaaaagagtgtgtaggtactaaaaagactatcattaaatatatccaaaccagttttactgtcctatctctgttgtaacggccttgtcacattatttgtatgtgttaggcaatctggaagtaataaatgagctgttagttatgtttcaaggtcaatatttaaataatgacttacttgtaataactagttcaacaggtattttgtttgttgggtaggtactgaggtaataggatataagtccagggagctcacaggtcagtttgggatagagaagacaggccagagaaacatatcttcagtctgtgtgctgttttcacagaactgggagaacctattaggaaaagcctttaaggagataacgccagagctaagttctttgtttatttttatttttgaaatggagtctcactcagccacctaggctggagtgcagtggcgtaatctcggctcactgcaaccaccgtctcccaggttcaagcggttctcctgtctcagcctcctgagtagctgggattacaggcacctgccatcatgcttggccaatttttgtattttagcacagatggggtttcaccatgttggccaggctggtcttgaacacctgacctcaggtgatccacccgccccggcttcccacagtgctaggattacagacatgagccaccgtgcccggccaagctaagttcttaagaattagtagaagtagagagtacagaaatattttatggggacagagcatgtgaaaaagtcacagaagtatgaattttgcaaaacatttttttctactttttttcttttgaaaagtttgattattctttttttagttgacaaagtaatacattctaaagtaggccttttttttttttttttttttttttaaccctggacccccaatctttctaggatggatttcttgtgtattcttcgaaactgtctataccactgtaaggatatttactttttaaaaaggtggaatcatatacactttgctgtactttatcgtgtgctcaagtttttgcttttgctttttttcctctctcctacatagtggtctatcttggaaatctttggtgggaagcattcgaagaagggtttgacatgaaggagtaacatggtcagttccatattttaggtagccataacactgatggccatattttcataaaaatgaaagtaaagatgaaggaaggaaatatattgaagatgataatgactttaggaagagaagtgtgtctcctgtacccaacttgcccatcatcgtgagaaagctagtaggaaaactcttaagcctttgtactcatggattggctcacattagaggtgttaccacttccccagcaggtgtttggaaatgtacggttgttgtcagagtaactgaaggggctctactggcatttgatggttgggggccagggatgctaaactttctgcattactcaaaatggtcgtgtactgctttgacagactgagggtggccttctaccctgtcttgcgataagtagcaggtctgttatttgaggatgaataaaaacaaaaaacaataggagtctatggaatacctatataataaaggaatgggaacatcatcctaaagactaacaaggagagcagagctctgaacacaatttttatagaaaacaaaataaaacttaaaaaaaaatctggcagtctcaagaagtggcttttagaaagtagattgtaaagttttaaattccaagccagattcagccctgtcagcatgttttgtgtattctacacattgttttaagaaatttctcacaagtttgccagcatttaaaaatagattttaaataaaaattcggatatattgcttctcttgaaaaatcagatctttaagcagtaaggttgaattgcattccaccttaccttccatgtaagcttttgagtttgccgtccctgcaataacaagcaatgtgagggacaaccatgatacagtttttacagattgaacaataaacatgaaaataaagagaagaaaggtgtctgtgggactcttctgtatagagatctaatctgagaattaaataagactgagaaatgacactcaagtgtaaatcattctaagtttgattttaaaattgaatatatatatgaatatgtgtgtgtgtgcatatatatgtacgtatgtatatatctctttcccttttttattccctctccttttttgaagcagttaattcctaaagccattaggtgagcccaagcaaggtaggcatccacgccaaagttggggagctatagtggcacagagcagagtgttggaagctgaccaggttcagaaggtgtgggatggggaacactaccagtatggggtttcagagcccaagcagggtgagaattgcacccctgtggaggagtgactggcatgggatgtcaagagtgcaagtaggatgaggaaggtgtctacataggaagggtaggactaaaagaaaccagggctctttggcaggttccaaggctggggtagggaaagaacaggataaatctggaacttcttgttgggccagaaagtaagaaagtgctcaaagaatgatgaggacatgtccaaaaaacacaataatgtcagtaattgattatatatttataaaaaataggaaaccatgagggaataaataaatgaatacattgaaagtttgatgaagaacaggatatttacatacttccaaattaggtccctacaaaattttcattgtctacaaaagagaaacaagaatcatggtaaaatttggcagataacaccttaatccagtgatcaagttaacatcagcagtaatgaaataaaaatcacgtgttacttgataggatgcagcgagaacacagcatctgtgatattcttaccaaagatgtgtgacctgaatttgatcacaaagaaacaccagaggaacccaaattgaaggacattcccatgcaaaataactgccctgtaatcttcaaaagtatcaaggtcataaaagccaaggaaacactggaatttttccaaatcaaaggagagaaaagaaacatggtggctaaatatagcacacgattctgaactggatagtattgggacaaatggcaaaacctgaatggggtctgaggattaaatgttagtaatgtatcagccctgatttcctgattttgatgattgtcttgttatctaggaaaccacccttatattgtagaaattatatgctaaaatgttcaagagtaacagcatggtgctagcaacttactctgaggtgcttccagatttttaaaagtttttcttttttgtttttgtttgtttgtttatttgaggtggagtctcactctgttgcccaggctggagtgcagtggcacaatctcggctcactgtaacctctgcctcccgggttcaagcgattctcccccctcagcctccttaatagtggaattacaggcacccaccatcatgcctggctaatttttgtatttttagtagagacggggtttcaccatgtgggcctggctagtctcgaactcctgacctcaggtgatccacccgccccggcctcccaaagtgctgggagccacctgggagccaccgtgcccggcctcaggtttttaaaaggtacttggaacttttgaattgtacttgcaacttttctttaagtttgagactctttcaaaataaaacaaatgtttagaaagtaggaaaggctttgtgtacacaaagaaaaagtggcttgggatattttgctacaacatgccttttaattttagcattactctcattaatgctaaaattagcattagtattactttaattatataaacactgctggaaaaactaaacagtgtagaagtagtacccagtttgttgtaagtccctaagtcatagacagtcttcttaaatgggagttttgctggaaactattagtagtaattatatatgttacagtaacctgtgttaaataaatgtaaaggttcagttttgaagctgtaaatattttgtatgatgtttattagtacatgtggtcttaaaacaaagtttgaatatttggaattgcaaaatataatttaagactagacacagtaattttcctataaatttatcaataatttttgaaggtttttctgtttggctaattgatttgtttaatataggtcaggttaaaatagaagttttggtttcttctaagacgggatgaactttgcctgctgctaaaatatgtatcttcttccacttttcatatttaaaaagatagcctataaactaatgaatacaataaagatattatatataatgtaatgaaaactgatgtatataaaaagtaatttcataactagtccgagtctcaaattccaaatgaaataaaagaggaaaagggtgtctcaaagagatagaatttcagtcttaactttgataattagaaagcaatgtaggttaaagagtaatttttaaatgtattcactagtagaatttaaagcaagttacatgctttctaagccatggaaagtataaacgcaatcaaaacatagtctataagagtaagaggagatccttttgtagttcataagtgtgatgattgggtttgcacactcatatgtgagatgtgccttcctcaaaccttgttagggcattggcacattatccatttgagggagaaaaaagagtaaggggaaaaaacaaaggcaatatttaaaccagaaaatatttaataacatgggaaaatgcaatataactatatgcaagatgaccccagttttgtatttgtgttcatgtgtatgacaaatgttgttatatgtaaagagactaaaaaaaatcagattgagcggtttcctctatgagatgaaattatgggtgatttccattttctcctttaaacttttttttatatttaaataatatatatgtgcaaatatctaacatatgtatacaactcctaaacaaatgttctttaaaaattacaatatactgtgttctattctatgttttatatactgtaaaagatactctaaaatattttgtagtttttttttttcagtggaaaaatctgtttatttctaggctcattggtgggcagtattacttatgggaattgctctgatcatgctaatggctggatttattaagatatgcagtgttcatactccaagtagtaatccaaagttgcctcctcctaaaccacttccaggtaagaatatttgagcaagatacatatttatgtaactcagaattgtttagcaggtagaattgaattataaatgagtctgtagtaactaatgttacagtactttctccgtaagaatgggattattggatgaatgatttagttgatatttgtgtgctttttgtcaatccaatctggccagtgactgctaagttaatgctaatttatctgagtgtctgaaaatatttagaactagaaattttaaattttgcttggtatttgttttcttgtttttttttttttaaatatattctaacatattcccttgccatgattatggtgaactactttaaaattgttgatctttctattctaatagttgtgcttctcatattgttgtccttcattcctccttccttcccttccatcttccctccctcccgccctcccttccttctttttcttttttctttctctcactgtgttgcccaggctggacttactcctgagctcaagcaatcctccccactttagcctcctaagtagctgggactataggcgcgtgcactgcacccagctctcttatcgtttttagtgtttgtgctcttgaaatattttctggcacataagcttattttcccccagggtgatgcttgtggggacatacagatcccagtctgtgggaaagtcttagagtagaggattcattcatcaaataagcacagtcaagtattctccattcctgaaaacaactctttagttctggtctccaccttttacctctcagggagacatagcatgaggaagaaccctctttagatgagctgtgggcattggaaggagaaaaggacaggaaataaacccttcgtattgtttagttccctctgtttatccctccccttctccaaggtattcgtagctattctctacaggtgtgaggacagacattgtctcagggcagcagcaggggagagccagaactaaatgacagcagttccctctcctgccgctctcagacttctcataagatgtcttgcctcaggcaaatccactaccttatacaaagtagttcaaaactaggtttcttacactttttctctgttttccctcagttgttcacctgcatttacctgtctggggcaagatggcccagtagtcatgctaggacagtatcttagtgagagttagaggaaatttgatttttatatcattgcttttcttaagttcacaatgttagttagcactctggaacttatgttagtatttaaggaagttctaagggccacatgacactttttagatgctgttaccaattgtggtcttattcagtgaaacattttatgtgtatgttggtttcattttaagtgaatagcacctttaaaaacttagaaaactagctgtcatttattgaaccctcacaaaaagtgttaaacatttttatatgaattatataatctttacaacaggctatatacgttaattatcatccttgttttacagtgtaggcatctgagtctcaggttaaggcatttgctcaaagacacttagtaattccctcatatggattctgtccagaatctgtgatattaatctggattaatctaatacttgtggctgctgagcactgaattgttgctagtttccattgaaatgtgctgttttaattaacatacataccagactttgaagatttagtataaaaaaagaaatattttgttagtaatttttgtattgattatatattgaaatgataacactttggctatattaatttaaataaaataaaaaatattattaaaattatttcaccttttaaaccttttttattgtggctatcagaagattttaaattacattgatggcccatattattggacagcactgaactaaaacctttcttattgaaacagcagctttgcttttaaagattaaaaagctcatgataaataaatctgctttgcttttatttgtggctcacaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggatttagcattccctgtagtgtcaagcaatgtcatgcagtttggggaagcatttatttaaggaaatgacaactttctctgatcagtcttgttttgtgaggtgtcttcaacactttatgctttgggtacttcgtgtttgtcacagtcttaggatagtgaaatctgatttgtccaagcggagcaaactactcgaccctcagtccttgtatttgtccctgtagtaagacctaattattattatttcttaaagatgggattggtgtccttggcaactatgaaatttcggggcttgtgcatgagaaggcatttcttattaagtatttctaattgaaggtatcagagtgtcaagcattacaaacctggacagttcacctggaggagtacaagaagagatattcattatccatatttaaagggtcaaggtttcccaaaaccagggtgcaagccagatgtagttttaaagcagctgccagggacagttcatctttagagaagtcactaaagttgtaagaaattttagtttccccaaaaccactttcaacttcttagaaactagaaagacaattggtttgccccacagaggacaacttcagtttcagcatctctcatgttgtgttcttgattaaaaacaacttccatttgatatacttttccgtttattaccagtttagttttttcactattgtttctgtattcaactctttatatgattaggatagaaatttagcccttctgttttatattactatattgtttgtgtgtcttagatatatacatgtatgtactattttcagtagaaattcatgtattttataattggtaagttcttcagagcatctcttctataaaaagcaacaggatgctaggtaaaacggagcattgagcaaaatactgattagtttttgctttttcctgaaatctacactaaagtgatagggtgtggggtaatccaacaaggacaaggtgaattgaacaagaacgaaatctggaagcagatgaaggagtactattgattgggcagacccagggaagtcaaatcctaaaccagcagtgggaacacaacagaatggtgtagtttgcactggtaagatttgggtacctggcagggctgggtgcggtggctcacacctgtaatcccagcactttgggaggccaaggcgggtggatcacttgaggtcaggagttcgagaccaccctggccaacatggtgaaaccccgtctctactaaaaatacagctgggcgtggtggcacatgcttgtaatcccagctactcgggaggcagaggcaggagatttgcttgaacccgggaggcagaggcaggagatttgcttgaacccaggaggcagaggctgcagtgagccgcgattgcgccattgcactccagcctgggtgacagagcgagactctgtctcaaaaaaaaaaaaaaaaaaaaaaaatttgagtacctggcctttgttactttttttctatgtgtgtgacaaaaacataatatgcacacttttgtaacccacctttctcatttaatggtacattgataatgtatatcacattaactactctaaatatttctgtggatgtatgtttttttttttcttaaccaatttcccattgtttggacatgtaggttccacattgtttattattttaaacaattctaaagaattttaaacaattcttaggaaaatcctcagcctaataatgaaattaattcctaaaagtggaattgttggggtaaaggttttttgagggacattgataaaaattatggtactgtctcccagatagatgtaccaagttatactaccacgatttaatatatatatatatatatattaaatcagagtcccatccttagaaatccacatatatgcagccacatgaatgtattagaaacaataatagaagactcatgcttaattcagttgattagctttagacataattcaaatgcaagtcaaattgagtgccctaattgtggtctcttaagtaccatttttcttcaagggaaccagactcctttggataaatcactaattccacctgtaagaaagaaatgtacaagaagaacctaggaaacattgttttgtaccagatcagaaagattcaggaggcaccttagaagttaccactggccaaggctgagataactttagcatcagcaaggataatatctgcaagagattgaaactcatagtattgtatttaactctgtgagttaatgatggtagtggacagaattatagttacctttgggatacgcttttaaagaaattccaggtaataagagaaatgatagaattaggatatcaccattttacccccccaacaatttatggatctagacaataatcgccagtgactgctaacctcacaaagtgagagcaatcagattttgtgcctcctaatggaagtacatataccacctatgaagcagttctgccaaaagtcacatctcatcatgatgaagcctcctgatctaactaccccttcattagaaatacaggggacagagggacaaataatatacaagggactcaatcagcaaaatccagactctggaaaactacaagacatatggtcctgcttcaacaacagaaatgcaaagagaaaagacaacgatgggttaaaggagacttaagagctacatctatcaagacaatttatggacttatttggatactgatttgaacaaactgttgagaccattggaaaaatgtgaaaagtggatatttgatattaaggtttttaattatttttaggtgtgataatggtattgttacattttttaaaggaccccttttagagatgcaaattgaaacacttaaaaaatgaaatgatacgatgtataagtttttgcttaaaaataaggattgaagttggctggtgtgtgtggatatagttgaaacaagattggctgtgagttgataattattgaagctgggtgatgggcacttggggatttattatactattttctctacctgtgtttatatttgaaatttttcatagaagttttaaaatgtggccagttgtgatggctcatacctgtaatcccaacactttgggaggccaaggtgggaggatcacttgagctcaggagttagagaccagcctgggcaaaatagtgagactccatctcaaagaaaaaaaaaaagtgttttaaatgtgaatcaaattcctatagaagctgattcattactgtttttattttagcagtaattcatgataatgacctgtattcataatgattttcataatgattgttttagtggaattaaacttgaaccagtcaagctaacataattatattctgctccagttacaatgaataattaattgatttcaactgctagggtgaactcttgaagctatcagtcatccagcaatcttagcaagcaggccattgggtccctgtttgctctgtctctctctctctctctcactgttgaagggcttagctaactacttaagtaaaatatttgttctctgttaaacatgtcaaggagtatggtcagcttatccacattaagcctgtgtgtcccacgttggagtaaatgttaagtagctcactacaataaactagattcttctgccctctcttgtttaaatgatcatgttccctggaggtggaaatagatctttaaaaagatattctgtagttgtttgttctcagtgtaaaaaaatgagaataatttgataagagtgtaggttgtcttatataaaaagtggttccatttgcatgaattttagaaaaatcattttggaaaaatgaaggctatgtggttatactgaacacattaagcaattttattctttattttaaatgaatattttattatcgttttcttcccttgccctttgggtatgggagttagcctttgtgtttctaaatacaacaggccggtttttataaattaaggtgtcaatatattcttcattatttagttttgtgattgtggttagttttcatttttcttaagtatctgctagtagcatctgtaattaagtgaagtgacctgttaaccattttcctctttctcctcctttcctcctccttgaaacatatcagagcatgtttgaaattctttggcttttatggtatgcatttgctgatatgcattgaccagttaccttactcacagatacttcttaggcacttgattgtgccagggccttggctagatgataagaatacagtagtgaacttaacagtttccctgccctggtgaagcgtatggtcttgtaggtgagatagatatcagataatcatgtgaataaatgtacaattccagctgtgatacatgctgaggaggaggtttttggtgatccaagagctgatcatgcagagataggactgagaaaggagggtgggacgttgtcacagctgataatgcagagataggactgagaaaggagggtgggacatcaggaaggtcagagaattccttatgaaagtgatgcttgagtcaaaatatgatggatgaagagagtttaaatagattacatagaatttttaataatgtcgattggttatatactgggcactgatagctgatttttctttggggaaaggtatgtcagcctagtcattcagattcctttatttttttaaatgttttttcattttttgctttgcattgcattcatttgctgaagagctggcttgtactttggcaggtgtcatacttggttattctccttaggatattggcccaacaatctgggagttgtgaaaggcgcttcgcttttcagacctgggcgtctgtatcatgactatcataaatttaggattaagacacctagcctcctaccaggatgaatgaggtgtccatgtgacctgctgtgccctggaattttatacatctttctctcatagcacacaccatattacaatataatcctgcctcatctaagccaaactttcgagagaatcatttacactcagtggctacttcagctcccattcacttatcaacctgctgcaatttttcacagcccccaaaggactgcagtctgtgccttcagggagctgagggtctagcggaaggaaagaaaccagcagttacagtacagaggggtttgtgttggaaactctacaaacacaggatgccctggtagctcagaggaagtgcatatcgagcatggtaggtaggtagtgggaagagccaagatgacttcccagaggagaaaagctggacctgagttttggagtttcggtaaaagtttgctctaactagtccaagctgctgtcacaagcttttagaaatgatgtaaccatggggcagttgactgtcgtcatgttctttgctattttcatgactctggatgtgcttttcctattccctggattgccctttccctcgattcctctgcaggactgggctttattaatctccatttccttgagcttggctatagtaggtgttcaataaacatttgttttgttgtgtgctttgtaaataggcaatgaagctgatttcacaagataggcacaaaagttagtttcattacaacacattaccaacagctgtatttttaacttttaacatatctcattctaaatcctgtggcagcacaacctccttccgtcatacctggagataaattttctttcaaaatctaatatgcactgtatttatagaatatgaaacataccgaccatgttttgcaaaaatgggaaaggcataacttagctttggggcatgtaagtaacaactcctgataggagaagaaatgtattcagaaagctcaaattagaaataaaatgggagactctagatttgtgtttgtggatgaatgttttctttagctaaatcattgatgtaatgtttatttggctatttcatagtgaaaggtggaagttaaacgttttgaaggtattttcctgcagtaaacttccagattaacattttctgttttttcacagaaatctagtattttttttttttttttaataacaggtttttagacaaatattcaggaaaaaacaggaggtataaattccagggtcaaatggaaatgcagagttacacgggtttttattttgttctgttgattgattttttaaaaaatgaggtatttctgagagcctctagtatgctagcactgattgtgatctgtaaaagcatcttataatatgcagtgctcccaaactagtaaactcttctgctgttttctcccctaaagagtcttgagttctgcagaacacgctgggtgttacttcttggatagctggtactgtagtgtgccctgctggggacaggttctccttacctaaggaattctcactgggctgggacttccacatctgttatgacacttggcactgacaatggggttgcagaggttctcaggacaggctggttagcctactccctcacccttacaagcaactctgctctctgtggcactcatcagaattgctttgcacagtggtctccaactttttttttttttttttgaaataggttttctgtagaccaggctggagtgcagtggcaccatcatagcccactggagcctacaccctctgggctcaagcaaacctcccacagttgggattacaggcacatgccaccacgcccagctaaaattaaaaaaatttgtagaaacgggtgtcttgctgttttgcccaggctgatctcaaactcctggcctcaagtgatcctcccaccttggcctcccaaagggcatgaaccatcgcatccagcttgtctccaagttttttgatcttgtatcttacacttaaaaatcttgagtacacactcctaatatggaaatatgtataaataatatgactgtgttactgcactatgatgatgttttaaagtatgccacaattttgagggataagagaaaaatgaacggagatcatatttcttcccacattccagtaggcattttgcactccctactgtgtacacaatccactttgtaagcctctggcttttgagatagagtctacttacaagccaactagctgtcgccctcccttcgttcctgggttaagtttgctttccagtgaaacactctgcaaccattgaagaatgcaggctacctgcaggtatttgcttctaaagaagtccaagaagtactaagtggaagaagcaagtattaatatatatgtatggtctgatttcttgtgtgaaaattttttacatttgtaaaaatgtataatttattcagagaaaatctctagattgatacattaaaagctgttaagttatttctgagcactgggattaagggccttgggagagtaagaagatttttattttttacttcactcttctgcactgcttgaatttttaatgaaccggattcttttcgtaataaataatttttaaaatcactaaatatattaggatgtcaactatgttacaatgcattgccaatgttgattgttgaagttgggtgatgggcatgttgggtttcattgtattcttctctacttttatgtgtatttgaatatttccataataaaaactttaaataaaaaatgcgctgcaaaagagtctatagaaatacactacacagttaacgtggttatcttaagggtgggaggacagaagaagggttgaatagaacttcagataccttctgcctcaaatgttttataatgggaaaaccactgatacacacacacacacacacacacacacacacacacacacacacactcactgcagagccaccaatgcaaagagtttcatatgtagaagggagtagaaaatacttacttgatttcctagataaatgttagttcctagggaaatctacaaaataaatgtgtaagtcgagtgtttcatatgtaaggcttggctgttccatattaagatttttttttttttttttttttttgagacaaagtctcactcttttgtccaagctggagtgcagtggtgtgatctcagctcactgcaaccttcacctcctgggttcaaccgattttcctgcctcagcctcccaagtagctgggactacaggcctgcaccaccatgcccggctaatttttgtatttttagtagagacgggggtttcactatcttggccaggctggtcttgaactcctgaccttgtgatccacctgcctgggccttccaaagtgctgggattacaggcgtgagacactgtgcccggccccatattaagatcttaaggcttgttttataaaaaggattcctgggcatgttgtataatcaaaggtgaaactccacagcatagccacatgcctctgcacagtctcagcggcagcagggagggcacagctagtggtctgccatgaatgatttgcacttatagctggttaccaagctccataacatgaaaagacagtgtcttaaagtacaatacctaattatagctctcacatggggtccaagggagttaatatgtaaaggacattttctgttgctgactgcaatggtaggctgcattcatggacacagaatctataaagagggaaatgatggtccattagccgtgtgaccttgtaaaagctaagctgtaggtacctcatctgtgaaacagggataatagttttagccacctcaggggactatgatgtggattaaaggagaatgtatgtaaggcaccttgcatatggtgaacactcgaatgtcaactgttctggttttcatgtgaaaaactgcttactgaactggaacatttagcttgcgagcaggtgtcccctgattttaagtatcttctcctctaacagacatgtggttagggtccttggtctgtggttaatctcattacccttgccaagtttaggaatggtcatgtcacctaattttggccagtgagataagagggctgtctcccgcatgatgtctactgttccttctctggatgttaccatgcctgagtgagctgcctgcagttgcagtgggcaacttggtaacagcctgaggatgaagccaacatcaaggatggtggagcagagagaaggaaaaacactgcatcttcataacattaccaagcagcccagtcagctcttcctgaggccccactctaccttggaacttccttttgtgtgagatttaaaaacaaaacaaaaccaaccaaacaaaaaaccctctttatttaagccagtttgagttagcttccaaaggcatcatgattgattgaacctgcaccagacaggatttgaggtaggggtggtagcatgtattcagtgatgtttattaagcactttagaatgcaaaaataaagacatcaagaagttccgagacatgaggaactgggggttctggaatgatagcagcttgaacttttttctacttgcagtttaacccatttgcctctcctgagaaaagcagctgctggggcttgccgggggaagataaggcctgggatgtgaatgaggcttcgggccacagcagaatcctgtcagagagct

SEQ ID NO: 1337 - DNA, 5037 bp, Homo sapiens
caggaagcggcggcaggcctagcagcacgggaaccgtcccccgcgcgcatgcgcgcgcccctgaagcgcctgggggacgggtaggggcgggaggtaggggcgcggctccgcgtgccagttgggtgcccgcgcgtcacgtggtgaggaaggaggcggaggtctgagtttcgaaggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacc

SEQ ID NO: 1338 - protein, 748 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 1339 - DNA, 101241 bp, Mus musculus
  misc_feature (1)...(101241): n = A,T,C or G
nnnnnnnnnnnnnnnnnnnnnnnnnnnnnnnnnnnnnnnnnntacagagttttacctgcctttgcctcccagtgctggggttaaggtgcatgccactactgcccaggtagccttgtaaatattaaaatcaaagccacgacccaaacctttgtccaatctctgagccccatccagcacagatgctgggtatccacttcccctgggctttcatttctatggtgctctgcaagtcatagaacacatattttgggccttggttatctgtttggccatatagtgacatcatgaagaaacacaatgaacttgatagcattatttgcccattttatgaagagaagggtcttcgcagaatcgacaggaagttcctggtctttttccagacccttcacttcctccctttgacgccaagatgatggctgatctggatctaccatcttcactcccagtctctagcatgtcttgagtcacactttgtagcagaaggctgagcctagcaagtctacctccagggctctttgtagacctggtgcctgccagtgtttccatggaatacatgtgactctgcccacctccttcttttcctccagtttctttcttggttgggagttggtcttttgctctgccaaatgctggttgctctcaaagaccacatgtgctcaagtgacactgtaatcttgccccgcccccatacacaggcaaattatccctgattgatgaggaaagatgcctactgccaatagttgggcagaagagagacaggggggctcttgggttcctgggcttcaggtctgaggagaccaggaggagagagaagaaggtgaaaagggagaagatgccttggagtaagaatcttaaaataatagtcgtgtgggctggctaattggagttaagagcagcccagacgaaacatggcaaattatataatgggattattggctgggaaatagacataatagcatagaggatagatatctgctcagcttttgtgctgattaaggtttaatataaatataaaggttgtatgtgtcttttattcaggaactaaatggtcaaaggaggggtagaaaccctggattgggattaaaaatattcaacatttctttccttggcttgcataagaacttggaagtctagaatggggcccaatggggaaggttgcttctgtgtctgtgcctctgaccccactggctgtgtaacctcaacatggattccattggctttttccattgggagctctgatttgtagcacagttctcaagcagcagccagcagcagcagcagcccagatgctgagggccttccagaagaagggtcacctcattttggactaagctgacagtagccaggtagatgatttaaccaggtgttaaggccagggtcttgcatattgaaagccagtcacagttacttggctgtgcccctatcaaagtctaagctacaaacttacagctttcttgccccagcctctcaaatagctgagattagaggctggcacctctggtggtgattggaggatttttgtatcttatgatctggtcaggcatctgaaggctaatgtcagccaccagggacgcagtacaagagtaactccttggatcaagacccatccaattggatcagaggcaagaggagatatttcatgtaaaggtgatgggtgtggtggtgcataagcctgctttggccaataggacaggatgaccaagttactcatgactatttaagtttaaatgagatcaaattaatatttagtaccttagtcataccagcaccttcccagtgctcaatgattatttaaaactggcttgcagggccagatggtggtggcacacacctttaatcctagtacttgggagacagaagcccacttgtagacaaggctagcttggtgtacagagtgagttccaggacagttaggaccaattccccacccccaaagcccaaccaactaaccaaccaaaaaaggctgtggcttggggtggtgtctggtagaagctggcaagttggctcagtggaaaagggagcttgctaccaagcttggtgacctaagattagtccctgggccctataaggtagaggaaagaatcaattccccctaaagttgtattctgacttccacatgcctgctgtggcacatacgctagtgagagtacatgaatacacacacacacacacacacacacaccacacactaaacacatgttttaaaaggtggtgtttgtttgtttgtttgtttgtttgtggctgaggaaatgactctgtagtataggtagtgcttgcatgaaggcctgcgtttggatcttgagtacccacataaaagtcagggcttggcagcacacatctgtaactccacctttggagttggggggacagatccggggaggcttgctggccagccagtctagctgaaaacctccaagcttcaggatcaatgagaggccctacctcaagggaggatggtagagtgagaaagcaggatgcctgatatccctcttgggcttctacacatatgtgtatggtgtgtgcacccacaccacgtgctccctcatgcatataccatacacacaaacatgcatacacacatgcatacctataccacacacataccacacacaccaggcacaccacacacacacacatacacacatacccccccacaccacagacacacacaccaccacacacacaagcatgcatacaaacacgcacacacacaaacatgcctatacacacaccatcacacacaaccatgtacacacatacacaaacataccacatacacatacactacacacacaaccatgtacacacacacaaccatgcacacacacacacacaaacatacacacacacacaaacatgcacacacacatgcacacctataccacaaatacacataccacatgcacacatgccagcacacatacacaaacatatacacacgcacaaacatgctacatacacacactactaccaccacctacacacaaacatgcacacacacatgtgcacttacaccacacacataccacacacacacacacacacacacaccacatacacacacataccacatacacacatcaccagacacacatgtgcacacacccacacctcccccacacacccccacattcacacacacacacaccccagtctttattgctgctgaaagtttcactggacagcactgatattataatatccaatggttggaaaagaagcagcagaggcaaaaagcgttctaggaaggagtaaacactgtatggctaccactccctattggagagagaagggcacctcataagactcagaaagctaaggcaactttacaaggcttctgtgctcagaaagttatacgcagaaaacagttatggaggctggggttgggtggggagtgccaatgatgcagctttcatgaattgtaacctctactgaggtggctttgggtgatgcagttgcctttgaatccccaataaggatcccctataaactcactgctcttcaagctagacagggtggaaccatattctttagtctgtcatcagtctcctttctaggatgaaagacatggttcccagtgcccaatggttccccagcaagagtcagacatcagtaagggaccagagagctcaccagagatatctagtaggagtgaccactgcttggatgacctaagagcaaggcatattggaaacagggaggaagcaggttgagcaggcactatgtatagtaaatgccctctctcactctctgtaccttgggttcggctaggggagccatcctgtgggagccatggatgttcctcaatgtagtatacatacccttcagggaagaaatggcttcacttaggaagcccacattcaggctaccagcaggcaaagaagaggcaccattttcttccagataggatcgcttgtgtctagaccgagggctagatagagggcccaatcaaaaagctgcaggacagtgagactgtgtttcaagtggacattgtctaaggaatgacatctacggtgggtgtttgtattgcggacagtgagcttgcatgttgaggcagaggtcccaagaaggaaaagattggccaaaaccatagatttgggtccttttgtcgcttctacttccggattaagagcttacgttacttataactgcttatttagttcttcgaaattcagagatgggagttgttaattatttgcctggggccaagttcttcacaaactgaatgcatatttgaagtcgtgtttatatcccgtgctcaagaaagagaacagaggtgcaaagggaagacccccctccccccacctcccggcactcgtgaaatcatcccaatcttgattctgcccttagattgtgttaagtgatttatgtatttgtatatttatacatttatatctcagtctaccaccatcttccttttcttcaaagttgtattgcaggcggtagattaagcttcgggcaatggccagatataagtacttagaacaaactgtcatcagaaatctgtgtctcttgactctgcctctcggtgtgttggccccatcctcaggggttctctatatgatgtcaaagtgggcctataagaagcagtgcaaagccagcagatgcttcagcaatttcaatggaaagaaactgctgcctaagctccacccagagctaatctccaccagtctgcacattcctgagccagtgacagggctctggaaggaatgcagccccgtgattggccatgtctgctcacgtgttcccatacctgaggcagaagatggggtcaacttcttcttgacttgtgggtcaccccccaccccccacagaggtcacatatcagataccttgcatatcagatatttatattacaattcatagctagcaaaattacagttatgaagtagcaatgaaataattttatggttggaggagctgtattagagggtctcagcattaggaagattgagaaccagcgttctagacttttaagcctttgagtcaggacagaatggttctatatggtaactcaaagaagcaaaacagacattagcttggtagaaaccacagctgtccacgctgtgaaaggttaagctgacacgtgggagctggggagagagctcacttggtaaagtgcttgcttgcactccaagcacgggacctgagtttgatttccagtacccacattaaagaaagtttaaaaagccaggagtggtagcaagtgcttgtaactcttgtattagggaggtggtgaggaggaccccttggcttcctggccagccaacctggcccaatcaaaaggctgcaggacactgagacagtgtttcaaggggacattgtctaaggaatgacatctacagtggatttctggcacgtgttctcatgtacacatccacgaaagaataagctgatatgtatacaacatttgcaaaatggctttgtatcgtataatagtaattttattctttctataacaatccttaaggattgttatagaaagaataaagaataaaattacaaaggaagaagtagggacgtagattaaagtgctatcttgtcctttgcagggaggaaagaaggcccatgggactcaggcacaagtgtcttgagcctcaatccaggaaacaaaggattgggtcacatggtacatttctagacgagctttaggaaaaaaaaagctaagggttatttaattaatgatttgagtacactggagggggcagatgtagaggaaatgttaaggtttgttgagggcgcaaaacttctgagtagagatgggaagtgcttgtgagctgaggtcctgggcagagaggtaaggaatgagctgtaaaatgcagatggccaggagcccatgctacgggttctattctggatgaaccaacacagcaagcgtttcccaactgtgggtcacgactcctttgggggtgtcaaatgaccttgtacagaggtctcctaataccatcacaaaacatagatgtttatataaggatttggaacagtagcaaaattacagttataaagtagcaatgaaaataatgttatggttggggggggggtgtcaccacaacatgaggaactgtattaaagggtcacagcattaggaaaattgaggatcactgctatacagctaagatgaagtcactgctataacccaggagagaaagttagcataaactctcctgagggttggctaaggtggttctagacaaagatgcatgagaaatactggtatcttagtccacttagggtgctccatccaaatagcacaaactggtgccttcataatgacacaaatgtatttttcatagtatcaggaagctgagaaattcaagatgaaggcaccatcagactacgtgtttggtgagggctctataggtaaaagctcgctgtgccctccatggccaaaagggcaagagagcctcttacaaagacactaatttttttacagagtcctcacaacttactcacttcacaaaggccctgtctcatgggttttgaaaggactcaggcattccgattcatagcatcagggttctaaagtagtttaaggaccaaaaatgtcattaaagtgcgatgcactggggagcagaggatactcttggtaaagtgattgtcacacagcacgaggaccggagtttaatccctagaagccatataaaagccaagcatggcagtactcgcccgtaacccaagtgctggggaagttgagaaggtcggatccctgggactaactggtgactcagtcagtctgaatcagtgagcttcgggttcagtcagataattcgtctcaaaaactaggtagagagcgattgaggaaaacacctaccatcaacttctgtacacatgtgcatacacaaatacatatacaccgatagataacgaaggacgatacaatcacacacgcaggcagctctgtctgtattccttataaagggggtccaagaaaagactatcagagccgggtgtggtggcgcacgcctttaatcccagcactcgggaggcagaggcaggcggatttctgagttcgaggccagcctggtctacagagtgagttccaggacagccagggctatacagagaaacctgtctcgaaaacccaaaaaaaaaaaaaaaaaaaaaaaaaagaaagacttgaggggttgcttgtagacttgataaaacaacagactttagggtctgaaaacagcagctgcaaatgagcagctgttggaacatacagtcctgtaactgtaaaatgcaaggttgctcatgaaacgtgcaaattctgaggttgaaatgttggtgacaagaaccactgtgtagtaatgtctgaagacttatttctcctccatgtaagagctaaatggggcgagatccatcggatagcggggcctgatatattggaatctccatgcaattcagcatgccactgtcagaggccattgggtctgaccggagtcacaagtgtggggatctgggctcgataaccttaatggagcctggagctcaacaggagagaagctctgaataactacacactcagatgatgcacaccagatgaatgaatagcgttgaaagctgtgattctccaaagctgcatcccttgtagcgtgcctgccttcctatttggctgacgtagagaaccacagatacagtgacttaaaacaacattaaagcgttactttgccatgctagaggccgaggtggatcttacaggctgaagccagtgtttcattccttctagacttcctagggcataaatcaccctttacctttcttgcttctaagcagtggttctcaaccttcttacctaatgctgcaaccctttaattcagttcctcatgttgtggtgaccccaaccatgaaattattttcattgctgcttcctaactgtaattatgctactgttatgaatccctacttcaacctttttaactcgagcgtagaaccaagcccacctttgctacatacagtgaaacacaacgatgcaaatgcaagatgcataggtggacatcttggagtggctactctgctgcagcattcctggagatagccttagaaactagtcagctggcctgggctatgccaatttgtacatagtttctgttcaatcttgttgtgggggtaaagggcagagtgggtatccaatggtttattgtgtagatgccattttacagagtaaactgtcacatgggtggtccccataatatcagagaatgaattcggggcagctgtcagaccttgggcaagcatattacaaacctaagttctaaatccatctaagtgaacgggaatgcatagaactgtcttggagagttggaatgaggagtaatgaagatgcaaacggtgaaatctaagacaatgcctggctttcaataaatgtctcttttggaatgagtcctacattcaccccctgtcttctctgtgtgctttgctgaggtcactgcttccccaactctttcttaaactgtcatttgcttgccaaccatgttacaagctccaccagtagctctggagcccaatgagtctgtatgtcagtctcttaagctctccaaagctcagtttcctcctttgtatgatccaggtaataacctgtacgctaacaggctaaattaagacatatggaaagggcttaccgtaatgtctggcacaaaattagggcctgataaacagtagtgttattctccccaaaggcctggcctcctttcagcttcatttcccacattcctttctgcaacacaggacaactcacttgtctgtgggcaaaccctgaacctgtgggcattgattgttagcaattcgctgtctccagtttgctccatgtgccctatgcaattcattcttatgttctgcttcgcttcccaggagtctgtccaaccttgaccaaccttctcagtagcaatagcttatgcaggacctttccttaattctgggcatgggcgaggtccttgaagcagggtgtctccaaaggagtatggaaaagtacttcccctcctcgcaggcctcaattttcttgtttggaacgggtccgttggactggcaggttaaagctccagccagggttgagattttaagcagatagaatttcattaagtggcagggaccttctaggtcgcctactccacttctgcagaaggagaaactgagtacggttggtgttttgtttttgtttttgtttttcttccacaaagagccgtgtttttctttgccctaggggtaagacttccctggaaggagacagtcttattttcttcatctggtcaagcaggaggaactcttggacttctagggggtcctgcgcgcccggaaacacgtgtgtgctcacctacgtgtacgcacgtgagcgcacctacagcagcagggggcgctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgggcccctgctcaccggcggcgcggctgtgcacatctccgcctcgggtagctgccaaggccaccctttactgccgtgtcttcctgctcgacggaaccgaagtgagcgtggacctgccggtgagtgacgcggcgcgtgcggggcactagcagcctgctctgcttgggtcagaaccccctgtcccagtctttctttctctctgggaagctacccgggctgttttttggggacccctcccccatcttctgccaatcttccccagccatgaaccctcccagaccaccagcccgggtatgctctggggcccagtctttggcaccttgcaaccgcagggttgcggcgcccttctttggcgaccacctaggatttttgtgcctcactcctaccccatgctatcccatgcacacgtccctacgtcccctccccttggcgcaggtggctggcattccctgccaatgttggccttcggctgctggattgagtagaatttttcaagcgacgcagggctgttccggggtatcccgctttgggtatcaggccttggtggagaagaaatccttgcctgctgctcagcaggtgccccaagtttgggaagaggcttagggaacagttttgccgctctgccttctcccgattccccgtggatggcccccatagggagcctatcccaaagtgctccctggctcacaacctcgcagggagtggagcgacttgggagccaactcaggccaggtccgctttgaacggagagataagccttggcgtgctgggagttggccccggtcccctctggactggcctacccactctctcccacacccggcagtttgcgtggttcgttcagggcatcccggggtggcagcaccagggcctgcgtccggttcacacacccacaggtggttgcacccgggcccagttccagtggcaagctaggccagcgccagtgtctccgacagggagtccagccgccaaaagagcctttttggccgaaggggccagtcagatcctatcaaacgctgcactaacgggcgcccactgcgctgcggcagacggtgccttcgggaatctttgggcatgactgaagacaccgcagtaattgagctttagatgagttacagattgtccggagtgtttaggcctccggacagtctgtaactgggtggtaggaattcgttggatttaaggagagaacacttaacctgtaagggtttcagatgggaaaaatcagcctcgctagcctaggctctaatgctgcttcctgtgggttaatttggagacagcttcaatttatggtagtttcatttttgtggttcctgtgctctataggagagcattttgtcacaaaaatatcctcgcgaggccttttcatagaaaaggtgccaacattccccagcccaaagctgttgtcttttaaaaagcatgcatgtcaccgctccccaagaatgaggctcgccagctctgatgcagagaggcagcctgcgagtcggggagcagaggctaggtgagtgggcagcttgggttgagagaggctgtggcgcagtttgcatctggcagaggaatgatacccccgggaactttgtcggtgctccctgcctggtagttttcgtggctgttccccagggataattggcttataaaatgtattgctactgtcaggtttgtgcgacaggcttaagtggtgtttctgagatgaaaaattgcaaacggagtaaagtgcctgtgtgctaaagagatccaaacaggtacacaaacgaacaggttgggaagctgactgactgcagctggtggggtcgtggggggatgggaagagtggcctcctaaaaggctttctccccccccccccctttttttttataaaagggcacagaagaattcctccatctcgggtttccttcagatggtagatctttttgatgtttttttaaaaaaaatgtgtgatttaatgaacctcaagttttatctataaaaacagacatatgaccatgtccatagacaaataaaaagcaaatcaacgctggctatgtcgtgtaagctctcggggaggaaagatggagaagaattgccagtgaacatggctcattgatttaaagatttattagatattggaatcgcatcagtaaatctcctccactaatcttcccagatcggagtgctggttcctgtaattaattctcccagttacagcggtttagcgccaggccgtggctcccctgtgaatctggcatttgtgctgttccactttactggattccctttctgtgcctccttctaggcatttgaccccacgggtgcttgttctgtctctggatttttactgctttctgggctatggccttgcctggctgcttgtcacacagataggatttacctttgacctggtacccctaagcttccttctatattggatcccttccataaagactcagggaactagccagactaactatgtctcctttgtaattaaatccctctggtagattcaagaagtcctttgctcagtgtacaaaatggtaaagtattgtcataaatcttttatattagctcctctcaggacagacacttgtgttccaggatggcctcagacacagtgacacactcaagtatgacaaggctgtggcacttactcaccctttatggggtgtctcaagtgtgctgagccacttactgtaaacacaaaggtcagggaggagtggccttgaggctcttggaagacacatttggaagtaggagaaaggatgggcaggtggggggtataggatgtaaggtgggtatcgggaaagaaggatttcctgaactttttgatgtttgaaatggaagtaggttaaatctactgttacttggcagagccatggtccagttgtcataattaatcaaaggagaacccactgccattttcctagtgagtcccctcccaacagacttggagtctggttggatgaatctgctagcatgcctggatgttctgggtccttcaagtagagagtgagagctttctcaacaccgaataaaaaaatgaacgagaaggtctcacctatagtatacagtccaaagtgggcttggtacacaagcccagcttccaggtaacaccaacattgccaccctgggccatttctctgcagtttctcttcagaaaccccgccctctcatgaagggcacctccctcctattagtccagccatgcccagccttcaggtgtggtctggtctgagggagccaggcactttccttctatgaatgcgtctgcagatcccactgctcggtgtgcttggcagcagcacccactgttgactcatatttagccctctgttgactaaatccctggcatggctcttgctctgggcccctccgctcagccccgcctctgttgcctgcgtgagcgagcgagtgtatgtgtatctttcagcagccccgtgtgcaaagctgctgggaccagtggctggccagttagcactcccgccatgccttgcaggggaaggctggttggccagtgtagcatttggcacagttgctctcactggatctggaacttggcatcgactcactagggtactgtgcaaacgcagagaatttcagtgttactttatagcccgactgccacactaggccacttgggctctgagcgttggcttccccgttttgtttgtttgtttgttggtttgtttttaaatgggatgaaatgattaaaaacaaattagaatgcttcagtaaacagcaagaattgctagaaagtcataattttgtgaacgtctcgtccttttctatggaatgtggagaagtttatgtatggactttaggggaacagaagtgagccataccagcaggcttaccctcgactagctcttgtttagtgggcttggaagctgggtgctgtatgagaaatgctttttttaaaaaaagcttcagccgggcagtggtggcgctcacctttaatccccagcccttgggaggcagaggcaggtgaatttctgagttcgaggccagcctggtctatagagtgagttccaggacagccaggactacacagagaaacccgcctgtcttgaaaaacaaacaaacaaacaaacaaacaaacaagcttcactttggaagagaaaagacacaggactcttaggactggtagagcatacgtggcacagcataaagatcatattccttatttagggattgagaaagcacatctccatccaatgtatatatgggtgagtgaggccaggggccataaagtgacttccctgtggtcactccctggagggctggaatggcgcacacagcaagctaggttgtaggatgcctccttaagtcccgcttgctggcttgtgcgcttgctgtggctcgtcttacctatgcagaaagggtgtgtgtgtgtgtgtgtgtgtgtgtgtgtgtgtgtgtgttattttcctcctcaaatatttgcagggctcttggggctggagaggcttcagcagttaaggacactgactgttcttccagaggacccaagttcaattcccagaatctgctttggcagctcacaactgtctgtaactgtgggtccagaggacccacggcactcacctggcacacagttggtgcacagactgtatggcaagcagaatatctatacacataaagtaatacgatcaaaaattgcaaaacaaatccacagacttcacgcctggcattccaggttcagtatttcagggaaccaagttcctgagtgttcacagtcctccactgcaggtggcgctgactcctgtgtcccttcacattctctaatacactctgtctctggcgacaagcagaggcaactgccttaaacccagggtgggtgtgcttgtatatggtggcctcgaggcagtctttgacctgggtattggcctgtttttgctagagtggagtggaggctgggctggaggaggaattggatgccagctacactgtggcagtactccaggtgaagggtgaggagggcatccctgggagaaggggcagagggccctggggcagttcatagatggaatcaggtgagcatgtgggggaagggcaaggtgccagtgtggagtatgcatgggtgatcggtttccttggccctccattgtgggagggaagaacgaaggagcaaaaaggaaccctccaaggtctggctgcctcagctgccttgcctggtccaggccgtctcatataagtagatcttggcgaatgacagctctgcagcccttgccccgcccctcaccagactgtccctgtgggttgtgagattgtgtcgtttctgtaaagtgtgcctttattatgaaaggcaagctgagctgggagtgagtgaggtgagtggtaggcacccttccctggtgggatgtggcagagactgcctgaagctggtgccacactgggcagtgtgaggaagggaggggtgtggttggcgagtgggggttcccctgatctcttccaggaccagtaacgtgaccctccagaggtacatgctctgagcaaacattaacttgctaaatatttcccatgtgtataatctcactgaatcttgcccctggttttgaaatagcagaaggccatggggatgagttttccccttacctacttgtgtgagaacttagaaaacttctaccctggtaaccatagaaatccttcctcctcctcctcctcctcctcctcctcctcctcctcctccagtatgtgtcctttctactgctggacctccttggctggctggctgcagacatccactttaactacccagtgacagcttctcagatttcgtgagaggtcggaacctccggtgacattgtgctatgtctccatctgtacttttaatctttgtgttcgtatgaaaatgtgtattttgggtggtgaactgtaaagggccatttggagaggccctgttgaccctgaccttacagtgaagctatgggtctccacttgttacactctaggaatgtacagcagtgggcttggtcctctgagcttccctacttgggtgagaagcaagcttggagctctcccttccccacactcttcctctggcgggttctcttgagtcccttgcatcagggaacataagttggaacagggtggtggttagttttaggtgtcaacttgacacaatgtagaacaacctgggacctgctcagtgagagattgtctgcatcacgttgacttccgccctgactgtggggatcatcttggctatgttaactgatacaagaagaggagcctccatgtggactgcaccacattcattcccttgagttccggtcttgaattgtgtcagcagagaagtcagcttgagtagtaggtgtgcacagattcattctctctgctcgactgtgggtgggactagttgcttctctaactcggaattgtgaattaaaataaaccctttctctcctaagctgtcttttttgtttcttaacctgccagctaagcccctaactctctccggtaaaacttaaggataacaacagttagcctttggagcattcccaggacccaggataatcccaggaccctgagcatagatccaggccacagaaatgaacctgagaaaggaaagaagccacagtccttaatgcttgcaaaagcctccagccaaagctgatctgtggggtgtgggctggagccttgcctgtgtcccctccgctccagtgtctccagccttgtatcttcagcctctgtggttcctctccagctaactgtatcatcttacctggtcacttgatttttaaagtctatttacaaaaattgtttttcaaagtgtttttgcttgtgcaaggcaaattttctgtagttaacaaggcctgtggaagctcttctagtgtgttggcggtgtgtgtgtgtgtgtgtgggggcgtgtgtatgtgtttgtgtctttcttgagttcatagtcagtgaaagacatgtaaccccataggaagcagtacaagggaggggccactgaactgtgcggtagaattggaaaagctttgatgctgtagtggctggggctgtcccaaaggatacatgctagaaggtatctgggcagcaggtgcaaaggcatagaggataggagcggggaggagggagcccgttcaccctttgggctccttgggggcaggtatggagggctgtaaactctgactgtgtgacttgtgagggacctttgaagtacatgagatccaggatctgtgctcaggaattctatgaagcttacaaagactgtttccccagagttttataggagagtcagtcttagctgaagagtaagtcttagctggcaagttagcaaacttgcccgaagccacacagctagcaaggtccagcttcaggcacagactgtggagaaaatggtctgagaacagtttggcaggtcatctgggcatggggtgggtgattggctctgagcctgtcccagggattcacaggtgtgtggggacctcagaaccttatgacaatttctgcctttgaaggccatttgagacttccagcctgaggtcacatctttggtagactgagagcagtttgtttatttctttttctttttgttggttttgggttttggtttgttatttgtttctcaagacagggtttctctgtatagccctggctgtcctggaattcactctgtaggacaggctgaccttaaactcacagagatctacctgtctctgcctcttgagtgctgggattaaaggcctgtgtcacaaccagccagttcttctgacttgaatgccagtcttcaacacctaggtagaaagcagtcttcataaagaagtgtctagtagaacagcattaaaactgccatcaagaaaaccgactttcgtctcccccgtcctgctgcgtagcaactgttgagttctagtctttgcatcagcacggcaggttctgttttgatttgttttgtaacctgggagttgaacccacagccctatacatggctaggcaagtattctctattgttgggcctgttcttttcttagcagaacatttcccgactgtgcaggcttcccgagcttctcaccctctgcgttctgcctttggctgacttaagtctgccctgcctctctgtgtgtggcaagtgagtaatacctgccgctgcctcctctgtctctgggggttggaggttgatacacagagcatctgctctggtgcctgataagcaccttgcctcccaggctcacagaatttgtgtcgtttctttaatggtcttgcctggcaaggtattaccttctccttccagggggtttccagagagcagatggccacaggccacgtgcctgggaaatgtggtccatccggatccagtctgggtttctggactccctttccattgcttcctccagctcaggttcacaagcagccctcccctcccctcctgtttcaccttgtgttcctgggaacttccagggagaaccagaaagacccctggctctgctgtaccacactggcactctgtctctggagtttgggttctgagcagtttttgctggctgtttcccctagtcctaccaagttagtgtgcacagctttctcttcttataattaagaaccggaagattccttagggttctgtcctaacgctaacgtggtaccactcagtgattgcttgccaccgaaggctgagcttggtcctagggttggggtcttccaccttgctggcctctctgagtatacatccacaagtgccaccagtctcagaggacacacctctgagctttgcgatgctcttccagaccctcatcggagtgctgtcctctgtgtcgtgaccttagcttttgagtggcctgataatgccgattcaccgcctgtttccttgatcagctgcgcctgctctaaagcagagctttttcaaaacttgcaaggtaacgcggagcttaccgttgtaacggtttgaagtgtataacgattataccagtcacctctagaacttttttctcttcttaaatggaaaccccagccccatttgaacactaactcttcatctcccccaccacacagtactcccccctccctagcccttccccctggatcctttacagtcctccctgggagttcccaggaacactctgtgaaacaggaggctgcttgtacacctgagctggagggagcagtggaaaaaggctctgggaaagccagattgggtccatccttgttgggatgctcaaaaacaactttgcatagtattaaagggccagcgtacccttcctcacttccaggtacaccatcccaggtcctggtgcccccccacccctttctgctttttgtccttttgaagctgactgctctcatctcattaagtagattcctacagtatttgccctctggtgtaaggcttgtgtcatttagctgcaaccctctcggtggtaggctgcacattgcatatccaagtctgagaagtgtatgggttttggactgcattaccccagacctctctatccaatagtgctgctgtctttggagctgtagatgccttcagcccttatctcttgatttttattttaatgaatttattaattagcaagcgcgtgtctgtgcacatgctgtggtgcatgtttggctggcaggagacaacttgcaggagtgggtgcttactttctaccatgttggtcccagggctcgaactcggatcctcaggcttggtggcaggcccttacctgctatgcccttccctcctggttgatgggatggtggtgtctcccttgcgactcgctctgtgctcagtgtcttctaatcctgtcttagtctggcggtggtggtgggaggtgatgagcccgttacatttttttgtcagagttgcccagtgttgacaagtcttctgtccagcatattaaaaagtgagatataattacaaaagaatttttgttgagacaaggtctcactctagtccagattggcccagcgctcactctgtagcccatgctggtctcaactcacatcgaacttcctatccttggcctctgcagtactagatgtgggccaccatgcctggtcagatggttctagaacagggagaatctaggacagtacagtgaggatccttgtaccccctccacccagctcaggcacagaccagtccccagtgcagacatggctctgaaatgctttctggggtacattcctgctcctcttcctgaagctcgccgcaatcccctctttctaaggactttgcctgagcagtacattgttagtctctcgtgctctgagctgaggttgtttttcttttagccttgtgtgagagagacccatccatgatgaagaggtacccggggtgctaactgctctacagttactctgttgcataactataatggatccgtttatccttttgggatgttttcagtttagagctatttggaaaagaaaaacaacaacaacaacaacaaaaacaacattttgtcaaacctctttgacttggtccccaggttggtatctcgtgcaagtgtctcttttaggatgcatagctaagggagtgggctggacctcttaatattatgccaagtggtttcccagcatcgcagcagcacataaagacatcagtgatgccttctgctctggggtcaggcaggcattctgcagctttttttgtttgttttatatctgcagtctagtgggagtggcagcagtgcttgtggtcttcctttttttggtgctgggatttgaaccaggtcctcatgaatgctgggcaggtgtcctgttcctgagccaggaccctcacctcccaccttctcttcccccagttaatgtaggattaaatgttggtcacccggttctccttctggatcacttaaccttagccccggtgcctgcctttgctgccactgtgccttccctctgtgcagggctctctcaccctcacacctactcctcagtgagcttgtcttatcctctccctcagagaacacagtcagcaggcaggcttccttggcagcctctccttgctgaagaggagttgtcagtgtttgactctgctgtcgacagcatgagctgtattagcggctgctgggggctttgggtgagcagtgagcggtgagagagtcttggcttcattctgcccgcattagtgctggtgtgtgtgtgtgtgtgtgtgtgcgcgcgcgcgcttgcttgtgcatgtgtgtatttgtacagggacatgtgtatgggtgtgggtgtacatgagtacatctgcatgtggaggccagaggacaatttagaatgctgttcctcatgttcctcagatgccatctactgttttgttttttaatatccacccccaccccatgtgtgtgtgtgtgtgtgtatgtgtgtgtatgtgtgtgtatgtgtgtgtgtgtatgatatgtataaatgcatgtgacacagcgagtgtgtggagggcagagaacaagtttgtggactctgttctgccgtttgggtgggttctgggtccccaactgtattgtagtgtagtgtattgtattgtagtgtagtgtagtgtattgtattgagacagagtcccttattggcctggattctgttcatctggccggtcagggagccccaagaatctacctattagcttttccatcgcgagaatcttacaagtgtgtaccactgtcctttacatgggctttggaaatggagtttaggtccccatgtttttaaagtgagtttcttactgactgggatgcccacccagtactgtatcatgggctctaagcatggatcatgagaattcggtattgacccaggcactctatatttatatcctcagctctggccttccccagtgactctaaaataagtttcagatatggtgtttcaaacatgtacttcattcattaggtgtctctggaagataatgctacactttaaaaggcatacacaaggctttgaaaacatctcaatataatgcaacagttgcttttagatatcatgtatttagctaatgtcaagacttttcctcggtttgtagcagggtccaattgtgctttgttgacagtctccatgaagcaattggctagccctctctcctctttcagttttcattttttaccgtgtatttgttgcagaagctgagacatctgtcctgtctatgttcctaactttctggattttgctacatttggtcaccctggcaactggttgcatttgaggcccctgagtcaggatgtgtatatcactgggataggtgctgatgctcaggaagtgtgggtggagatacataaccaaacctgatgtagatactcaatgggaaggcctaacgggtaagacctgggagacaactcccagatgaatggaaaataccacggagagactttgcactctgagggcaaacagaggaacaactttcccagcagctggaacagcatatgcaaaggccctggggcttgaaacagcgtgttcaaggttcctgccccttgctctgtgccagccagcaagcctaaccctttcccactggtcttgacccttgaagaggtccagattcctctctgtagatgggaggaagaaatattttctttttcttctgtgtgctttcggtttccttaccagctccttgatagacacttttttatcctgatctctcctgtctaggttccctttacccttacagggagccctctgcaagtcctttctatctccccccccccccccactgggtgtgccagcgtgtttcagggaacacaaagccagagaacactgcagacggaatgcagtcatctaactctgggtctgttggaatgactgagtgtttggcttcctggagccagaggaggccactggttctgagtggatttgcatttccagctgcctgaaaatgctcactgctctctccagcacaggatgagaatataaacaggttggctttgggcaggcggctctcagattttcttagtgacacccactcatttagcagccatactctctcccggaggctccactatctgcctcttctaaagcagtcatggcggggatctctggcctgtgatgtggacacgggcgtcctccaggcacctgatatttggtaaaggcccaggtgggttagttattaaccagccatgcactctcagctgcccatccctggctttcatccgccgcaagccttttattgcttctgtgggctggggcttgagaccaaggctcaagcagcctgctctgtatctgttagtcagcacctgtacctctttgatgaccgtgaggatggctggtcagagttcagggaggggcccaggctgccttggaactggggtccaggccaggcctctgagttgccagtggcagatctagtagggcaaggagattttatgggatcaggactgtcttactgggaacaggaggaatctaagcttcggaatatgttttccaggatacattgctattctagagctaggggtttgttgagctttgaatccagaaagccttagcgttgtgagtcggggtaagacccaatgctccccaacccccattttgttgcagtagtcttagccaaatgtggaggtacatacaggcatgcctgtcctgtactctcagtcctgagaaggctgaggcaggaggatcattacacagtgtagggcagaaggttacattgtgagaccctgtctataaaagcaatgacatctaaagtaaattctacagtcttgctgggtgtggtggcactctttaatcccagcactctggaggcagaggcaggtggatcttgtgagtttgaggccagcctggtctacagagtgagttctaggacagccaggactatacagggaaaccctgtctggaaaaataataacaacaaacaccgaactcaacccaacccaacccaaaaaccatatagcttcttcattaaagagacaatagtctcttcattaaagaaaagtggaaagcttgtgtgttgtctttgtgtgtatgtgtgtttgtgtatgagacaggtacccagtggaggtcagaggtcaaccttgggtatttgaccttgcccttcactttgaggcaggatctcttggagaagccctctccctgccttgtcttctttttttttaaaagaaaaaggatttgtgtgcacaggaattactgtaatgtgctgtttaatttattcactcacagagagttgagcctttcccattcaggagttgcccagatggctagagtattctatttaccaaagagacctgctctattacagctatttcatctatcaaaagaagtaagccatagagcctctagcttatgtaagaccctctgtgggcgaggcagatgctcagaggcagagccccacttccatgcagggtacaggattgtccttgacatgcttcatacataccctgctaaaaaggagacagagcatcttattttgatgtcctaggtgaacctgctataggtttattattctcccagactccaggactctaggactcccaccaaaaggacacaactctgtgatgggtaccccttcccagttgtcccagacttctaatgatccaggctcttggatcatctctgtatagtgtgccttcctttagagaatcatggcctcagtccttaggttataatgaggctttgaaattatttatttagtttatatgtacggttattttgcctgtatgtatgtctgtgcatcatgggcatgcctggtgccttggaggccagaaggtgtgggatccccagttagagacagttgtgaactgccatgtgggtgctaggaattgaatgtgggtcctctggaagagcagccaataatggccttaactactgagctatctcttcaactcatggaatagtgattttaaaaattttcatatattctagaatctcctgggggagctttttaaagtgtattttcagggacatacgtcaggttcttggtaacccccaggaatactggatatgggtggggcaggatgctatccccagaatgtttcaaggnnnnnnnnnnnnnnnnnnnnnnnnnnnnnnnnnnnnnnnnnnnnnnnnnnnnnnnnnnnnnnnnnnnnnnnnnnnnnnnngattcaggcgtgtattgatattgacttctgtgtagttgactcttacctcttcagggcccggttatctctccaggctcacccatctcagctggagcttgtcatttgctgtcccctcgccctccttcccttccttcctgggaacttgcgtgagggacacttttgccacaggcagacctaacacttttcatgggctagctgttgtttatatcatcattagaataatatatagctctactggccttttatttttgcaaatgatttctcgttgtggtgaaactggcatgacataaagtttaaggtgaatggtacctgttatattcagtatggtgtaccttgtacccattaagcaggcactccccactgctcctttgctctaggcaacctaatcttttgtctttgtggatttgctgacgctgggcatttaagtagaatcctaccatgggtggtagtttctgtctgctgccttgacttagcataatgtctttaaggtgcaccagccattttccttcttcaataccatggttttatgacttagtgtagtctgtgttacaggtagtcctacttgcacccttactgtacaaacgaggaaataggattacaggacagttaagctgttcccagagcgtacatactgagcatacacagtaataaagatccctggctccttcactgaccggctggtgtctccctcttaaccttgaccctttgagcctgtgctagctttggtgctgtaagctcggcctttgaagttgaagggtaaggatgaaactttatgagagactctgaagcctatgcatagcatatgatacagctctgggagcagaaggcacctatgatgcctccctcggagctgctgagcaggactgatagttcaaaggtctcggcttaattggaatgggtcagttttgtgatgtgtctcccagatgttaaatgttgagcattgtgctgtgtatatggtgttggaagagcactgtgtgttgaaaatgatatgagggctcctaaaggtagcagttaccccagataaagggtatcccccaaaagctgtgtttgtgctgtaccagcagagcttcaagctacatgcagagccaccctgatgccactccatagccatccaggaagttctgtttccctattttatggaggaggcaacagaggtgtcaaactgaagtctctcatctgggatcttgtctctagaatgggatgggcccaggaagcctggctctagctttctgtgcttcatctttcaatatcttctttaaaatttggggtggggggagtttggtaaggtggctcagtctgtaaagggtttgccaagtgagcatgagaacctgaatttggacccacggtgcttgctatgcaagagctcagtggtgtgtgcctgcagtctcagggctggggggccagagacaggcaggtcctgacgctccctctgtcccagctaagatgatcgggtgactaggtttagtgggacagagtgtctcaaaaaaaaaaaaaaaaaaaagaaagcagtcaacagaggatggggttgagagtgtggggtatagaggaggcaagaggacatatgggagatggaagaagagactagagctatgctatacaaggagattagcaacagcaaggtgtgtcagaggagagatggggaaagatgatctactaaaaacaaatttgtttaaaaaatgctataatggtgggtctggagcaatagcagtagtttttctagaggactcaggttctattcccgggggatccgatgtccttttctgacctcagtcggtgccgggcatacatgcatgcaagcaaaatgaccgtacacataaaataagaagtaattctaaagtattaaaacagaaaatgccaccagacgaactagccctgtttctaccttgatttgaatagggaggaaagacatctctgttgtttcaaccgtgagtccatggtattttgttctgacctcttgaacaaatggatattgcagctgagacctagagaattctgcttgctcctttgacttttgagctagctactggccacgtcgccatgcctttctgatgaccacaatatgaaacaatgtgaaacaccatcccagctggacaattggagcttcatggaactcactgggagcaaagaggcttgggttggggatggttttgagggggaggtgacaaagttcgtgtagatggcccaggtaggaacagcctctctgaggagggcatgcagcagtggctcctggatggctaagcctggggagatggacaggaaagctgtggccactgagtgttctagggcagtggaggtaggcgttgcaggatgctagatagcctgcccacaggcacaggtgagctgaggtgccgttatcagttaacctggtgctgggcctgggcagaaagatgggtgctcaggggttgggtacaaacttggaagccagtgaatttaatggttgtatttaatggtgggacttatggtaaaaagagcagatgtcttcccatgtctatgcctggcaagttgctgaggttgagagctcaggaggagaaccctttaaagaaggggtcactggatctttgtttttgtaaaggttgattgtatgtgtgtgtgtgtgtatgcacgtgcatgcatgtgtaattttttttaaggtgccacagccccatggtacctttattccttgttggtttacatgaggccagcacaaaagaccagtaggtcaggcccctaaggagagatctaggaagatttgaataggtactatagccaggaggagatggggcacagccatggcggaccttgtgagatactctccctgccatgcccagaatacctgagcatgggtgtagtgtcactgtcaccagctggtataggtgatgaaagagaggcagtgccagccaggcagtggtggcacatgcctttaatcccagcacttgggaggcagaggcagatggatttctgagttcgaggccagcctggtctacagagtgagttccaggacagccagggatgcacagagaaaccctgtctcacaaaaaacagaaaccaaaccaaagaggcagtgcctactctttgctttgttgccttaccttatacatggaaggagtcaacactttccaaggagagagaaaaagcgtgcaggcatttgtcgaatggtgccgtgtacacagaatcaagccaggtaccagacagagtcaagactgaatgagaggggtatatttccccaaattactggcaagttagtgagaaatggtgccttccacgattgcagagaacgctttgggttttatatagttttaccatgaattgctgagacacaacacaggaggggagaaagagaccatgagaggccaccttgcttttctgaggatggcagaagccagctctgtcagagcactgggacagatgctgtggacacagcaggaacagaaactggagtctgtgacatagacacagggaagacagcctggctctagcagttcattaagagccatgcctctgagtcccagtggggattagacttctctgaaacacggatttcaaggcttcctaggtatttatagaggtaagtacaggagaggtgacagagacatgtagatgccagcttggcttaagctccatcttgtcttccttttgttttttctttctctctctttctttctttctttctttctttctttctttctttctttctttctttcttccttccttccttccttccttccttccttcctttctttctttctttctttctttctttctttctttctttctttctttctttctttctttctttctccctttctttctctctcccctctctccnnnnnnnnnnnnnnnnnnnnnnnnnnnnnnnnnnnnnnctccctccctccctttccctcctctctctctctctctctctctctctctctctctctctttctttctttctttctttctttctttctttttaaaaataggacataaatatcattgtgttgcccaggcaggcctggaattcctgggcccaagtggtcatcctgcctcagcctccgcgcctggtgtgtaccactgtgccaagctcaaaatgaattgtgaagatgcattttggtattcatgcccgtgatactgagtgcaattaacctcactggaaaggggagcctgtgcttccatttatatgcgggtctgaatgggcagaactcatctgtggaggaagcaagtcagaatagctgctgcctctggtagatggaggagggagggtcacacagatgtttccatctgtcacacagctcagatgtgtgcatttctatagaaacactacttagaattcttagaattcgtcccaaagaattcttttaaatcagtgaagggccaggggaggaaaagatggcatggaacagtgaccatggctaaagccaaggggacaggtgtctatattccattgaccttttgtctgagactggccatgatgtaaattttttgtgtgtgtggtgtaaatagaggcagttgattaagaaagggaaaacacagcatccctaagggtggccgtgggctagtgagcagggaagacaaacacggaaaagccggtggggagctgtaaaataaacagcctctccagtcctctgttgaccccgccttcctggaaacctgtctgctgttccgagtcttcctggctgtcatctgcgtttgcttgtttcctgctttcctgggcactgagaaccttggcttctcccactgtcctctggcactggccagtcttttgcccatccctgttatcaggaaacagaccctcccttccgccgactttgaccgctgagccacccatcgtcgagtctccttatctcctccctgttctctgtcccaggtctttctcttctgtgggtgagcacacaaagggggaattcactggatctcatttctcttccttctgcaattgtaaagtgccacctgtgcctttgttcacggatgcaggccgggctgggagtccagggtgctctccccgcacttgcactccagtgaaagataaacaccctgtgattctctaggtatgggcttcaaagcagacacaataaatctgtggtgctgagggaaggaaggaaggaaggaagggacgaaacctgtgaagaggcacaaggaagcctccagcaggtcgaagttaaactggggaaagtcctagagggtggcttcccaggctgtctacactggggagtgccttaactggacctgtccattttctatggatgtcacacttgagtcttttttttttttaaggcaactaaaggtctaagcaaggtcttaaaacaatactaaccattttatataaaaatttgtatttctagattttcatcaaacactgggaaaacgtgatatgtactctgccttgcctcagagtggtgagcccgtcccatcccttggtgatcaatttttggtctctgcagcatccattagaagttgctcagaatgtgtgacaaccctgttatcgatgttccccttcctttgcacactctaagtttcttagaaggcatgggattgggactggttcaagtctggtttggtgccagagccttggggactcgtgcctttccaggtgtgttctgccccagctagtggaagttgaggttagtttatgaccaacctgggcagttactatatttgttcttaggtgtttggttctgtaaataatttcctacatgtgcattctattttaaaggaacatttcacaatagtcctggttcaagttcctggcctgcttggcattccattgtccctcacaaaaatgcatatgtgagtgggctgtatttccccccacttaatggctgggcaaagcacactttggtatggtggacttacagccaaggccttaatcacagcagctcacgttaactgcaaaccatatgcctggggagacattttgatgcctctcttgcagacccaaacctgaggggagactgagtcccacaccttccttttctccatgtgaacctgtatgagcttctcctctgtgctcggccactggacactaagcttcatgcctagctcctcccgcctccctgcagacaggcagtgacttctcctctttttgtttttgttgttggtttgtttgtttgtttgtttgaaacaagctgtccctctgtagccctggctgacctggaacttacatcgtacaccagatgggccttgaactcataagagatccacctgcctctgcctcctgagtgctaggattaaaggattaaaccatacgtggctacttttttttttaagatttatttatttattcttattttatgtgtttggctgtgtggaagtacaccacatgtgtagccggtggctttggaagccagagagggtagaggatgctctacagctggagtcacaagaagttgccagctgctatgtaggtgctagggactgaatctgggtcctccgcaagagcaacaagtgctcttaacagctgagccacctttctagcccctgcattaaaaacaaaaacaaaaaccaccccctaaggccccaaatagcatgaacaacaaaattatggagtcaccaccccgcccccaaaaaagaaagatcaaaagttaaaacccatctttaaaaccagcttcgtttatgtgtgcctgcatccgatgaatggataaagatgccccagttatagtcttaggacttttggaaatacaggtggtattaaaggaaaagtttccttgacttttctcttcattaacctttagagctgtttacacacacacacacacacacacacacacacacacacagtgtaattactctgagtgtaacaattggtgtcattcttgtttacagagtgtcagagacctaaggggtaggcattgtgtgtactgttgtcttcagcaccagcgcctaagggctgccatgcagtgaagggccttgcttacagtggggtgggtagagaggtcctggacactgttctcgctcccccatggagcagggacagtgctgagtgtgcttcctcatttttgccccaactccccttggcagcacaggcttcattttacagatgaagcaaacttacaaggcgcagggtctgagtctgactctgctggctgtaggccttgggacctagaggccaaccttctctaactggaagccccgtccctccctccctccctccctccctcagttggctagagagactgaagcagtgtgccacctgctgggaacattaaacagggaagtctgcactcttcattctggtgatggagctaagaccacagtgctggtagcactgcttttcttgggtggggatggctacccctgttgccctttccctgtcttctggtggactttcctcagagcatcttcatcccttgtgtctctctgtgccctgtcctgtcctgtcctgtcttgttctctactcttttcttcttttttttcgcacgtgtttaatgtgtgtgtggtatgcacaccacagggggaggggggcaaacttggcggtcagaggacaacattgggaataagttctctccttctaccatgtaggttctgggactgaactcaggtcaccatgtctgacagtaagcacctttatttaatgagccatcttaccagcctgactgctctctacagacacggatgggttagggctcaccatgatagccttattctaacctgactcttttaaacgccctgtttccaagtactgtgacattccgaggtcaaggcttctatgtaagactttgaagggtcaacactgctcagtcacgtaacctcaagaaatgcatccccaccctctgctgataggcatgctaccgagaatgaggctactgccacctctaggtcttgtgggtaaactggggcaaggccctgataaattcatcaccagacttcacgcaattgtgagaagtctttactggttagaaaactcttagacatcaggctccacctgagctgaacaggagtcaggactcaaaacccaagcccgtgtcctcccggccccgcgttactcggtatccagtcagatgtgaagatcctgtgaaggtgaactgtgaagttgaaagttgtcattggagtgaaggctgggttcttaatgggactgggcttagggggtgctggttatgaggtggcattaatatgcctcactctgtgtgtgtgtgtgtgtgtgtgtgtgtgtgtgtgtttgtgtgtggccagcagtttatgtctggtatctttcctataatgtttctcccaactttttatttattttaactttttaaaaaagggtctttcactgaatcttaaactcagcaatttcattaggctgcctaatgagcttcggggatccacttgtctctgtgatctacattccacacccccaccccactgctaaggtggcatggatgcctggcctctctcctcccttccctatcctcccctccccttccctccttctacaccctctctttttctttttaacatggatgggttctagagatccaaactcgtactttcagggcgggtgttttgctggctaagtcatctccgtagcgctcatagcactcttcacgtttggcccatgggccgtcacagtttggggggacatctacatccagcaaaactttgtttttttcagctcacagttttcttggctggtttccatggggatgtgctacatacatatttactgatgtacagttatttagttgcagaattcccggggttgggggtgggggagaggtgtgtgcacaaaagtacttccacaattgattcacagggctgccctgtttcaagccccatctctgacatagaagacatccacgctgtagttgcatgttactgctcccctgggcaccagttgatttcattgtacttttgctttcttttgtgtagtggtaggttggcttcctccccttgccttatctcttgcttggcagagggagtgagtgagtgagcagagagagagcaaggaggcagggagagaggggaagagaggaaaaagggagagaggaggaggaggagaaaagtgtgtgtgtgtgtgtgtgtgtgtgtgtgtgtgtgtgtgtaagagtgagcgagcaataggagtcctccaaaccaagcacttcttaaagtgatagagctcttagcacctaagcatttgtttttccagcgtctcatgtttagttctcaaattttgggagcagaaggacaaagcatgtctcttgcttggctgtcctaggcagcagactgttcaagacagtcttaagaaaggccattgtcaggggtgggggtgcactggagagatggctcagcggttaagagcactgattgctcttccagaggtcctgagttcaaatcccagcaaccacatggtggctcacaaccatctgtaatgagatctgctgccttcttctggtgtgtctaaagacaacgacagtgtacttccatataataaatcaataaatctttgggctggcaagagtgggggtggggtggggtgggcctggagtgagaagaaaagaagaagaggaggaggaggaggaaagacagacagacagaaaggccattgtcctcagaaggctccaaagtagctgcctgcacactgacctactgataatgtttgtcccatctgtcagatgtaaggtttgaacatgtaagtgttcactcctgggtaactgggtaacttggtaacttggctgttgggactaggtccacttattatggccctccaaggctgtcctcgtgggggcttgttcccttacacatcatggtgtctcactctgctggatgaaggatgatcacactttagttcaaggtcagaagtcagtccttcagagctgttctgagtgagaaaggcattgtttctgtgctattagatgataaagggaacgtcctggtgtccaaagctaacactttagctttcattgctctgcatgctttctttctgtaaaagtactcattttgtgtctgtgaaactaagcacaaagtgaacgatgtatctatcacttgtacaggctgcccaaggggatggatcggtggctcgaggtgcattcttgggtcctgagttgggtctaatagaagttttgtactgtattctgttgtaatgatatgggatcaaattaactgttcatgacttggaacaatttttcttgtctgcatcccacaacctgttcatcttcactgtggaaatgggaatttcttttcccaaccagtggtcctgatgctgcaaggcagggctcggcctcatgttgctgtcattgcctaatctccagttcgtgtgtactaggtgagactttgtttaaattcttgctctggaaaatttaaatataaatagagactgcatggaagcaactataatacacagaatagacatttcttttttcaaaaaatataatttatttattctctatatatgataactacactgtagctgtcttcagacacacaagagggtgtcagatccctttacagatggttgtgagccaccatgtggttgctgggaattgaactcaggacctctgaaagagcagtcagtgctcttaaccgctgagccatctctccagcctgaatagccatttcttatttcctggattgatttgattgattgattgatctcacagtactaggaatccaaaccagagcctcatacattctaggcaagcccttctaccgctaatccatatccttgacctggtttctgggatattttaaagcaaatctcataatttgtttaggctcttggttcttagtcacctctaccaaatatatatgtaacagatttttccacatgtcattatcatcttcagtacaaaatagtgaactcttaatggcacatacccaacacttgctttattctccatttgtctaaaaaaaaacaaacaaaaaaacccaacaaaacaaaacccttcttactaattttttttctcacttgattcaggagccactgtaggtcacaggttaggtttggtagatctccccctgtgctgacagccttttccctgactctattctaactctttctggagctggttaatggtatatctaaggccctcagataagtaagcagttttctcctaaacaaaattagtggccttcaaaaaggtttctagcttctcttttcttcccccctgccccaagtttgtttatcccactccctgccccctttgtttccaagcaggtgatactcctgttagcatcaccgtatggtatttcccagaaaacttggctttacatttggaaaaagttgatacgtatgacatctgttctgtacacacatatgccacacacacatgctgggtctggtcttcattacacttatctgttgttacctagtacatttcccagcatgctttgggccttaaatggccatttcttagggtttgtggattatgttagtcaaggattgaagcagagctcacctggtagcaccttctgctccttggggcatttgctgaggctctgcagcgttgctcagttgttgataggccaggacggggtggtgccctcatgtgtttgggtgactggaaggctggcccagctgagatagtggacaggaacatctggacgtggcttgtcaggacagagtaggtacacttaatgctggatggctctcctccagagtaagcctgtgtgtgtgtgtgtgtgtgtgtgtgtgtgtgtgtgtgtgcgcgtgcacgtgcgtatgttattgcctcattttggaaaacacaaaatgcccagaataccatgttcattctgtttgaagccatgccaggttcttccagattcaagggaagggtacaaaggccctttcttggtgggaatggcatgagagaatttgcagccaggttgcaggtgctaccatttggaaggagaacataaaaactgatacctgaggtccttgacacttggcacttttcaagtccctaggttctttgtgcatcttgtggctgatgttgatgttttgaggcaggctctaactgtgtagcccaggctggtctcaaactgcagcccttaggtctccagcctcctgagtgcagggtctatcagcatgcgccactatatcagcttcttgcttttattattattattattattattattattattattattattattttgtatgtagcatcttggactcaaactagggatttgtgtgctggaattacaggcagagcctattactatgtcctagcctattactcgccttttgatggaagatggaaacccctgtgtggaggcgtctgccttaaaggttattcagcatatatcccatccctgttcctatttgctagagaaccgagagaactttgtggggcagaagcactgtgacaggtgacatgataacagacaaatggaatggctccgggccattgtgttagggaggcctttgccaatgggagtagtacattaggtagcgagggacccgctggcagtgtgaagatccttctggagagtaggaagcacgtttgcagtcactcagggcatgcgaaaaattgagctctgggagtcctttatcctttctcggcatcttgaagagtaagagcgaggccatccctcagactgactctgggcaggcggacagggagctttccagcacccctcaagaggctggaggtgtggctcaatggagaacatctgcttcctgtgtgtgagactctcagattgattcctgatgtactcccacccggctcccagccaagaacatattcataggatccaggctgataggatactgtggtcctcactgcatcctgtaagggatgtgtaaagagaagagccgagagcattgaatctttctctgcccagatctaaatacagcttggcccaaagacagcttatcagctgggaacagactgatcaatagctgatcgataatacaacacaaagcctcggtgttctccattgatctctccattagttgatgttagggtgccagtggctctgtggtgggatagctcatagtccctgtccagactcatcaagggccctcacagtggcccaagagggtcacgtgggcctggcagcaataccccttggactgactgactagccaagatgaaagtacttttaagatgatccctccttccttgttcaaagttaagagcagttcgtaatgttgtttccgctgatttctaagagattggtagccaggcaaatcaggaaattaataacatgtgcgctgctttaccagaagtcaatttctaggagccgcccagactgttgctgtttagttccctccagtgtctcagcgtttgtgtcagtgtgcgagcagataatctactttgcacactgctgtgactttcccgctgtccagaggggcgtttcctctcctactctgagatctgactgtattccacttataaccagaccgatatttgcaggtagcatttggtattgatgtattgaattagtctcaagaaaaaaattctgtttttcttctttttctttttctctttctctctctctctctctctctctctttctttctttctttctttctttctttcttaaaaaagattatttatttattttatgtattccccattgctttattcagacacaccagaagagggcatcgtcggatcccattacaaatggttgtgagccaccatgtggttcctgagacctgaagtcaggagaccttgggggttctgaagcttgttctgctagctggaagccttgtaacctggtcacgtgacttctgtgaggcttagcctcctttttgggagggggcattattttgacacagggttgcctagaacttgggatcttcctgccttggccttcttagaaggcccagagattacaggtgtacacacctcacgggctcacaatccagttttgagtcactgaaccctgctaatggctaaaatagtatttttcttctcgagggtatgtgtatatgtactgtgaacatgcttgctgcttgcagaggccagaagagggaattgtatttcctggaactgtaattacagtcagttgtgagccaccacatgggtgctgggaaactgaccctggctcctctctgcaagagcaaacaatgctcttaatctctgagccatctctctagttgctgaaatagtatttctcctgccgaggtgacttatttggtaattttagttgttctgtgtgatggcatccttatcttctttgtttatgatgatttacgttatgtctatctttgtttatcacgatttagctatgttgacactggggacttttctagttattgttactctctcaaattattcatagtgattacttgcaaaagaaagagctttattttggcctgtgtttatgcaggttacagtccaagagcagctggcctgattgctttgggcctgcagtaagccggtgcatagcgtggtaggatcaggtggcagaggaaaaaccgtttacatcaggaggcagaaagtgacaccagatgggagtggggtgggtttgcataaactccttcaaggctatgtccccaatgacctgaagactccccactaggttcctcccaactcccaaagctcaaaaggtaagctttttccaacagtgtcactctgggaaccagttctcagcacatggggacatgcttaggccacctgggatgagtgtgtctccgacagagaactagcttttttttttgttttttgtttttaaacgacggttcatagaaagctggccagttggggctcagtagtgatagaacatctgcccagcaggtgcacagccctcagagcctcaagtgaaaaggaaaggtgtagccgccctggcaggggtggagagatcctgaagagacattctggattctcttcttggtcatcagactattaaagcaacagtcccaaggagttagaattccccccaggaacctcttgctgggagaaggaaaatgttgaagcctggtgacagccagaggaggagcttgtgtctactcagaggacattgcatacctacctttctgagtacaccttgtaggagagactgggacccagcatggatgggccagcagtggggggaatcacacttggccaggactgcttgttgtaattcttgccctgacaccgtatttaaaactaaacctcacgtcaggatcccgaagatggacttgggatggaggtgggcaatgtcactagtttactctgttctttttaacaatgtgaccaccaggatggcatctcctttctgagctgagcttcttagggccaccagggctcaggcactaacccaaacagctctgtttgcagaaggaaggaggtgaggaaggaaggagacaagcaaaatgagtggagacctggcaggtctggcaggggctgggagcaggagggccagtgactaatcgggaaagtagcacttcccagaaactgtgggctctagcctccctcgggggcttctgagaacgaccagctgtgaagccaactatgatcccaggtagggctccaaaacacagtcagactactggtattaacacgttagaaaagggatcaaggcaggtttacaaaaatccccaaaccagactaagctcagtctcccttttgatgggattattagacctcagataccttgagttgtagtaaaatttgactaaaagcacatggcattaggcccgtgtcctgccaggagatagaaggtttgggttaaagtgctcttgctctgtaggggtagggcacgagttggcatgcatgcccacctgctttcttgttgacagagctgttgagcaaggtggacgacggacgagatcgttgtcatttttctcaagagtggcaaagatcatgtttggtttgctggaggggccgtagaactgggtttctactccagcatgtgtctccacagagcacagggcacaggcctgtgtggaacaactgtgcgtattcataaccaagccggaagcctctcaccactcaggtgcctctgctgaggtctagtactgccattccgcccaggcccacctgtggtgcttccacatgccatcaaagtgagatggatagctgagagatggaacaagagacctgaactcttaatgcacatatattagatctcaggccagtctaaggatgatgaaacgtaatgggagcaaatttgaaaacaagcaaaaaaaaccagctgttcttctcttcagagatcatgagcatagggggatgggatacagctcagcaggccgcttgcccattttattcaaggccctgggtttgatcctcagcacttcagaaagcgtttaacccttgcatgagattccgaaatttatttaaagaacaaaacaaaacaaggtggcacatgcctgtcatctcagcactcagtgagtggtgacaagagcactgtagttccagcctgcactatctagtgacaccctgtgtgatgctttggataaaaatggcccccacaggtccgtagggagccacacttttaggaggtgtgaactggttggagtgggtgtggctttgttggaggaagtctgtccctaggtggcaggctttgggatctcagaagctcaaacccaaggatagtggctcactgcctcttcctgctgcctgtcgatccacagcaccatgcctacctgcatgccaccatgcttcccgtcatgacgatgatggactaaacctctcagctgtaagccagttccagttaaacattttccttttaagagttgcctaggtcatggtgtatcttcacagcaacagaagatctaactaagacaccttgtttaagtaaaataaaacatttccggggctggtgagatggctcattgggtaagagcaccggactgcttccgaagttcaaatcccagcaaccacatggtggctcacaaccaatgagatctgatgccctcttctggtgtatctgaagacaactacagtgtacttacatataataaatcaatcaatcaatcactcaatcttaaaaaaaaaaaaaaaaagcatttcctagcatctataaagccctgaatttgattcccagttcagcattcaaaaccagataagtaaggaggaaatctatcaataagtagattttcattagccttaaagaaaggccacagtgggatacgatttctaaaacaccagtgtagtcatgtgtgttagagctgacaaggggtctgatggggcctgggtgggtgatgaggtctgggtgggtgatggttgtactagagttttgctctcaggtcccagccagctgtggagaattcctcacgggattagaatggggagatcagacttttgaaacagtgggtcgtttgaaaacttttgtgggggacagaagagtctccttaatcggttggcgctaatgcttgcatcaacctccgaacgccagatggcagtgaagcaaaaagacgagcaggggagtgtgctgggcctagagttgagcttgctgcaggtgaggataggaacagggtttggagaagggcattggaggcaaaggaaagggcacaagtcaagctgtagaggtaggggctgctatggaaggtggtatgacgtcgtatctgggggcttcagagcttggctgggattcagggtactcagagggccctagcagaggccgaacttgttaggatttaggcaaggatggttttgcaaagtcacggatcaggctgcagggcatccacaaaacacttgcttctctggtgagtgctctccggtgcagagaaggattgtcttgaatgacagttcccttcagagacacagagaagggtggtagtggacagacaggaaactagaggtatcgggaccgtttggggtcattgctgttgtctgggtgtgaagtgacatgctgtggaggtggaagggaacacaggcacgcagggacacagcatgggatgggggtggaacaggtgcgttgagagggctcctgcagccgctttacattgtttcgacgctgtgccttcccagtttagctcacaactagaacatgtacacttattcagggagcatgcgcagcttagcccatgccttcctttgaagtctacctgcgatgcctagcattttctacttcggagatgaaatgagatttggacagttggcttctaccatctttgttccacagctggatctgacctgtttgcctcgaagccggggcaggttgcagtaaggtatggccagtagtgtcttatctaaggtcgtgtagttccatagtttgtttagggcatgaagtgaagacactagctgtccagcagtcttcctcctttatcagaaacatgactgggaaccggtgagtcagcacagtagcctcttggctgaccagcagagactgtgtagagtccctgccttcccctagtagctgtctgtgtgcttgcccaccccaaccttgcttggcaactgtggagtcttaggcagattttaatgagcttgttacttcagctcttgtcagctcagaaggggctgctacagggaggcattctgatcaaagctgctggtccttgggaaagcagtattgttgagatgggaggcataagaattaggctgcaagaactcaacgtagagcttgctagagcctgctgtatcaggggacggcttggcatataaatctggcgatgagaactgcagacctgactgtggccctccctttcaggacgtgtggcctcggtgggcaggaggtccatgccgtgtgtgtcctaagctgctttgtacaacttagcttctcagagagtgctcagtcactgaggacttcctgcagtgagcaggcatagctatccaggtttcagactatttatttaggctttaagagaaagttccacttttatttcttattatttgctgatatgtgtgtctgtgcatcagtttgtgcgtgtatgtgcattgcccttggagtgtaggagagggcattggctcctgaggagttataggcacttgtaagccacttaacgtaggtgctgtgaacaagctcatgtcctggaagagtgacaaatgctcttaaattttctgaaccattaaaaagcccaggctttttaatttttaaattttattttgtgacagggtcttactatgtagccctggctggggtggaacttgctttgtagaccaggctggcctctagctcagagatctccttgcctctgcctcccagatactagaattaaaggcattcaccattatgccatttgtttgtttgcttgcttgcttgcttgcttgcttgttttttgttttgtttggtgttttgtttggtttggttttcttgaggcatgagttcatgtaatcctgtctggcttagacctcacggaagagcacagctttgagctcttgatccccctgcctctaccacttgaggttgggattcagatgtgttccactgcactctccaacatcttaatccccattacatacgcaggacgtggaatggcggctggaagttgatgaagattcagcagatacttgttaaatgaccgaatgactaaatctggcacagatggggagactcggttccttttaaagcatcaaggatggctttcacagtaacttatctcctatggtaaccattagacagctcttcacataatagcaacaaaattgtgtttgggtaaatggccttggaagtgcagttggttccctaggtgctgctttgtggaattcatgatttgaaaatattgtaataaacatattcccatgcttaggctttccgcttgtgatgcgttcttagtccgtagttggcacagcccgtccactgcatcttctttttaccccagacctcaccatacgtttccctgattatctgcctgtgcaccacctatctgggtccagatgggtggcagttaggctctgtgctttggagatggaagacagagatgcggttactcaggtgagcatggctagaccctgcccccagggagtgagtgctcactccgaagcagtgagacattgtgccagtagagaagataggtacaaagatggaggcacaagtgtaaagaagtgaatgagctttgactccactacacaaaagcgtatgaatcgtaaaactggcaagatggctcagtggtcaaggcacttgccacgcaaacccaaccatctttgtaattacacgtaaaggtggaaggagagacccatctccagagaattgcccttggcttccacacatgcaccatgacgagtatacaccctccccgctgccacatgcaccaggcacatgcaataataaaatgttaaaacatatgtattagatatcatggaccgctttataaaaacaggatatttgctgaaacaaaatagacatattcaaatggaaaactgtggatgtttttctttaaatttctctttaaaactgacctttggacagttgtcagacagcaaatgcaatttgggagggagaaaaaaaagtcctaattctggcactctgtcttctttcccataacagccagtcctcgggacatgctccctgttgctctccagtgcagccagccccaagcaacacctgctattgtggagccaatgcttcattaaagagtttcctagtggggcagaactagttaggaaaggctttagcagcaggacatggcagaagacctaggctgggaggaagcaagagaccgtgttccagaaccagacgggctacccactgtgaccctaagcagttcatagttcccccaaacctctgtctccaacccagacttaccacgtaggcttcacatggtgccctcgatacgtggggccacagaaaccaaccaaatccagtctcaaatgcactctgcacccaagctgtgcctctctctacttgatttcaagacgtaccctccaatctgtgatttcatcaatcccagattattaactaataatgcacagtgaaaagggtcggagcacaccgccactacgcttcattccaaatgctatcctttgggtagaggcagggaagggctccttctgccatgccagagcctcccttggtggacttagtgtatcttctgttggaacattgaatccacagtggcctgccagcttcatgggcctaggtgaaggaaaggataagttggaggggactggaaggacgaagatggggggatggaagccaccgtacgagagcccgctctcggctctcctatcctgcaaagtcagccctccagcctacagaggctccaggtgactcgctttgcctgtactgtcagacatctcatcacatggagctagtttaccctccttcctcttagtcccaccggtaggcgcatgcctgtgactttacacaggatcgccttggggtgcggctgtccatgctcctgcctcatcgtacacttagccctctgcgtctgttgttgctttgcaggagctggtccagagtctccagtctgtagtctagtggtaggtgctgacgcttgaagccagggccttttgatgtttatgtcctctacagtgaggcttcatccctaccctcatggggtttttttttattttgtatatttcatatagatagagatgcgcagataaaaccgagggatagttcgatgagttactggaatgcaaatgtcccgtctcctgagatagaaacctgaatgcgccaggtgtatctctccatcccaccaccttctgggttctttcctcctgagcagcagctaccctgacttcagtgtggccacatccttattcaagtttcctcacccaagtgtgtttcctagacggtctgtcagtggtgtgtgtgtgtgtgtgtgtgtgtgtgtgtgtgtgtgtaccaccagcctagctatcacctctcaacaccctcaaccctaagcaaccacaacctaatttctgtctctagggtttgtccgctctaacgtctaatgatagcgtcatacaagtatggtgctttgtggccagtttccttgcctgaagccgagggtcttcttattttatccctatggtaacatacatcagtattccagtcctttttatggtgaaataatagtccaccaaatgagtattctgtattttgatcgtccattgatagccgttttggtgtttctgcttttcaggtgtaatgtgtagagctgctataaacatccatgtacgatgtttttatgaacatgagttttcattcgttcatacatacatatatacctccagatagacttccaggccatgtgctagtctgtacgtaaccatttcgggagctgatagagtgttttagagtgtggccgcagtctgttattttgtcagcagtgtgtgaggagtccagcgtctccagcacttgttgttaggtcgtttccatcccagccgtccaattgggcatgaagtggggtctggtggctgtcatggtttacaggtcccttggctgctgttgctggtcgcatttccaggtgctcattgaacccttgcggatcttcggagcatgatacgttcctttggctgggtcttaattagatacttgtcttttcgttattggattataatagttctctcatttattttggataaaagtctttcatcagacacggttggcccttgacatcaactaactggatcaaaactactgaaaaaaaaattgtgtcagtactgaacatgtatagactcttccttggtcattccccaaacagcacagcgaagcaaaaacgactctctgcctaacagctgttgtctgggtggcatgagtccgccagaggatttaagtcacgtgagaagatgtgcataacttatttgccatgcgtatgagggatttgagcatctgtgcatttttggtcttcttgattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggctggagtgacagctatatatatgatttgcaaacttcccccacaccttggtttgcctttgcagttttttaatgtcttggtgccttcgaagcacagaagtttcattcttggatacatagttccctgctgcttttcttagcttatactgttgctggtagtgtttctaagcagctctcttaacttatactgttgccttaaccccagctccggaagcatcatgcctgtgcagtattgggagattcacagttctctctctcccactgagacctgctccatctcgagtggatttgcctgtttgctgctacctactcttcagtacagggaaaggccgtgtgacgcctgcagctttcctgttgattgctggtgtttgtagtaaggagtgggttctccagtcacgtctgaagttattgtttgcttttttttcccctttgttcagtgtgagataagagttgaagttcatgaaaagcttcttgctctgatggtgtttattgtaaaagttacctttgtctatcagagcatttatgcacctttatcaaaaataatatgttgttctctttctatactttctcttccgtgctatcctaatgctaggcctatgcagtctgggttactctataattaactcttaagttgcactaacttacattctgtcattacttccaaaaattcttggtctattctaagttcttatttttttaattggatattttatttatttacatttcaaataatgttatcccctttcctgatgccttcctcccccagaaacctgctatcccatcctccctcctcctgttctatgagggtgtgcccccactcatctacccattcccacctccctgccctcgaatttccttagccttcacgggaccaagggcctctcctcccattgatgccctacaaggccatcctctgctgtatacagccatatatggctagagccatgggtccctccatgtgtactctttggttggtggtttagaccctgggagctctggttggtgctgtttgcttctttgtcagtgttttctttgacaccgagttgaaatgtttttgctatggagttgattttatcagagacatgtgcctgcatcttgcttcagtgagtactaacaagccttctggtcagtcaaaggtctgagttgtcttgcagtagcttcctgtttgagatctcgaagctggggaaagcacctgtcagcagcccatcttgcacaacaaatagagaagcaagagatgtggcttgtccaaggtttcctgttattcatgctccatctacggaccacacaggaccctggagtgtgcctaggcagaactaatccattgaataaagtcattcatccaaaaagcttccttctgtaaggaaagacgaggtttgacagtgttgtgttcagctgggcctcttaacttcataggattatgtgatatttgaatttttttttttttttttttttggtttttcgagacagggtttctctgtgtagtcctggctgtcctggaactcactctgtagaccaggctggccttgaattcagaaacccgcctgcctctgcctcccaagtgctgggattaaaggcgtgcaccaccatgcccggcttgaatatttttaatttcaaattcttacttcactgaaataaggttaattaaaaatttatgaattggtattcatgtatgcagtttatggagagaaatggatttataataatatttttgtttcttacccattttatcatgccctcaattttcctgttcctctttgtcttccagaaacatgccaaaggccaggatttgttcgaccagattgtgtaccacttggacctggtggaaacagattattttggtctgcagttcctcgactctgcccaggtcacggtatgtcttgcagtgatttatttcagaaacgattggctcttcatgctaattctagagccctagacattgattgagaaaagaggaaaattgagatattttcccagtaatgagcttggcaattgatgctggtggtgcccaaatgaaacacatccaggatgcctatcagactgccccaccccctttgaggccaccactgaccaggaggctgtgtgcacagaataccttctggggacatggctgcacacaggggtatatgataggaacattgctaatgtaggggaggaagaagaaacccctttatagacatctttttggtggtaggtctagggaatccattatcttcctacagaaccagggtgggaagcaagcaggtgctcggagcacagttgaagtgggggaggggagggcttcaggggatggtcacagccaaccttggcctgggggtgggggtggtggtggtaagtcgtcacaacagactcacctcatctttctggagacagatgctagaatgaatgacctccacaaagctcggtccatttattgccttttaaattaatgatttatttaaaaaaaactattttatgtcctatgggtgtttgcctatgtgtaggtctatgtatcatgtgcctgcagtgcccaaggctagaaagggctttggatcccctgggaatggagttacatacagttgtgatcaactgtgtggttgctggaatgaaacccaggtgctctgaaagagcggtcagttaaccactgagccatctatctgtccagccctagcacttatgtttctgagagcaggagtgacttcctagttcttctttccaacaagctgtacctttgggtttcaaagataacatattcggcattctcaacatgttttctaagtggctgttgtacgtcgggctctattctaagcattgaagagaaggtggtaaatatacagttgatgtaacaaacatgacaggcagtggacaattaacaggaatacaagaagatcactcagcaatgcaaatatgaggacccaagctcctgagtttggaccccctcacccgtgttaaacagcgggatgataacacatgtctgttaccccagcaatgctccatccctggggtaagtggggagagttgtaccctagagcttgctagattgttagctttgctaatctgtgagctccaggccccgtgataaaaacctgtctcaaagggtaaggtgtagaatggttgaggattaaatacatcagtgtttacccgccacgtgcaaacctgcatgcgcatgtatgcatacgcccagacacatacctaccacaccaattagaagaagtatgggacaggacggatagggtgctgggtgagaccgtgttttggaagctgggtattctgggaacctgtttgagctggagatctgaagctctttatacgtgggagacacttaccagatagtccctggggatagctataagatgtagctgctcaaaactggtgcctggtaattggttttactctcagagagatgctgaattctgaggtgatagaatctggctgttggtgctcctggctacatcctcctgagagggacatctcttgggtgacatcccaccacttccctctgggccttaggacttctgtctgctctaaattccttaccttgcaacagctcttgcttccttgactgtccctggttccttctttgttcctcagctggagagttcctttacctcaagggaggcctcacaccttctccctctctgcctctttgacccagtctacttgcttaaagttgagctctgccctcatggcttaacatccatcgaaaccatctctggatgaacttagaactcatgttgctggccctgaccgtattctaggcatggtttcctctcagttaagctccatttcagcagtctcacagactcccttactcccatatttctgacccacctcccatggcccagtctcctctttttcctgccttctttactgctttaggggaacgaggctttggtccttattcagcctctggttctcctatcaccacaactgttctctggcctcctcttggcaaccaggctatctgtgtgctctgtggcttttcccgggctgccaaacgatgctggagtcgagtgcctgtatcatttgtctgcagcagagatcacaggttcagccaagtccaatcctccaagctgtgcattgggagtgtgagctgctcactgatgcctggatgccccttggttcattttctggttcctaccacagacctctagtcaaatgcacatgaattctgtctagcatctgtatatctacagagaagaccgaggccatctgctccaaactcctatgcttcttgccctgcaccttctagcctctctttctgtttgtttatccttactccatccttgggtacaggaatcagcctgcctctacatctctcttctgcagcacagcctatatgcagtacagcctatagtttctttccagttgtttcctgaaaaccactggcttagttggggttactattgctgtgatgaaacaccagaccaaaagcaggctggggaggaaaaggtttattcctgagagccgctgttgtcttaatttgggttttattgctgtgaagagaagccatgaccaaggcaactcttataaaggaaaacattaatcatggctggcttacaggttcagaggttcagtctgttatcatcaaggcaggaagcatggcaccgtccaggcatggtgctagagaaggagctgagagttctacatcttgatctgaaggcagtcagaagactgtttcctagatagctaggaggagactctcaaagcccacccccacagtgatacacatctcccacaagaccacacctcctaatagtaccattccctgggtcaagcatcttcaaaccaccacattccactccctggctcccataggcttgttcaagtgcatgaatctgtgggggccatacctagccatagcataatgcaaaatacatttagtacaacttcaaaagtccccatggtctatcacagtctcaacagtgtttaaaagtccaaagtacaaggtctcttctgagattcatccagtcacttaagtataattacctataaaattaaaataaaaaagcagattgcatacctctaatattatgcaggatatacattaccattccaaaacaacatactgaggaaatcctgggcaaaaccaaaagccagctgggcaaactccaaactctgcatctccatgtctgatgtccaactccgttctgctttgttgcctgcagcacaattctttctctttggctggttccactaccttctagcagctttcctcagtgggtatcccctggctttggcatcttgaacatcttggggtctccaaggcaactttagtgttacaggttcttgttcaaatgtctgggatccacacatggtcttctaggctcttccaaaggtcgtgggtcacatctccagctttgtcctctagcactccagcatctggttgattccactctactgctgctgctgtttctggtggtcatcctacagtactggcatctctaattgactgtagtcttctgctgcaactaggcttcatcagtagcctctcattggctccctttatggtgccaagcctcaacttcccttcagtcctgggccatcaactgcaactgaggctgtaccttaccaatggtcttccccggtctctcacagtgccaagcctcagctgatctctgtgactcttccataccttcaaaaccagtactacctggtgactcttatatattaccaagtccagctacagcacaaggtataaccttggttatctgtagaacacagcttctttgtgcttatagaaaacatctctcagattttccttcagtgatgctggcttcctctcaatcactgctaatctcttagctccagctaactagcatcagttgtcccagtaacccctccactctttaccttaaagccagagcacttggctgaagctgcccagttctgctgcttattggggttggaacatgacctgcttttcggtttttttttttttttgtgtgtgtgtgttttttggtttttgttttgttttgttttgttccccaacacccccccacccccgagacagggttgtatagccctggctgtcctggaactcactctgtagaccaggctggcctcgaacttagaaatctgcctgcctctgcctcccaagtgctgggattaaaggcatgtgctaccacgcccggcatggcctgcttttctattacatcattactagctttttgtttcccagtggttttcttcactgcctaagccatattcttcagcaaaatatcacaagaacagtctctaggcctcataataaaattcttttctgaaacctctggagccaggttttcacagttcatattatcctcaggaccaatgtcttccatattcctactagggtggcccataaagccccacttaaaccattccatggcttcccaaacccaaagtccccaaatctacattcctccagacaaaaatataggtaggcctatcacagcaacaccccagtccctggtaccaacttctgtcttagtttgggtttcattgctgtgaagagacactatgaccaaggcaactcgtataaaggacaacatttaactggggctggctcacaggttcagaggttcagtctgttatcaaggcagaaatcatagcagcatccaggcagacatggtgctagagaaggagctgagagttgtacgtcttgacctgaagactgtttgctaggcagctagatggatggatggtttcaaagcccacttccacagtgacacacttcctccaacaaggccacaccttctaatcctgccacttcccgggccaagcatattctaaccactacataagggtttttattgccgtgatgaaacaccagaccaaaagcaacctgaagaggaaagggtttattttgcttatactcctatataacaattcattgtcaaaagtgttccgtaacacacacagggtaggaacctggagatgggagctgatgcacaggccatggaggcgtgctgcttactggcttgctctcatgacttgcttagcctgcttcttatagaatccaggaccacctgcccagagataataccactcacagcgggctggaccctccccaattgatcactaattaagaaaccgccttacagccagatcttatggaggcattttctcaattgaggctctctcctctcagatgactcttgcttgtgtcgaatggacataaacctagccagtacaaccacatccagagtttctctgtgctcagcatcctctgaccaccccagcctctgacactcctgagcctttcatttccccgacgctcatctctatccagcctcaggtgggatggtgcttttcattagtcctggagctggaatgggtcttgatcctggtcctgggttctgacccatcccggtggccttcagatagccaatctcttctctcttggcttcagtttcctcacctgtaaagtgaagtttgggtcccaaacctaagaactctcagtcttcatggtcagtgaccagtgtgcaggtgcatctgctccggggtctccagggaggaagccatcacttttgtctttagaaccaagggcttgttggcctgccatcaagtcctagtcctcaggggacccctcaataaccttttatcttgctggaaagctttggatgtgactgttatgaaaggctttgccatgaagccctgctgacttggctggcaggcattcccattattgtgccctgtcaccgtgtagcaggagagatgttcacagcaggtcccaggtgtcccgcgcagacgacatctataggtgtcttggctctgctggtcctggagacatttcagcatcttactctacagacatgagggacttcctgtaaggcaagtgtgggatccccatctgctttcaagtccaaggatgtaagagatgtgctgctgcctccagggcccttccttttacaaaaccccatctttgctttttcagccaattctgtcatagactgggcctgatggtgccagctgccgttcgtgccattctgttgggcctatccccccactgacgggtctcacgccacttaatttctggatgtccctctgtgtcatctccactcgtggttcttcaaatcctgtcctgaatgtttttcctctctgtgaacatgggagcttattggcctttgctgaagaagccctgttacgcatccttgggctttgtatttgtagatataaacaagcagttctagggacgtagcccagcagtcaagagcacttcctcctttttcagacgaccagggtttggtcctagtacccacatggcagtgtggctcaccattacctgtcacttcagttctagaagattcagtgttgtcttctggtttatagtacaccatggacagacaccccatgtggtgctcataatacactcaggcactcagcatgcacatcaaagaaatgcatcttaaaaagttaatagatctttctgactacatcctaagacttatgactgcctcttctttacttgggatcaaggcacatcccactagcaaccctgacgggcaaggcatgtgtatttcttttcacctgatggaaaacctttagaccttagagaatcatttagcagcacaaaacgttttcagtttcatgtatacatgtatatgttcctgtccttgtacactgtgttcttgtctgtaacatgtgtgtatgtgtgttggggggggcggataaaaatagattcggggcagaagtcaggagtcacgggggagaaaagggttaatcttctggaacccggttgtgggtctctggcgtagtctgtttcatattacagtagcaaggtacctgatgcagggtactttataaagaaagcaagtatatttacctcatagtattagacattgaaagtccaatatggatggcttctgagagaggagtcataatacattggaaaaacagaaattagaagtggttgggtgcagaagaggccatgtgtgtggggtggtctgactgtaactacacagaattgattcagtccccagaacttaacctgggcagtgggactctgtaacctaatttctttttaccaggcccgagcccatcccttaaaggttcgatacctcagcagcacaggccaggcttctagcacacaagccttgggggccgactttcttcagaccatagcagtctcttcactcctgcgggacagggtgggggtgggacacaaagtcatcagggtgagcgcactgagaagacgcagctcattggaagcctgcggtgcgtgtgctgtctgtgggagagcgctctgcagagtctgccgagatagctgctgggcattactgatgttcacagggtctaggaggtggtcagatgccatgggaggtatttttgggaaggaagcagcaacagatggggctctgggaagaagtgattcattggagagggcttattgcccccctccccagtagagtctcccccaaatatccacatccccacacagcctctgacatgagcatccaagggttgtggtggtagggctttggcacagttttgtgtacaccaatcttgtatctccagctccttgaaaagagccaagcctggtttccatggtaccctgcccagccctgaggcaactgtcaaatcctgttggcatcatctatttttagcagttggtgctgggacctccagtttccctgttttgtatcctaaaggcaggccacccagggacctactctgcagatccacacttgggatcagctagagcttgggagtgagcttatataagtaagctctctgcagagagctgaggcccctgcctgaatcccacccccacccccaggcctttgtgctacctggtcatggttgctgctattgactgagttccccctctgagctagtgctaaattaaaggcttgcatgacttccgctcagcatccatctgtgaagctggcacaaggcagaccatcttatacagggggattaatctaagactcagagaaatcggaaactttgtacacaataaagtaagaacaaagtcgggatccaaaatttgatctgactccaaagtctggtactttgcactggactatataggtatacacacattaaacatacacacacacacacacactcggaaagagaacatttgccaaacttgacctagagcataccaggactaagttctttagttgcagttatgagctagatagacactgtattccgactagggagacagacagacagacatttcccatggagtaagtaccgtgtggtcagtcctctagcagagggtggccaggctcgcagagaagagagtacctgagtgtcagtgggagtggggtgtgggaggggtatgaatggacactgatgtgtcaacaggagaggcaggagtttccggagagggaaagcaagactttaggacaggactctcaacagaagtcttcttagaagacgcctcccttcccttaaaaggggcacgtgttgtataggacacgtgtggccctggagtcccctccactgaacccttcccaacaggaatagaggtgtttttatggcagtacattttacagcatgagattcagggaagatgattttgtcctttctttccagccacgccatgtgttgtttttcttgttctttacggctttgagtctggcaggtgagagtcaggtctgtgcagcagacttaacacacagttgtggaggctgctggagatactgcagtgcccctggcttcctgccggtcctgtctcggaaggtcattacctgcacctgtgcctcatgccgcttcaagtaagaaaaaggagcagggctggctggagccagggccaaagaacccacccaacacacacaagggtttaagcccggacgtttacgaaaaagaagaaagaaggagatgtataaatgtggtctgtggctgtctgtgtaactttgcagaccgtcattgagccttcaagacttcttaggggctagcacgtggtgagaaagactcgtggccacgtaccagaaggttacaaagcaggaagggagctctggtcttccacctccactcatggtgggacagaaaagagtcatgtggtctgaggaagtacagcaggcttccagtagcccatctgtgagtatcagcagcgagggacagggaaacactacttgtcagggggaagacttaggctgatccccaaggcaacctccagtcatgctgtaagctttacggacttcactctggatgaagagggtgggtcatcccctcctgcatgtaggtagtaggtggtgcttgctatcagtttgggttattatgggccttgggttggggacaatgacaccaacaacagtgagtttgaatcccaccacagccttttcactctcctatccccagacctgacccccaagtgttctttccttcccttattgccatggctgtgatttcctcttcagatccctcctggctctgacttaaaggcaaattagatattcctttataagcctaggacatttctaggtactagaccttgagtcgcataacttagccttcatagcaagggctccatggacagagattttagacttgctttaacctctgagcgtcagtgctccccacgaggacccgggccatcaagttcccacagccagcctctgccggtagtacttgtagagctgatgttctggcagcagagatgggctctgccaggatcacatcccacatcttgatctatggaaagggctttgccagatggactgggatgacagattcagacaagaaatcaccttgccaacacccacgggagagctgggttcggtgtcttgccatttgaactcaaaagcatgcatccgtctgcctgcggtgactggtttaatggtctgtggaggagcttagcggctgtgtgccttggccttcaatgatggatggtctgctttatttagctaagatgcaggtgaacatgccagacggaggtctcgcgactgcccgatacagctctcagagatgttcatggcatacgattttctgaatgccaggtctttcttgtgggatgctgtaccagtgatcagcacctgctaagcctttgcagctctgaggaaagcccggtcatttttgagctggttggacacaagataagctttattatctctgcttcaggatcacagatagatttcttgtcagctctgatggagccaacagcccttgttctgaaaaatcccctgggtcaaggagcttagactactgatttcactttgactcctatttcagcttcagatattttatggactctgtcttggcaagccctgctttagatgcaaaggatgaagcctccatgaagatagataaagggaaccccattagcaatgtggccccagggcagagctggctgctgcccatatgagcatctggcaactgtcccccttacattagccccaggtgtggacatttgaccatctcacctcttggactaacccataaaccctggagttgcctgagattttgtagagctcacatagagctgaagacattttaagatccacaggacatcctcctgtggaggagagtacggaagagtaagtagtaagtactgaacggcacactcggcacatctgtgaaaccaatgctttcagatggggctggtgggtcttgtatgacccctggtgtcagcttcgtccatttagttcttccagcattgtcaggtgcagttggatctgaaacttgggccaaggaaaccacacaagttgggcttggatcgagatgagagcttaacagtggagggagagggaagatgggcttgaacttgatctactcagcctaatggtaaggaaacgggagaaagaagggaatgggttcctttaagctgtgggtgtctggagctgctgagactagaaggctggctgcgggagaacttgatgtgcctgggaatggtgagttcgttaagtacaggtttggtcacggacgttagcgtggtgcttggcaggaacataagtatgctcctgtcctctctatggctgtccttcccagaatgagactatcgggggttttcctgcatggttaagggcaatggtgaggtctaattcttgttctccaaatccctcatcaaaattgcctacctcggagccgaggatgtaagatgggtgtcggcatggctatctaggcagcaggaagctctgggctgggtgtggtagtgggtacctgtattgctagcactcaggagatgcaagtaagatgatcacaagttcgttgtcatccttggctaccaagggagtttgaggccagcctggaatacatgcgagcctgtctcagaacacgaaataaacatacctagtagtaggcaaacagtgaataaatcaaaaaaaaggataatcctcccacactggataataatcttgttaaaataaaaggctgttcagaaaggtgaaagaaaatgacccgcacgtccctacccacccctccccaaaaaaatcccctacaaatatttctggacataaccttgatagaaaataataattttctgtaagcaggatcctacctgatttcttattcctaccttaacattgtgctcttgtcacaccagtaaatatcagcctacatccttttaaaatagtaatgcattacacaggggagccatttttgaatctgtctttgttgacggacatttaggtcattgccaattcaaagctataaacaatgagatgtagcatcccagccgcggcgccttagagataggcgccctgctgtggcgatccgcttttgttacccagtctaggcagtgtagaggtgacagaggcccacattctcctctccttagcacagtgtgcacgcttattgtgttctaattcatctgttatgtgcttttgtgtgtttccacccctccctcctcccacacagtcctcttgggctttgtggttaggtgtggagtacactgtgctcgttcagccccgccctttctcattagtaacatgtgcacggtggagatggcttctgccagtcccaggtagtcagcagaattagcctctgtttcggaatagctggagagaaacctactttgcctgttccattccagttctttttatagcagtggagctccgctatgcattgagttagttacagtgatagtggacatgttacaatgttttctcttttggatggacttgcgatgtttctctatagtgttctcatatgtagcttcctatagaagttagactactgagcatgacaacaattttaacataaatgtttatatgagagaaatggctttgtaacctccttaggcagatagaactgaagtaggttttctggtaaataagaggagtatctgaaatgtcctccctggccacagcggaaccatctgcctcttcccgtcagtgatgggggttcaggagtgtaaaagaatgaaggaggccagggactttgttttcctgatgtcagagttgagggtgttagaaccacaggctggtatgcaatcagagtttagcacagggtttgtcgttttagctagattactggagacctggagtcactggggaagagcgattataacaccaggaactcagaatttttagaagggcctttcagatcagtttcttaggggtcttaagagcttcctgacctcttttaaaaaactttgggaaactttggttaatagaaaaatacacttacatgcaaagcaaattatttgtttttctttttctatttacatgtggtatatatgtgtatgtatgtatgtatgtttgcatatatgtgggcacacatggagggttgataccactttgatacctcactcattgaggcagggtctctcaatcaaatccagagctctctgatactggcactctcatcaggggttcactctgggaatcctctctctgtcttcctaacctggaattacaggtagccgttaacacctgcctggcttttctgtaggttctggggttccaaactctgatcccctagagcaaaccctttaaatgttaatttattttcattcaatctgtatgatgttttgcctgaatctgtatgtcataaaccatgtgagtacaccatgcacggaggtcagaagagggtgttggatcccccagaattggagttacagatgggtgtaacctctgtgggtgctgagactctaacctgggttctcaggaagagcaagcaactggtgttcttgctgagccatcgtctcttcagcctcactgcaaggcaagcattatctatctacacacggaacaatttccccatcttgagcgaagacttttttcccccattaatttacttattctttttacatcgcaatcacagcctccccttcttctctgagaaggaggcggtcctcactgggtaccaacccaccctggcatagcaagtcactgcaggactaggcacatcctctcccactgagaccagacagagcaacccagttaggggaacaggatccacaggcaggcaacagagtcagagacagcccctgttccagttgttgggggacctgcgtatctgctgcatatgtgggtggggtggggctaggcccagcctttgtatgttctttggttggtggttcagtctctgggtccaggttagttgactctgttggtcttctgtggagtctccgtctgcttcaggttcctcagtccttccctcagctcttctacaagacttcccgagttccatctgatgtttattctaatgttgcacctaaacttaaggatttgcagcggtatgaaggagaactttaccattattattattattattatcattattattattattacttggttattgttttaacatggacgtaaagagacacctgtatttgtgaaattgacaagggacagatcgtaatcactattccgggttttttcggtttaatatctaaaaggaaaagcttcggtccaggcacggtggtgcacacttttaatccctggagatgagaatcaagcagacttttggttcaagccaccctggtgcagaaagacttttaggtaaagagcagcataggtacgggcaacatgtgacacacctttcatcccagctttatgtctctgtgtctgttttggtcagccactgggtagagcctctcagaaaacagttatgctaggctcctatctgcaagcatagcagagtatcattaatactgtcagggattgattcttgcccataggatgggtctcaagttgacccagtcattggtgatcaaaatatatctattttatttttatatgtatgagtgttcgcctgcatgtatgtatgtgcaccatgtacaatatgtgcctggtgcctaaagagtccagaagaggccatcagatctcccttagaagttggtgatgtagtgctgccatgtgggtgctgagaactgagtctgggttcctaactgctgagccagctccccagcctgagcaacggagttttcagtatcatacttagcagtttgcagatctccaatgaggaattcaagatctgactcaacaagtctcagggctttgtgagcacaccgaggtttgtagaggagaggaaatccagggctgcatacttggttcctaaagaaacactgtctttctttcagcactggctggatcacgcgaaacccataaagaaacagatgaaaggtaagacacagactccagtctattcatgccttttttttttcttttgtaaaaaaaattctgacagtaaactgctttgtcaagatttctgagatcttttgattggtaaacagatccagtgttaaatgggtggtttttacttcctgtaaactggccaaaaagtagagctttaaaattgaatgagtactttgggtagatattaaaacccacctgtgctctcatttcaaatcagacacccctgccaatgagagctgactaatgttctattcagaaagctgtcgccccctttgctcactgccaagtaagtttcaaagcagcttcaggatggggagtgggaagcaggaaggctccagctcattccttacaggtgtggtaaccatggtttcctaatgctgtttatgcttagatcatttggagatcatagcctcttaaaagtaccttacggtgtttttgcggtatctgtacactcagagcactttgctccttctgtgtcactcgcctccagcccactttgtacttggtagaatgtggatgccagtttggagtaatcccgtcagagataagaggggaacgccagctgtttgtaacccagtcagggtttcctgccagatgaggtccccagctaaatcttcccatctttgcaactccagatggagcagtgagcttgctgtcagtgggatgtgtttccttttgtctgatgggggacagacatcttgacctttctgtctccaaatgtttagtgggacctgcctatgccttgcactttcgagtcaaatactattcttcagaaccaaacaaccttcgagaggaatttacaaggtaggatacagcgggcggagagcattctgtccagtagcccctgcctcagccagattgggggaatatactcagtcaggggtttgattcctttttagtcctctgtttctaagcagaagttactagcactttctctgggctcctctaccctgttaaaaatccacaagtctggttaatttggtatttttcatatggatcaaattatacgaattttcttggaccttgggaagtggtaggctcatctttggcattttgtcttcatctccatgaccaacaacaaaagcagatactgggagaaggtttcttagtcaggaattgcctcctcttcctcttcttcctccttctcctccttttcctccttccctccttttcctcttccttctttttctttgaagttttgcaaaacactctgattgttccaattagaggaacccctcacataagcagctctgtcaccaaagactttgttaggacccacttatatctcttagccccactggtgatttttatgttgcgagtgcctatgtttacttcttgaattttagaatcagtatagaagaaagggagaatgtaaacgggttggaatacggagcttcccttccatctgtggaatactttatggagttcttgatatccctggagtgtccttgtcactgattgttcatgtgatgtattgtagcggtgacttgcacattgatgggtggtctacattgatggccagcaacttggagaggagtgacatttgaaagttattactcgtgcccatgacaaggcctttggggcttttcctccaggatttcttcatgggagccacatggccaccatgccatagttggtgtgtctatacatatcagcatactaaatttgagaagttatactttaggacctgctgagaggcagaaccttctggaatgaggtagaaccttcagccttcctgcccactttgacttctggatcatccaaagtctcctacaaaaggttctacagaaaagggcgtgtccacaaggcgtccgaggctcaacttattaagcaacttcaggatttctctttggagttctttatgaaacacgttgcccctagctgtcaacagagcagatcatttttaaggccgatatgtgagtcagaaacaaacaggattccactctcaagtgtaggatcctgactctataggcctagagtgtagcgggctttgtttggtacaaagtggttttggtggccacatcttcctagaaataaaaggcttttacttaaagaccgatacatctatttttaacttggtgagccctccttatgctttttgtctctttttccttgtttcttattatccctgtaattttttggtagggtaattctaggtgtgtgtgtgttgtatgtgtgtgtgttgtatgtgtgtgtgtgtgtgtgtgtgtgtgtgtgtgtgtgtgtgtgtggtgtgtgtgtgtgtgtgtgtgtgtgtgtgtgttgaatggtttgcatgagtgtgtgtttattttaaagacagtcagcagttatacttcaccaggaagaaaagtatcactttgtagcagactctatagtctgtgtagactttttgaaaagcccttggatctgggcttaactgaccaggtgccagctcagtggttccgcccagcccattttcttggatgcatcatatgctggtgcagaattttccgtgcctgttgggctagactctcctgcaccaaagccaccctgcaagtcacatccgactgcatccgcgctccatcctacaagtgtcttgccagctccccacgtgggttcccagcccattgagaccagggatgcctttccacaggctcaggaggagactccctccctcctcatttgcattggacttcctttgacagttcagaaatccagggcacttgcaggggtgcttgtgatgggaggctggggattggaggcggctggggaagggaagggttcccctctgttgacttttgtatatgtttgtcaggtacctgtttgttttacaactcaggcatgacattctttctggaaagtaagtatgcttttgttctacctcttaactcagcatggagcatagtatccctcaacactgcactgttttcactctttacccttggcccctttaccaaattcaaatggtgcacgggttctgtcaactgagttggatacttgtcctgctgtcactttcctcccattttacagcgattcctacatgtcttggaacgtttccaagggcattgaggaccttaagtgatgtgtgtttgggaacaactttctccctgccacatccctgccccattcacacaccgtcagcatgtatacacatggcaatttgtgtttgtgcagtttaggaagtctcactcattaccagcacactaaagcaatgtaaagaggcccttgtctgacctgtaagacagggctgtggatttctcatctcattgaaaggctctttaagcccgaggcattaggcttgcagtgagtatgaagcacaaagcacatcgtcacagaagtggttggttttgagggggcatcagtagagaaagaaggctgacaaaatggctcagccggtcaaggctcctgcagccaagcctgaagacctgagttaaatccctaggacctgaaagttgtcctctgttctctgcacatgtgctatggcatgtgtatgcacccccaccacacacacacacacacacacacacacacacacacacacacacacacacacacacacaattctatatgaataaataaatgtaaaaaaattagtctttatcattttctagcaagagttatcgaatattttgttacattaaaaaaacaaaacaaacaaacaaaaaaggctatattaagaccagtacctgatattgccagcaggaatatgttctgattttaaatgtaatctgaaagaaatgtagtggataatttctgccatcctcgaattgcagagctagggaagcagagacaggagggcatcggtgagtctgacactagtccggtccacctagtgagttctaggccagccgaagctacaaagtaagacccagtctcaaacaccaaatccagatataaatcgattatataagtaagtagaatttgaactaaaatgtaatttctgtgtttgtaaattcttcataggaaacacactctgaaagtttcagttgcagagaggtaatagaatatgagtagactgtgcagtgcatatattggccttactcagccatgggatacagtttctggttggtgcgtgctgagtgtctatatttgtatctctgtccgtcctgtgctcatcatactaaaggccccatacctctagaacttgcctttagtttgtaaaagcactgacggcggtacttcacctgtgtctcgtgcttcgcagtttgtctccactcccacccagctagttagcgtgtcactgaaacagtgttctgagccagcactgcctcctgtcagcaggaaggccttgggcgggaggctgaaggctcacaagagatggggatcagggtgctggcttcaccagcgggtttactgcatcagtaggtctgcctcagttggacctggcagatactaagtacatctagaggtcttagcagttgtgtgtacagtgctgttgtgtgggttattacctccaagactttgttttaaggaagatttgaaggcagctcgaaaagacaaatgactgtatcaacagaaaataaacaggataacaacacaaaggaaaggtttctattctgtttcctaaacatcccaagttctttatactcatcggaagcatctgcgtggttggtaggacgtatacttggatagataggttgagaactgccttgttagtttgtgttctttaatgtagacactgaaaatatgaaggactagcatcagaagccgtatttagatactgctgacttttataggacattggtacatggttataactgtaaccttcctatttaatattcatttctttttttctcccccgaagattgaagtgcccctatgaaacggccgtggaactagctgccctctgtctgcaaggtacattcatccttcgtgacagttcgcatcttgaagtcattgcttttgttttcataagtgagaacgtgctgtatgccaggcccggggccccgccttctcccaggatgtaaaggcacatgatgtggtctcagttcccaggagctcgcagtctgccgagggaagcacacagagattatggcagttccctagcagcagagatacacaggaggctggggagagggaggtccatggggatgtgggaggaggatgactccaagaacaaggtgtaagtacagagaggagcggagatgcggctcttgcttggtatgcacaaggccttggggttccatgcctagtaccttatgtgtgggtatggggttgtatactcggggactgctagaggtataactcggctgaatttactcctcagcattcatgaggtggtggtaggagaatcagaaatcctaagtcatcctttactggatacaagtttgaggccagtctgggctacataagaccccatcccagaaaaaaacaaataaacaaacaagcaaaaaaccctgaaaatcgagcaaacagtaatgaaagtcacagggacagtaagtgtgtagtcacagtgtgaactggagaacagcccctggtcccacttaaagactataaacttcatggggccagcagcaattctttgcgcgttcttgagccggcaggcctgggtggtgtgtgttttggaaagactgcatggaaagaaggaactggagtggggctaggtggggtagggtgagggctgttatcgtaacagccgtagtaagaatgggcaggtgggtgtgcacacaatgcaagcagccgccctgtcagtgccgggagcctggttctctgatgagccttaatgtgaggaaggggtgagaggactcaggctgttgccgagggtaggtggtgacatcagtgagtgggcagaggaggaggaggctcctgtggagaagtggctgtctgggccttggccaagaggtgctgaattcaccagcatgcaagtgggaagtggccggcaggaggtctgcctgcaggactgtccacattgactgtttgtctgtgcctttcagttaaaatgcacaggaagtgcttgcttgagtctcctgagctatctaagagaacgggatttcctgagcttgtgcttgtcagtgctttgctgggctatgatctgtgacacctcctctcgtggtatttgtgaacatcataaaaagagatggctcttactgttatatttttctaattacagttttttatttttacgtgtgtgtgtgcgtgtgcgtgtgtgtgcatggaggtcggaggacaccattggagagtgtgttctctgcttcacgcgtgggttctggacgcgcagctgaggttgtgaggcttagtgcaagggccttgacttgccgagccatctcaccgcctcgtcgtctactaagttaagaagagctgatccgagagatatcacaatatcaggtcacactgattacagactccgggtaggtcagaacagcagccaggcaggtcaaagaaaggacttgatgtcccagaccaccacccaccagcacctacatcctctgttaatgagtttagtttagtctgatttttttttttttttggtaagaaatgtaactcagattagaataataccgattcttattgtgtgttgtttcttagtattcttgctatattttaatttagtgtgtgcatagatcagaggacaacttgcaggaatcccttctcttctagacacgggtcatggggcttgaactcaagtcatcaggtttgtcggcaagccttcacctgccgaggaatatcactggccctacttgctatatttagtcaccgtgtggtgtcacatttatatatgtaaagatgttttgtggataatgtgcatcttcccatccctgaatccttctagaccttagtcacctcctagcagatgctcagtaagtgtagaatgaacaagaggaaggagcttggagagaccctcagtgtagttggagagccctggtggtccttctaaagccaattgtgtccaatgcagagctacaggcttcctctccctgtgccgtctgatgcagcaggcctcctggtgagtgccacggtgtaggcagagttgggatcagggcagcagcgttcctagcttcttttgttggtcagatgcaaattttaccagtacagacagtagccttcatgtacactggttcctgagctgcaagaggcctagtcaggcttggcagccccgaaggatctgtcagggtggtgttaatggaaggaaagcacccaagcacccgtgtcaggcctggggctattaatcactgcagaagcttcctccggaggctgttggcacagtgttctaagcctgtcttgatgtcctgtgtgatttgaggaggaggcacctccctgtcctcacgggtccagcggcagcaagactgtaaaagcagcaaagatgagagtgaaaaatgtgagcaaaagatgagagcctttcttggagaaactacccatccctatagtgtaatttaataatgatcattatgccaggtgtgaatcaatacttggaagactgagggacacgcagagaagcccttctcgggtcgtcatcccatggcgctatgctgtcctctgtagcccagccaggagcccccctgtgtgatcactagcttcactctgtggtgtgaagaaaatgaagggcagagttccttctggcggttgagcctttcaggcatatctcagtgttgttcttgagttaatctcgtcccctgagttgagatgctgtgcccttctgtggaggacatgctctctggggaatgcatgagtggtagatttgaaaatttatccaagtgaaagggtaaaaggaacatgagatcgcctgtttgtttgtatgaccgctcccacgtttcgggtagagatcttggccctgggacagttcagtgatttgcctggagcacacagacacctgcttagagctggagtttagtctcttacatctgagctacagccttcatggagcctgagcctggctgtagaattaggagattcttggaatgcccacttctttcagcttgttcttggaaggcagagtgatgaccagggtgctcctcaggcctgcttcagtgcaacagagcctggaggggacactgccttcgttcttactggtgtctttggcatagtttatcctgccaattcaggacaccagtaaacacagggtcttattgagtcatgtttgcctgtgggtacaggagacaccaaaggaatctctctctagactatacagagcttaaggcttgccagcacccattccacagtgacctcttgggccagggtcagtggtggtctccagtttgaagaacccagtcttaccccttttctgactatactttgtttctaggacaggatttcatgtgtgtctccttgcctggacaaaaaggctgctgcatgccctgacccagactcctatacactgggtctcagtgatgtggagggtggctttccaatggagaagtatttatcagaccatctctctctgcctgacattgtcttataaaggcacagtgtccttgactttgattttattgcttcctatgcaggaatgggactgttttgtttcacgttttgaggctgggtctcactttgtcttgccctgaccttgagcacaagagccacctaccataggctgtctcactgctgggatttcaggatgtgacacaccacacctggccacagggacattttatccattctgcaagtcaaatggagtccctctcctgaaagatgggttgtgagattttggtcctcagaagcacaatggggtgatgaaaatgtagtgagctgctgttttcccaggttcctgggcatgtgtggctccgtccaccggtagatccgatgtcttgagacatcaggttccaggttttcttccgttcccaggctagctatgtcagtatcacatggggatttgttagacgtgcaaattcgatgggctggatgcagcccaattggtagtgtgcttacctagcatgtatgaagtcctgagtttcctccccagcatcacataagatcaggcatagtgctgcactcagaggagaagggaggagggtcagaagttgaaggtcagccacagttacattcaattctgggtacggggcccagtgatgtcttgctttaatgagcccaccaaatgagtcttctgctttccacattcaaaacaagtgctgtggctcgctgtctctccaaggagagtgcacccattcttgagggtaaaatggaggcagcaactgggctctcctgggtgggcatgcaagtctgcgtggtgatccagccccttggtgacatctatgcccgctagcctgaagcccacacttacgctctggagggatagggccaccttgtcctccggcccaggttttgcggcctggcaagaacaggagccatgcagtgctcactgggctctttcctgggcaggctcctgttgctctccctctctggcacagcagccttctgccttctctccttctcctttctgcttgatttgctgcagttgctcctgcagcctgctcaccctcctttgctgctcctggatccctcacttgcatcctgcgtgcaccaaattcctcatccaccctcccccatccctgcaaacacttaagtgtagctctgccctttgcttaaagagagccctgtgcaaaagatgcttacgggccgatcctcgttgcctgcaactgccttttattgcaaattcccacttcctggggaaaatgtgagccaggcttccctaagtgggagaagcattgaggagaaagccagtgatgactaagatggcggattagaatgactcttggggactctgagggaacctgataatgagggggctgtacatcaggggtgctcgtgctttatgatcagaaagaatgcctctggacttggttccagtaataacccaaagtgttcaatgtctcctgtgttcaatgtctcccgttttcctcccttctatgaactgcacagcggagctaggagaatgtgagctcccggaacacacgcccgagcttgtgtctgagtttcggttcatcccaaatcagacagaagccatggagttcgatatcttccagagatggaaagagtacaggtacctccatgcgcctctctcgtggtctgacctgcttctttttttttgtgctgtgtgtttgtcagacccttctgacaaaactatggcctgccttccgcagcacagtgtgcctgagaggctcagtcaatgaccagaaagccacagctctgggttgtagcctctcctgtgcttcacacctgtttcccaaagacctgtgtgttacctttttcctgagaaatgtgcaaaggtcaagccatgctgctttttgccttgggaatacatacagctcctgtccgatttgatccttgcttgctagtaacaccccaagtgtgggtaatgaggagacgctgcgcttataaggtcctattcttcccgaacagaactttctagaacagtagttctcaaccttcctaatgctgggaccctttaatacagttcctcatgttgtagtgaccccaaccataaaattatttttgttgtttcataactgtaattttgctactgttatgaatcctgatataaatatctgtgttttctgatggtcttaggtgagccctgtgaaagggttgtttgaccaccaaagaggttgcaacccacaggttgaggaccactgttgtgggcaaaccctttagaaatacatgtggagcatccctacctcccaatgcctgaatctaaagtgtgaaacttttgaacaccaacctggtgacacctttgaaaggtccatccctggcttcccgaggcaggcatgaaatctaatcataggagcagtctttaaatatggatgaaaccacctcaaggacctctcagttctatgtagcgggttaacgtggcataaatgatttccatgttcagagttggggctcaacccccagggtgtctcattgtcttcacactagtatttgaaaatctgaagaagggagaaagaaaggaccacagacagtgtgggtctcacacttggcctgacaccctgtggtgaaaaaatattcatcattgagaccatgtgactgacatacagtactacatgtccagaagtgtgctcagtgtactgagagccagcatgacatatatcttccatgtctcccttctgccaccatcctaatctaatggatttatttttgttttgcctggaccagtaaggcagtttcccagtgattcacacatgcacgcatacacacatgcacacgtacacacaggccacaaactacccattgataattcctcttggaactagcacttagtgtgaccttttcatgtctcccagttcctatgatgacttttaaaatttaaaaaatgtcatgatgtgtcttcatccagtgatgggggagtgtgcagacgtacagtcaatgtgccccgcccactccttcacacgcagcctgctttctcccagaggaagggcagggggaacaagcttttcctttgctttaggcccctgctcttgttttcttaggttattctaagaaacaccatcctgtggtcttccatttccgttaaccgtgggtgcttggagattgtttcccatccttacagacttgcaccctccattgctataactattgtgtgaccctctaccacataacgggcttttcacgcccctgccggtgtgtgagtcctaatttacatgtgtctccattggtctttctaaggggaaagagccctgcccaggcggaactctcctatctgaacaaagcgaagtggctggaaatgtatggagtggacatgcatgttgtcagggtaagaactgtgtatgtttgtttcattttattttgctgtttctgaaaaaaaaatgtatagcgtgccaacaaagtaaattttagtgaggaaattgtttttacgttcttctctgtgacgacctgttagaaccctctaccgactgtcacttcgtttgtttgtagggaagagatggctgtgaatattctcttggactgaccccgacaggcatattaatctttgaaggagctaacaaaataggcttattcttttggtaatttagttttgtctaatattaaaaatgtcttttcctattttcttgtgttggaaagtctatgtgatggatgattttgaggggaatttgcaacacccagatttgctttaaaaaaaaaaatcacaccatcctattgtgcttgtggatgtgtggccagtgcactgaacgtctagctaatcgtatttaaacgaatgagtgatgattttcttctcttaccaatctaagcttttataagtagaaaggaaactgtttgatgtgtagacggattggctgtagactgccctttttaaaatgctttctctctgaccaggcctaagatcaccaaaatggactttaaaaagagtaaactgaccctcgtagtagtggaagatgatgaccaggtaggtctcgctccccagagtcctccttgctgccgctcactggcatccctgtgacctttgctccctccctcaggggcgtgagcaagagcacaccttcgtgttcaggctggacagtgcgcgtacctgcaagcacttgtggaagtgtgcagtggagcaccatgccttcttccgtctgcgcacacccagcaacagcaagtccgccagatctgacttcatccggctgggttcccgcttccggttcaggttggcaattgctttatgacatggaccatgtgtttcagagaatgacagctcctcttttgtgtatgagtgtggcagcggccatttgtgttgtttgccccgcccccacctccttgctaaggaccattatgacctctgttggtttccatcactttcctgataaaatggagctgagttgggggtgaagagcctgtatctgaagtgcttggtgctgggagtgtttgagatgctgatttttttttccagtttggaactctttgtgtatttgatattgcaaatatttgagcctggagcccggaatgttatagatatatgggtaaacgttcatcagtctaatgacaaaatttgccaggatctgaccttatagctagagctgtgttgtccagtgccgtggccactggttgtgtgaagctgtggaagagaatgactgtttaatacattgaaaactatagttccttggtctcatccagccacttagctggtgttcagcggccacatgaggtagtgactgcctatgagtagagcggatacagcacacgttatcattacaggaggttttgttagatggtgctgcactggaactctcacagcctactcttactctgagaagcagccttactgaagcacatgcagtgtccctgtgtgaccagcagcagtaggctcagactcacatccagtgtccctgtgtgaccagctgcagtaggctcagactctcaagcagccaatgagccctagagtagagtagcatcagccaggctggctcttcctttgtgctttctttgtctcctctctcttcttcatatcttctaggcacatctagaagttatgatcctcctgtctctgcctcccaaatggattatgtgtgccccacacacctggccttggtgcttctgtgtgtgtgtgtgtgtgtgtgtgtgtgtgtgtgttgctgtttgcacgtcttccagtggagttatatatacatacatacatacatacatatatacatacactcacgtgcatgccttgtgtgcatgtgtctgtcgaggcctgagaccaacgtaggcgtcttcctcagttgctctccatctttgtttttgagccagagtctcttactgaatctggagcttgctgattgaggtaggctggaaacctccaaagaggtttctctacctccccagtgctagcattacagacagcaaacagcaccttgctgtgtccgtgggttcaggggatctgaactcagaccttcatgcttgagccaggacgttactggatgagccatctccccagtactagttcttaaattcctcaccactgctgtctcttttcacatgccaatgtcaacagtgtgtatgtgtgtgtgtgcgcgcgggcacgcgcattggctctgaaaagagcctgaagaaataactaattgtcacatagttttgcttttgagtataagatgagtgcatgaaaacgtctggggcatccgtgagaaatgaaagcattcagctctgtgctcagagtctgtgagtgtgcacgtgtgtgtcagaccttgaaatgtgcattttgatttttttttaaaatttcatttatttatgcgtatgggtgttttgtctacatgaatgtttgtgcaccatgtgtgtgtgcctggtgtctgaagaggccagagaatgtgtcagatgtcctaaaactagagcactactgtgtggttgctgggagtcaagtctgggccctctggaagaacagccagtgtccttacccgcttagccatctctccagcctagaatgtgcattctaaacgcctgtttggagtctgagaatccgagttacatgatagagaactctgcttggtttcgtaacctctgcccacacatggcatgtccctgaactctgtttaaaatgccaggcgtgctgctcgcttcagatttatccactgtgcgaggaaatggctgtgtgcttctgtttaaagaacggtctttgtttgaatgtatttcttaaacgctccaaggaaggggaaaagaagaccaagtccttgaggaaaaggattcgcatcacaaggccccaggaggatggaaatgtcagcatgcagaggttcgcagagccgctgcggtctgcccgtatccatgtggatttggaactgggtggggagggcagtccaggagattgccagagtaagcaggcttttccctgctggggagaaacattccagttggctcagacctagtgaccttcgttcctcaaggagacatgaaagaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagaaaccaagtggctgatacttacgttgcaggttttttcctttgatagacagggattcttgcccctgtgcctggcctggcaaaggaggctgtatttccaaataggagctttaaacttagcatgtctttaccaggagacttcatgttaagttgaaatacacactggagcgcttgagaagaaaaaaaaaaaaaagtcaacggcaatagccgtggtatgccgagagctgctgctggggttaatgtgcaaccaaatattttcttcccagtggacggacggaatatcaagctacacacggctccagattgcgaagaaccagcacctttgagaggaagcctagcaaacgttacccgtcccggcgacattccacattcaaaggttgtacagtgttcctgccttgctgacactttacagcggggtctatgggtctgctctctaggggcagaacctaccgctcttaccctctggtgttcagaagctgttgaaaaagaccgagtctttgtgccctccagtcttcaatctttctcctggtcaatgtgttcctttgcctcctgtctgtcttcctgcgaatgtgcctctctacttactttatgcttggacctttgccaagcatagagggtactgcatccaatgtccccactgcctccccattcctgatggggacatgggcgcatgctaaccagaattgtgaccacagaagaatggatgcccaacctgcagggacacagttcaggtccctcatagttggtccagatatactcattcctgaatatagctgtaccctggacttctcctctcttcctgatcagaattctttgaaccgaatatccctcattgagctggctcacacctgtgtcgggcctgaaaccagcagagtgtatcagacagtccatgagcattcctgacttgattctatttaaactggatttcataatcttagcttggagctctgcatagctcatctctctacatggattgctactctgtctgatacattccaggtagctctaaattgtttgtgctttttttttttacaacaaggccatcacatatggcctctgctaacctcctatactagataggactattctggacagttttctgtgcatatcttgggatttaatgggcctctgtggagccttgcttatatacctttgcctcctagaatcttcagcctttttctccctccaccctgttcccttctcttatgagccaacagctcagtagcatgacagtcaacaggtcttcagtcatccttggctgctttagtggaggagaatccagaaaatgtggccttaactaggaagggccagggaatgggaacatgctcaaagggatgaaggtgactgcagcagtgtctaagggaacagcaagggctgagaactcctgcagagcctttgcctccattagcagaactacgcttgggggtgggtcgggtgtgcctggggaggttgtccattgtattacaggggcctagaaacagaccagtcctgggaacagctttctaaagaaaaagcactattttgatatatagctgtaagcacccagtccccacagtgtgtgctcacacaaggggagcaagcatctggtgtagctgtagaagtggaacatatggcaggaccccagtgggtagcttggggctgttctagactctggttccgagaccccctctcaccctcctttctggcctctagatcctccttcttcatttattttattgatggtttttctagctagaggcctggtatcatctttgtgaagctttgaatgattctttcccctggcatgcctttcttgaaaggaagcaaggagagccgggggtgggggtgggggtggggggtataaggcttgcatggtagagtgcttgcctagcacagatgaaacccctagatttgatcccccagttttgcataaacctataatcacaactcttgggaggctgagggcaggcgagtcagaagttcaaggtcaccctcacctgcatagtctttgaggctaacctgagcaacataaaactctgcccctgtcaaaggaaaagtgtgtggggagggggagggggagttggggatatagctcagtggtagcaaggctgtgggttcaatttccagcatcacacaaaacgaagaaatgtaaattgaagtatagttgaataaatatttgcccctttcatgcaggctctgcctcaataaaaatgcccactctaagtccttccataaatgcctgctggtatttcatccttcatcctgttatactgcctttccatcccagactgaattctcctcaggagcaagggctcacctgtggttgtctccagtgtgcctgcataccagtgcacccagtcctgggagcctgctctgagagttgcctagaaacctagacgaagcaacacaaggtagagagagggctgttcaggtcatcagggaaaaagtagctggagttgagggctgcccagcttgagatgaggagtgtactctgagagagatgtccctgtccagtatctctgtgtgttagttcagggtgaatgttggaaagttctgcataactttctattctgcctttacagcgagcaacccaataattgctgctcagctctggtaagtacccccagccgcctcagcacagctcccccctctaattaccgtgtttgtttgcagtgttgactttctccttaatacaattaaacccaggtgactcacctgataactctttctccctgtactgctgcctggctgccccatcctcccagctgtcaataagcacacaacagaatgttccaaggctttcttgttgcaaaacagctgctttgtttgagtagcacagagctctgtttgttgtcgcagtggtaaggtggcaggcatgcatgcagcatgtgcagtaatggtgtggcaggcaaaggcagggactgaacaccaccctcctgggcaacaggtgctgctgtacccattggctagcaggtgttaggagacactggccaccaccggaggggctggcgagatggccgagtgggtagaggcgcttgccatgcaagccttgggactcatattaaatcctgaaacctatgtaaaggtggaaagagagacctgacctccacacgggcaccatggcgtgcatatacatcatgcacataggcatgtaataataagccgtaaataaaccacatacagagcttctgtggaaactgtgccacaagactgaaaatctccagtgtgggacgttgcaggcttcttaccgggggacaggtaggaaatattttgaattctaggctccgacatctctttcagaaatattcagtgctgctgtagcaacagtgaagcagctgtagacactatgtaaacaagtgagtatggctgttaataaaactttattcataagtaccagtccaccatagttgatccatggatggaatcagctgcttcttctccagcacaggtgttcctggtcctgcctgtgtctggaactacctgacgatgtccctattgggcaagaaaaccctgcaccatatgaaaacatatatacacatgtgtgctctatgtcttggcggggggggggggggctctagcagtcagggtctctgcagatagtgtgctgaaaactcctgacattttttttttttaagattcatctatatgagtacactgtagctgtcttcagacacaccagaagagggcatcagatcccattacagacggttgtgagccaccatgtggttgctagaattgatctcaggacctcttgaagagctgtcagtgctcttagccactgagccatctctccagccctgtgacattctttcagtcaggttctgcttctaattcttgggagtggagtggaagctacagtattgcttgctttcttaggagatgattgttttgtttatgtctccctgataaggtgacatttccctcagaatctagggggagattatatattgggaatgaaaacaaacattaaaaaaaaaaaatcaccacacacacatacaaaagttgtcagtaaatataccctttaggaacaaatgagttaataaccaccgttggcggctgtttaatggctctttccagcctgtggggtcctggtgtggaattgctaggggggaccatggatggagttgtgctgggaactgcagatgactgctagaaaaacagcaccttgtagaccagtttatccacctgccgaggtccggcttaggaggtctggatcacagcctggcttttctgccaggcctctctgaagactaactgcagacctggtgtgagactccgaacaaaggtgcctccctcccctcctactgttagaaagacagtaaaccctgattccaggcatgtcaccctagcagccaccctagcaacggtgactgctcagtaattgctctgagcttcggaggtttccgataggtgctgagtttgtgtcttatgcaacagatctctgtttctctatgtgtgtctgtctatatgcctctctgtgcatatacatacattccacacccatatatttatgtgtgtatatatgtttatatatttgccaacctagttctaattaagattctaatcaaattggatcacacttgagtcctgaatgtttccacagaccctcggattgcttttaattctcagagggtggtaaactacagtatttcttgcttatgaatttggtgggaagaaaataggctttgggtctgagcagatgttgaatcaaccctggcttagccactgagtggccagtgatcctcagtaagttttctcagtctctcttaggcaactcttcctttgcctgtgaattgaggtggtaggaagcatcctgcacgccatcaatctcttatggagattaaataataacaggatagaggcttggcctgaatgaacagacattcagcaccagtgcccagagcagcagcagggtcagtatgtgcgagggacccatgtgctgcggcaggtatcttgaagagctggtacctcttcctcctgctgcaagaagcagaactcgagctgtagcctccggggcagtgccagggagctcctgcactaggacctgaagctgcttgatttgcctctgcatggaaacccacaggtcacagctgcacccgggcatgttcctgggatgtttacgctggtgaggcttaaagtggagagtgaaagttggttctgtggtttccttgattatacacttaacgtatgctctggcaagctctggtgcccaaagcagaaattcctatttgagtagggagcctgtagaatttgtaacagctgtcaaatagatccgtgcctccttacaactttaaaaatgatggtttttctttcttcttctcctttctagctctaaagcaaatcctgaagtccacaattaccaggtgagatgctatgtctgagatgtttggaaaagcgtcctgaattttgtgtgatgagcgatatgtaggaacaatatgtgcttgttaggttttgattcgttcttcctgctgtcttccagaaaactctaaaaaacaaatccttctgtcctggcccctgctccctcccaggcatctgaagtacctgtttttaatcttgttaacctgcgagtgctaaggacgtgtagttatgtttctggttggtcaggcacaagctcttagcaacgttcaagtgcatgcctttgtggaagtgtgctgcagaccttgagagcacgggcccttgagacaagcatccacaggggagagtttggtcaaggatttgggagactccacttcttccttcatttgtcgtcttggacatgactgggcctggtggggggcaaaagtaatgagaaaactgccaggaaagaaggcttgtttgtttgagatggtgtctggctctggatgttgtagaactcactatgtagactagtgagtgccagtctttaactcacagagatccacctgcctctgcctctccgcctctccgcctctccgcctctccgcctctccgcctctccgcctctccgcctctgcctagtgctggggattaaaggcgcaggccaccatgcccagagatggttttgttgtttgtttggttgctttttttttgctgttgtttttcttggtccttcctccagccccttttcatggcaagcctgctcacaccgaggaggggggggtgcggcgtcatttatctctcgaacccattttgtcaaacatcaggcccaggcattcagtctctcggcccagtgttgtgttccttccaagcagtaccaaccagggtctatgccttctacctgcctatccacctctgctgaagccctccatagcccaccctgtcacagctgttgtgggtagccctgtctggccttccgcagccagcccagactccttccatttgcttatgtctcctgttggaacaggtgttcagttcccagcagctacagtgtaagcagttgcccttaggttcctgttagtgcagcttgcccatgcttgtccacctggagctctttgcctcttatctgcttgctacagtatcttccactttgggagcccctcctcctttgcttttaagttggaagctcccagctccagtggaattcagctctttgtgttaaaaccatgtggccggcattactagaataaccaccttctcctaacacacttgagtaggaatttggcatctgtagacttcagagatcctaaggtgactctggatggatggtatgtgccttgcttcccagatggtcatttgtttctgcttaaaggtgactcctaacttggagtcctatattagtctcccccacccccaccccattgctgtgacaaaatacccagtactgtctactctataaagtaaaataagttcatttaattcatagctctggaggttcaagagtagtgctggtctccgctcagctctggtaagggatttgtggtgtaagaacaggagtgtatgtggagggagagattacatggtgagatggggagccagtacacaagggtccaggagaactaaccagggtacctctgaagacccccaaagactcaatcacctcgctgttgggtggccagcccttgcaggagagagaataaaaataagaaagtaaaaacagccccacctgccgtgaccccgccctcttctgcctccccttgatttctgctcccagtgaccatccagggctgtgcttgttcatggcagatctgcgggcactctaggcatggatctctccacagggttgctaggagaccctgtccttggccagtcttagcgtccctgtgtcgtcccatcagagtttggctataagtggactggacacttcatgatgctgtctgagaagggttgttggaaaggggataacacagcagcactgttcgttcttagagctacagagtcagccagctgcagagtcagccatgttctcagtgaggacacttgtctcttgaggtggggcaggtcttcattgtccccgaaattccagtaaacttggcttctctcttctgttattgtgacaagcaaagagacacacatacattcctcattgtggacagagtacctgaggtagcgttaaagtaggagatataccaaggaagggtctggaatctccttttatccccaactctgtggatgaagtttctgcccctctctctggtgaatccagtgtgtttaaaagcacggaagagcagagggcctagttgtaggttagtcattctctcttgttggagtcttagtgtgtggagcctggttatggctggctttgggctaaccacccaaaccctatgggttttggtgtccccaaaagagacaaagagaaggaggttgcaccaggtcaggactgaggtcttcctgcagacatgcccctccagatcccacgctctgcgccatgtcgtctgggggtgccaacaggcactttgaaggaggaaagaatggctacaggaatacagaataggcaggcagcatgagagcctcgcagggccatgaagattgaattgaacagaattgcagagaatttctgtaacagaaagcaggccactgcttattaaccacagcagcaggggcaaggaggaggaaggaaagaaataattaaaagattaatggttgcacaattgaagtgactttcaggttgggggagcagattttaccccatatcaagtttagccttaagacaccccatggcttctgacaatgtcccgggctgctgccctctgcaggtaagaagtggaatgacagccagccagctaccctgctaggcccatccaggcgtcacactggtttcttaatcttctagggaacagcttcctactctccttccttcagtccactccagtctccagtctcatcaaattaataggtcctcctaatgatgttactgtttatgcacccacgatactgttgctttcattactctgtccttccagccctgtgtgtgtgccaatgtagctaggctgttacgtgtgtctgtctgtcatcatctgtttgtcaacaacaaaagtggcttctgaagagagaagccactcagcccatcttccttgtgagaggagtgttgtctggccagggcatgctgggtagactcctttgagtcagatgtggcacctggcctcccagatccttctctggagatggtatttggtgagccaagccctaggttccagcccccaacacctccccatccccctttgttagggaagaaaggagatcatcctgggaaaggcccagctgcccctccccccagggcttggttccagcttcctattcacagcccccttggcctctgaggtgggtgcccttgctggagaaagcaaactgtgtgccggccattgaaatccaaaggtcactgagtaatcagctttggtgtttcctttccagcctcagtaccatcctgacgtccaccccagccagccccggtggcgccctcactctccaaatgtcaggtgagtttgcgagcttacagagacctgtaacagagacctgttttcctgtcctctggaaggcccccctgcacaccgcaggaacaactcctcagggcgacaggaccagggcaaaaccagatgtttttcacagcaaaggaagcaagggaccagtctgtgaaataacgaattttttttttcttttagttctaaccacaaatattttggtttggttttatatcagagatgttgcttaagatttccaagtaacattttcttattctgagaatttatgttcttggaatgagagtgaagttgtgtcgatagcgatttcctttttttttttttttttttaaggatttttttaccccttaggaataagggcaatgtttctttggtggcagtgttcagccaaggagagtctgtatttttagctctgtggttgctgtctgaagacaacaacaagcaatgaggatttgtgtgagaacacacgactatatcccagtgaaacccgattcacaataggtgggatttggctagaggggtatcagtatcccctgccactgccctaggagtgacctggcacctgccatgctatttggagtcaggaccatccctggggagcagacgtgtccttaagatttgcatttttaatgggtcttgattggcattgatgcttccagctctttcagaagcatgggtggtgacttcaggctgtgcgagggggagctgtgagcctttgcttcggaggaagcatggagaaggagcagtcgaatcagatgtggcttgaacaagttgggcaaaagctcatggggatcatgtgacacagtgggggcggtcttcagtagtaacacattgctattcacggagcattttagggcagaatatgttagtggggtgataattctaaaccttagtgtggctcagacgaaggtggtttgtttttcagacatgacaggtagtcacgaggcttagaggaggtgtcatcttgttaccattggtctaaccagatttcatacccggcattctcccttcatggcaatcccacaccgattctttgcccggaggcagcaggttccctgatggccaggctgatgccaggattaattgtctgctgagaaccacgactcagccccatgctagaccttctatagtgggacccaggtggcaccctgcactctctgtgttatagagctctctggagctgcatcctgaggagagttgattggtccacacttgtggcagatgctatccaaaaccataaccatgcacatcagatttaaggaggcttccccccatctagctttccctagattgccctgaccgctagacaccccttgcaaaagtataactttgccagaaacagcttttatgagcttcaaagttggtagacgatcacagtgggttgttttcttttttaaccttctgaagtcacctactactacttctgtgtcaggcaccccactcactcccccatcccaacccctgtttcctttgtgtatgcttgcttgaccacgctcatttctgaattgtcttccattctcccagtaaccattccatctgcaaacaaaacaagccatgttttcaggatgacaggccacactggaaaacctcagccagtggagatggcagccactttgactatgtccaggaccagaaccagaggaacttaggaggggcatacagtgtcacgtaccgggacaaactcatgaccgcactttgagagactgaagcctcctccggtcaccaccatggtgcctttgcattccatgaggagcgtcctggcatcgcatgaatgtttttgtacaagtgtcattagtgcttttcgtgtccctgtaaacatttgaagataacagatagccatgatttactgtggaatgcattctcaattatgaaggtagctaaaggctcaggaatcgttttgatatgctggctttaaaactgaagtcaaagtctcaaccatcatgctgtgtatcctgatagttttgtcatttatccagtggggccacataaagcaaaccagcaagaccaaagcttgggaaaatagcttagcacataggactgtttgtaggagtggaaatcgacagggaccagcctcccttgccgtgtgaccttagctaaatcattcccctttctttgatttcatttcctccctgaaaagaacgggctgggctaagtgatctccaaggtcttctattctgtgatctgttaagatttcacttctcatttggggtgagagcatgcatccagactaactccccataaggacaactataataccccttctgtagcagaagctcaataaagattacaaaactcattaggtattcatcaatacagggaggcttggagttttccatctgtaaatgggttagcccgtgtggaattgagcctcagtgctgatcaccagttgcatagcatgtttcactagaatttacttctcaaacgcaaggatgctttgtaatgtctcagtgactggtgctgctaccctgtgtgatcagcgtagaggctgggttccatcctagacttaactcctttgaccagcagcatgcagttgagatatagtgggggctcacaggagagcctgccaggtttctgcaggtcgtgccaaagcactgtgttgcacagagggatgcatatgcccccctccttctgtaggaccccaaagcaacatgttgtcttttagggtggaacttgtaccaaagtatttatttaccccgattcaagtagcacctctctaacctcgttacgtcttcataggcagtcccagggtgctcttctgtttgtgtttctgtgcaatcagttaattctgtgtcactttgatatatgtgattataatttggctccttttaagccctttgggcatgtgttaataacatcttctcttgctaaaatctggcctttttggttctatgaaagtctcttgaggaggaggggatcagtcctctgcacacttgcacaagggagtagaccacctacatataacctccccacaagatgcgtgtttacaggcgtgttccagttcagcaggtgttctcatccccagtgtatgtactgcatccatctgaataaacgtgttctgggtctcttcatcttactgctaacagtttttacaatgtgtctccaagtaataaagattattcctacctttgttatttttggggggggggggttgtttgtttttgttttttggactccatcttcattgcgttgattcttctgcacagaagcctccctttgatctcactcatggtacagttgactcagggtgtccgaaggtgaaccttcagttatgtggttgggacaaagccatccttcactgaggctcctataggtacagtgactggggtgattctcccgatgcgcttctggaagaggctgcagtacctgtctccatgtgtaggcagagcagggagacacctgggtattccctgataacagtcctgtggtgacgggtacaccttctcgtggttgcttacctcttcttggctctgtctgtggcttcttaaagatgatcctcgatcaaagccttctgcttaaactgctgatgagtggattaattagctgctgacatggactttctggctgtgacatagatgctttccgttcttcatctcggtgacctttatctactgcatggtgactgttcttgcggccttgtttttctgttcctgttggggatgggtgttgctcaggggtcccttctttgctccctacattcctcactaacaagtctcctagaatcacctcattctgtcaacttgtataatgctgttgactctgaaaacagctcggactatttgcatgagtttctgctctgacacttcagtgtggatattccatgcacagttcaaactctacatgtcaaaaaaaagtcagattcctctttgatcaccactcctgggatgcacaaatttccttccctctcacattccctcttgctaagggcgagtatatgcaaatatcagccacaactcttgctctgcctagctaccatatccaggcagttcgtagctctacttaacttggcttccttcatgattcctcccaacaccgtcttgcaggaatgtcttctcttgctctctgatctccacaacctttgccgagcttgctctcatctttctgcagccatatatgaagtgtcattccaggctgggctgggcacttcgcctcatctctttgctctagtccggcccgactcctcacctgcctgttggaacagtaatagcaaaccgctcgcgtcacacctcatgactgtcaccctgcaaatgctgttccttccacggagaatcctgtcactcccagatcctgcttagcctctaagcctccgctcagacgtcatcttctccggggactctcttgacagccctcacctctgcaaattgggttaatttctgtgttctgtgttctactactgcctccccttccacccccagacacgggaacattgtactcacaactttgtattgaaacagcctcttttgttcatctcgtcttagagccttagactccttaatacaagctttgccattgttcccggtgcctggcagatagcaggtgctcaatggctgtctgcctagagaatggattcattttaaagggaatttctaaccaggtagcaggcaatgatagctcgtctccagtctggtctgaagcaccacatttagtctggagcattacattttgagtaggacatgggccaccatgtattcacaaatccagcttcatcctatgtatgttatccagcgtgtctcacttggtgtaatggtgagcatggcagtggtccaaccaactgacatcggtaactccattaggtggctagtgatcacagtcatacagaggggttaatggacaattgcacgctcctcgtgtgtcgctttattttcctggccacactgaaaggtgggtaatagcatattgttactgatggagttgaggcaagcggtacctacgtgtcatacaacaggtaagtgccagcctctgggctcttgtgcctcatggctgtcctcacagtgttgatccacagctcagcgagactattggactattgtgcagttcactacgttgaggtctagcagctgactagacaactgcctttctagacaacagcctagtggcactccactgtcatccctattgtctgtggtaactctctccatctccactaccatccctgtcatccatgggctagtaactgcctacacccacctggggctagggacctccatctgtaaccagatccactctaaccatctataaccatcatgacctccatctatatgagaacctctataacctccaccacgcaccccctagttgtctagtgaccctctccatgcctcatcccactctggtccagtagcctatttatagctacttccctcaactcattctccattttcaaaacggcagagatgcagtattatttatagtggaacacccttgcgagagatgccccacatcttcccagcaattcttatgtttttggtttttgggtttggtttggcttttttaaccatcagctgcaagcaacatccaacccgctttcccacaactaatgaacttattctggttttggaagtcacaagcttaacaagccttctcggctctgtgggccctcagagcatctaacagtgagctgatgtagctcatggtccttacacagtcttcacagtctgctggttggttccatcctgcattcgaagctgtcttgtgtgcttcattcctcaagtgttccccatagaagatgcttctctttagcagcaaagatggagtgaggacagggctgggggtagtggggagcggtcccttctgactcccttgcctgttaaaaccatccaccatccttccaggtcagtgactccagcctcctgtgtccatcttggaacaggacaaataacagggccagcctgtttggtgcccttgactttgcagcttttacctagttctttaaaatctgagttcatcaaagaactctctgggcagccatattgatcttttttagatcaatagttctcaaaccaagctctaagtcaattccctgactggccaagtttcccaagtgctcgggtaaataccacagattggcccagaatgactggcttctgcatctcccaccaggaggcagtgagcaaacccaggccagggggtccggggtgggggccagacagagaaaagccagctgttggtaaggaaaactggcccattttaaggagcccctggggtgtctaaaaggcaaacaaacccgaaactggcactcagctgagcctaggcaagaagaaatcaataattctgcaaataggcctacttctctcccaattaggaaccaaatgatagctcacacaatttattcgaaacgttgagctttggtcctgcagagatggcttactgggtaagaattcttgctgctttttgagaggacccagatttggttcccagcacccaccttgagcaacctacaactgcctctaacaccaattccagtgccctgttctggtccccatgggcacccgcacatacttggcattaaaacatgtttacaaaaacaagcttcttttaaaatgctgggctctatttaaatagttgctggtaagactttcttccttccttccttccttccttccttccttccttccttccttccttccttccttccttccttccttcctttctttttaaatttaaagatagactttctctacatagaccgcctgtcctggaactccatgtacaccaggctgtcctcaaactcagagagatacacctgcctctgcctcctgagtgctgggattaaaagcatgacccactataccaggcttaggactcaaattttaaccatcaccacaaggtgcggggtgagcaggggtggaagcttctcttggttaatgccattgcttggtttgacagttcagttttaacatacattggtggcaagggggaaattatatataaaatttaagtagatgtaatgctaaagaggaagtgggtggatccctggggtgtgtatcagtagcagagcacttgtctagtgtggccatggctctgggttgaatagtagctaaatctgcctagttagtatgagttgccgcttcctaaatggggggggggggggggcattagaatttgggtgctaatggtatagctttgatttcaccatcgctaccacctccgagtttgtcagaccatttcctggtcattgttctgcccttctcaggagactgggtactggtgacatccaagcattagacaagggtgaccacaactatctaaggacctgtctcagaatgaaagcccattcttggaaacaggtgcaagattatagaagcttgatggcaggacatttcaagccagatgaaagacagactcagtatgacaggcccaccatatgacattctggttgtcctggggaaataggcttataggtctctggtgaggcaaaatgtgtgaactttggagtcatgtgctttgaacctcaactttgccaccagccatgtgacctttgccaattttccaatttgtctcattttcctcattcaaaaaaaaaagaaatgtaacactattttgctaagggactcaaattaggtctgggcagatggctcggtcagtaaagtgcctgttgcgtgagcttagagacctgcgtttgggttgctggcactcacccctactcaccatgttcatggcctgggggtgtctatgatagccattctttgcatttcaaatgagtgagtttattaagcacggagcactcaaaagtaaaaggataaataacaagtggccaataggtaggaacagcaaatagagggtcaaagatgaacactgaggctaaagccatctcacggaaactgacaagcaagcagctgcagatcccagtagtaccctccagggaggcttccaagaaagagaacaaaaaaccagcagaataataacatcctcacaccaagagcttacaaatccctaatacaaaccagctggggaagccactaaggcagccagctagaggtcccaggagagacagtccctggcaagtgtcacctccagatccaggtagcatcatcacatggatgcttagggaaattgagcccactgggctactggtggagatttcctcggtggactccctactgcacaactcctggcttctctttttccactgtaggcatcttttgtatcatgggaccaagaatagtaacatcttttggacttaatttgtcttctagcttttctcaaggacacggtgttttgactcttgggacggtttttttttttttttttgctgttctcttcctccctgttacagagtcaggggaggtacagcccattcctggacaaggtgcctcagaggacactttaacacaaacacgctcaggtctaggatgggagggggcaactctctttccaaagccagcttgttagtgagctcagatgacacaggacattgtaccagtagaatacaccttccatgtaaaaaagctggacttggtgcagatctgtaacattcctggggtggggtcagggcagagatagatctctgggactcatcagacagttaatctggtaagcccaggttcagtgagaaaccctgtctccaaaaacaaggttaaaaaatgatagatgacttctgaactttacctctggcctcaacacacacttgcaagcatacatttataacacctctgatatctttgcccccacacacagcacacacaagtaatatcaaggtgttgtgcacagtgtctaaggctatctgcttgcaattttcagtaggttttgaacagtaacaccttggcagtccatgtgaacagaaaaagaacaaaggttgtgcctagcaaaagaaatggtgtgtctcctgggccaaaggaggaagctgtgtgttctaagtttagcaacagagagggtgcctggttttagaggaaagataaaatgaaagacggttcatggtgcagaaagacacctctctttgaaacagggtaagagcagaaataccatggggatcttttgaggaaggataaaaggagaaatagaaatgatatttctgtctgcggtcctggggggtaacggccaggcaccgtgtttgccaacaatgctgttgtaaatggcaaagctgacacagggtggagagtaggtgagggctcagaacgcagtccacccctccggtaggtcttgaaagtttggagagtttaaagtgtctgtgtagtccccgagttatctagttcggggttttagctcagacaaagcaggtctttgttagtatactgaacaagagagccatgagggagctgaggagatggctccattggtaaagtgcctgtcacgcaaacatggcaagctgtgttaggagcctgtgtacccttgtaaaagcggagctcacgtgaggggcctgtctgcaaccccgtgctggggttgggagggggagaagggtttcaggagccgtcactgtcagccagcctggctgtatcagtgagttccaggctcagtgaaagactcaaaataaggtggagagcaactgaggcagacacccaacattggcccctggctttcacacacatgtacacacaactgcacacacaagcgtgtacacacacccaccacgtgtgcatgcacacacacaaactttgtaataaagggaaccaatgtgctattaaaaaaaaacagtcaatgtacaatggttaaaaactcaacgactaaggcaatggttcagtggataaagtacttgccacgtaattataaggacttcagtttgatccccggagccatggaaagccaaatatagcagcatccatgtataatctatgtactcctatgtcaaggtgggaggcaaagatgggagaatcccagtaaccttccatatgccacagaatctaaagaggaccccttctcaaggcagacggcgtagactgatacccaaagttgtcctctaaccgtcacacggtgccgtgttatgcatagcacaaagacacacagagagagcatttttaagcctctaagtgacttctttttattcctcagctttccagttctgagctgcatttcttgtcaatctcaagccagtcttacataggaagaagcacatgtgtttacttaagcagtcaaaactgagagacatacaagctgcatcacctgtcgacgataattgtatgctaggcactctgtttgtgcacttgaacaagtgaactctatagaataaagctccggggagtagacttgctgagccaaaaggtgtgtgcattataatttgagcacttttatgttgctcttccccctaaggagatgtgtcatgtgtttgtaccctctacacatgacagaggaaagcacgctcacagagctgttgctagcttttaaccgtttgtttgtttgtttgtttgtttgttagtccaatgggtaaaagccagaatgtctctgtcctctgtttctcagtgagcaagtttgtgcccggttcactgtttattccgaatcatctgttctcctttcatgctccttaatcaagatcagttgtaaagtgcttgccaggcacgcataaagacctgagtttggattcccagactcctataaaagaggcaagcatggtggtacctgcttgtaatggggaggtgggaaacaagcaggtccctgacatttgttggccaactagcacatgcacatataacgcatttgcagacatgcacgcacacacacatacaagtatgcacacataacacaagtttagggtgcttaattaacgtttaagcgtgccctcttagcattttttataatgagaaaaagaaagcaggggtttgttgattgttactagaactttcttgacattgatctccagacattcagatgaccaccagcatgctgttgccctggagagctgaagggggaacacagacaagataaaaatagctgagattagggaattgatttctcgtgtctgtacttcctttcctgctaaggttgctgttgaaagctttctactccgactactacacactcagatgcggtgacctacctgtgcatttgaccaaggaaggacctccttgtagttatgattgtatttcagatagatctggtccaaaattacaggtgcatcccaaggctgtgagtggttttaatggagagaagactgcagcttttaaaaacatcacaatagttgtctaggcaacccactaaaaggggttagaataattagagtcacaccctacaggaacccacctaatcactccctgcctgaagggatggcttgaacatccttttttggtgactaagacctcatcagcaagagttgctgtgctaatgacccagccagcatccttcctgggctgactgatgaatgctgtgcgcctgtaataaaagcaattaagccaaaagccctgaaacccagccagtacctggccttaaaggctaaggatgcttcttatagacactggtaaagagcctatgggatctgggaaagggacagaggcctacttgacatttgcatgcactaatgaataccaagacagactcctgttcctttatgtcctctcagaaacacataggcaagtttcagctccagttccagctcacagtgtatgtcccataattacagtgtcgaaagcctgccctccactcactgtatattttatccatctaacccgaacttcatttggaatgaaccatgttttagtttcatccatcccgtgaactggatggtgtctgaggattggaaaaatattcgtcccagctcatgaccccattctcctgcagctcagggtagcagggatggtaagggatgggctatttagaacattttttaaattattattttatttatttttttttttagactctagcggctcagacagggattaattgtactacggccccttgggggctgctctgtaatggggattcttaaagcccccgttggcagaagtgtgttcctgctgctttcgtccagaaggaaaatttcacttaaagcaaagagcagagacagtgggatacagaattgaaagcagagaaaagactaaagaaaccatgaaggaaaaatactcttggatgctgtcttagttagggtttcattcctgtaaagagacaccatgaccaaggcaactcttataaaggaaaacatctaattggggctggcttacaggttcagaggtttcgtccattatcaatcatcatggctggaagcatggcggtgtgcaggcagacatggtgttggagaaggagctgagagttctatatctgggtcagcaggcagcaggaggtgaaagttacacactggacagacttgagcttctgacacctcaaagccaccccgtaggaacacacctgcgcttaacaaggccacacctcctagtagtaccactgcctatgggcatatgagggccattttctttcacaccactgcatatgcattggaaataatgccacatgcagagctactctgatgtagcatttgttttaaggacaaaaaaggttgaaccaactgtcagtcatggggccctgagcaaaaaggaattcatgaaatgctcattcactagaatggatctggaattgctaacaccttgcgatctccccacagagtcctatgcagcccctcctcacagctcagtatcacctcagtggctcatgtgtacttgtgcaagtgcacatacatatgcaaacacacatacacatgcacatacaggcactcatgagaacacacagtaggaaggataataccaggacaaaatgcatcttctgaaagaaaaatgtcaggtaccaaatacttaagcctttcattgaaatcacgtgtaataactgacttcatcaattgcaaggtgaatgtgtctgtcccatgctggatcacatagggtcacggaatcttctaggctgtccccaagaggagctgtattttaccctacaatttgcaaaagtaaattaatgtagttagaagcaactagggaactcataagcaaagtgaaacctttacgagtaaatacttgaaaattacctaagaaaatgaaaatctaatgcattgcaacaagttcattagacacgcatttactaggcgtctacgctctcccacatactgctgtgttggaaatgacatctgactccaggctgctaagacactaattgaatcaaga

SEQ ID NO: 1340 - DNA, 2768 bp, Mus musculus
cggcgggcccctgctcaccggcggcgcggctgtgcacatctccgcctcgggtagctgccaaggccaccctttactgccgtgtcttcctgctcgacggaaccgaagtgagcgtggacctgccgaaacatgccaaaggccaggatttgttcgaccagattgtgtaccacttggacctggtggaaacagattattttggtctgcagttcctcgactctgcccaggtcacgcactggctggatcacgcgaaacccataaagaaacagatgaaagtgggacctgcctatgccttgcactttcgagtcaaatactattcttcagaaccaaacaaccttcgagaggaatttacaaggtacctgtttgttttacaactcaggcatgacattctttctggaaaattgaagtgcccctatgaaacggccgtggaactagctgccctctgtctgcaagcggagctaggagaatgtgagctcccggaacacacgcccgagcttgtgtctgagtttcggttcatcccaaatcagacagaagccatggagttcgatatcttccagagatggaaagagtacaggggaaagagccctgcccaggcggaactctcctatctgaacaaagcgaagtggctggaaatgtatggagtggacatgcatgttgtcaggggaagagatggctgtgaatattctcttggactgaccccgacaggcatattaatctttgaaggagctaacaaaataggcttattcttttggcctaagatcaccaaaatggactttaaaaagagtaaactgaccctcgtagtagtggaagatgatgaccaggggcgtgagcaagagcacaccttcgtgttcaggctggacagtgcgcgtacctgcaagcacttgtggaagtgtgcagtggagcaccatgccttcttccgtctgcgcacacccagcaacagcaagtccgccagatctgacttcatccggctgggttcccgcttccggttcagtggacggacggaatatcaagctacacacggctccagattgcgaagaaccagcacctttgagaggaagcctagcaaacgttacccgtcccggcgacattccacattcaaagcgagcaacccaataattgctgctcagctctgctctaaagcaaatcctgaagtccacaattaccagcctcagtaccatcctgacgtccaccccagccagccccggtggcgccctcactctccaaatgtcagtaaccattccatctgcaaacaaaacaagccatgttttcaggatgacaggccacactggaaaacctcagccagtggagatggcagccactttgactatgtccaggaccagaaccagaggaacttaggaggggcatacagtgtcacgtaccgggacaaactcatgaccgcactttgagagactgaagcctcctccggtcaccaccatggtgcctttgcattccatgaggagcgtcctggcatcgcatgaatgtttttgtacaagtgtcattagtgcttttcgtgtccctgtaaacatttgaagataacagatagccatgatttactgtggaatgcattctcaattatgaaggtagctaaaggctcaggaatcgttttgatatgctggctttaaaactgaagtcaaagtctcaaccatcatgctgtgtatcctgatagttttgtcatttatccagtggggccacataaagcaaaccagcaagaccaaagcttgggaaaatagcttagcacataggactgtttgtaggagtggaaatcgacagggaccagcctcccttgccgtgtgaccttagctaaatcattcccctttctttgatttcatttcctccctgaaaagaacgggctgggctaagtgatctccaaggtcttctattctgtgatctgttaagatttcacttctcatttggggtgagagcatgcatccagactaactccccataaggacaactataataccccttctgtagcagaagctcaataaagattacaaaactcattaggtattcatcaatacagggaggcttggagttttccatctgtaaatgggttagcccgtgtggaattgagcctcagtgctgatcaccagttgcatagcatgtttcactagaatttacttctcaaacgcaaggatgctttgtaatgtctcagtgactggtgctgctaccctgtgtgatcagcgtagaggctgggttccatcctagacttaactcctttgaccagcagcatgcagttgagatatagtgggggctcacaggagagcctgccaggtttctgcaggtcgtgccaaagcactgtgttgcacagagggatgcatatgcccccctccttctgtaggaccccaaagcaacatgttgtcttttagggtggaacttgtaccaaagtatttatttaccccgattcaagtagcacctctctaacctcgttacgtcttcataggcagtcccagggtgctcttctgtttgtgtttctgtgcaatcagttaattctgtgtcactttgatatatgtgattataatttggctccttttaagccctttgggcatgtgttaataacatcttctcttgctaaaatctggcctttttggttctatgaaagtctcttgaggaggaggggatcagtcctctgcacacttgcacaagggagtagaccacctacatataacctccccacaagatgcgtgtttacaggcgtgttccagttcagcaggtgttctcatccccagtgtatgtactgcatccatctgaataaacgtgttctgggtctcttc

SEQ ID NO: 1341 - protein, 465 aa, Mus musculus
AGPCSPAARLCTSPPRVAAKATLYCRVFLLDGTEVSVDLPKHAKGQDLFDQIVYHLDLVETDYFGLQFLDSAQVTHWLDHAKPIKKQMKVGPAYALHFRVKYYSSEPNNLREEFTRYLFVLQLRHDILSGKLKCPYETAVELAALCLQAELGECELPEHTPELVSEFRFIPNQTEAMEFDIFQRWKEYRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPSNSKSARSDFIRLGSRFRFSGRTEYQATHGSRLRRTSTFERKPSKRYPSRRHSTFKASNPIIAAQLCSKANPEVHNYQPQYHPDVHPSQPRWRPHSPNVSNHSICKQNKPCFQDDRPHWKTSASGDGSHFDYVQDQNQRNLGGAYSVTYRDKLMTAL

SEQ ID NO: 1342 - DNA, 87731 bp, Homo sapiens
gcatttgctgctcctcagacccacttcactgggctcactctttatgctgtcctttttgacatttggccctgcttgtcattattctcttttgtgttcctggatttttaccgcttcctgggccctggtgttgccttgctgcttgtcgcaagataggatttacctttgaccgtgataccccaagctggcttctcaggcacccagggacattgccaggctaaatgtctcctttgtaataaaaaccctcaggcggcgttagccttgagaattcctttgctcaacctcctaaaagttggctatgtgctgtcataaacctttttattagccctagttaggatgcttgtgttctgaaattgtctggaacacaataacaccctcagtgtgaccgtgctgtggcacctcagtccagtccagaccacagttattgggcgtctccaatgtgccaagctgtgtgctgcagacacaaaggtgaatgagatgtggcctggaggctcttgggaaacgcaggtgaaaacacgtttcttttattctgggtgatgctaagtgatatgactggcacacccagacagggtgctgtggccggatgggatgggggaatcggaaggacttccaggagactttgacacttgagattatggggtctcagatccagtgtcccttggcaaagccacaggccagttgttgtatataataaagagaaaagtagctgcaattgtttcttctgacagggcttggagcccccttctctggtgataggttgagtcacctagcatccctgagtgttcttttttttgttttgttttttggatatggggtctcatctgtcacccaggctggagtgcagtagtacgaccacagctcactacggtcttaatctcctagccgcaagcaatcctcccacctcagcctctctagtagctgggactgcggttgtgcaccactacacccggctaattaaaaaaattatttttatagacatggggtctcactgtattgccctggctggtctcaaacgtgtaggctcaagcgatcctcctgcctcagcccctaacagtgttgggattacaggcatgagccactgcgcttggcccctgggtgttcttagtctttgctatggatagtcagcagctttccagtctttgataaaataaaatgtgaataaaaggatctttttaaaaaaatctataacatgcagtctaaagtggacttgctgtacaaacccaacttccagatgagcccttgctcgccctaccaaccagagtgccagcctgagccagtcctcttcagaaaccctggccctgccttcgacagcacctccctctccttagcctagctcagccctgcccaaccctcaggtgtggtctggtcagagcagggcaggactccctccctcggcctgccctagacgctttccttctattaatgcagctgaagatcccattagtgtgcttggcagcggcacccactgttgactcatattagctctctgttgactaaatccctggcatcgcttttgctcgtgtggctgttgctcagccccgcctcccgttgccctgtgtgctcagtgtggaaagctgttaggatgtgcggtcggccagttagcactcccgccatgctttggagggaacggcccatgggccattgttgcatttggtgcacttgcctcccctgcatctggaactcaacattgactcattgtggtccagtgtaaacatggaggatttcagaattcgaagatctacctttgcatattgcaccctggctctgcagctttgggcaattgcagctctctgagccattgacttcctgatctttcaaatggggatgttgggaggatttggtgacgggaaggcctcatggtgcaacagagtgctgaaaggttgctagtaggttgtaatcttagaaacctctccttcctctactttgaactttggaaagatttgaagaagtttctagtaatagacattaaaaaaaaaaatgctgtgccaggcaggctaaccattgcttggctcttctttagtggaaattggaagttggatgtagtatgagaaatgctttttaaaagtttcactttggatgtgaaaagtgatgtttttttcagcaaaaacaggagaatccaggtttttagaattttaggactgaaacctctgatctcacataacatacatgatacaacataaaggtcatatggcttattttggagttgaaggggaccctggacagcacctccccggcccattggagaaactgggaagctgtggtctgtggctataaagtgacttcccttcagtcagtcagtgaaagagttggaaccggctgctttgggaaccctgattgtcagcgtctgaaggtgtcaagcgtagggtcagcagtgggagggaagactaaccccacgtcctaacacaggatcatggaagagggatggggtacattcctggcagttggaaatagaacagattttcccaaacagtggaaaaaatgatcccaacttcagtgttcacaaagttcatctgggattttttttcttccattaaaattcccagagcacaccccgagaatttcttgattcagtatatcaggaagctcaacttttaacaagttactccaggtgattctgatgcaggtggtctcttcacagccagtgaaaaaccctggccctagaactgtgagaacagaggcagctacaccatgcattataaactgctgtagcaatggggcgagcaataccattgctgtagcaatggtaggggggttggcagtctttgagctggggtttgacctgtactttagggagcccatttttgtcacagtggagtggagggctaggggagggactggagaccagtcatgccattgcatttgtcaggtaaggggtgatgagggcctggctaggagaagggggcaacggtagagcagctcacaggtggagttgggtgagtgtgttggggagggtgaaggtttgagatagagctgtcttcactcttggttgggaagaattaagggacccgcaggaggttgaagacagcttctcatttctaccctttcccaaggctctggctgccatgggcacactggcttatcccagggctctgggtggcttgctttttttgcccctgtagggtaggtattggctaaaggtggccttccactacttgccccacccacatcccctctcagacctggaatgaggccttggatatctagtgggtcatgagtttgtgttatttttggatatgccttctttgttttaaaagaaaggctgaggtgggggggggtgagagaggggtaatgaacacccttcccaaagggggtgtcgtgatacaagcaagagcactaactccccttctatacttgctggatttgtcagtgttaataaggggcgggggttggcctgcagggggaaggggccgcagcctagcctctccagtgccggtaacatgaccctacactggtacagggctctgaacaaatattaacttgctaagcactttcacgtgcataatctcattgaattctgttcctagtaccctgcagtggatgaaggcacaggtctgtttcgttttgaaatagcagaaggtcgatgggggtggggccttcccttaaattcttgcgtggggacttagaaaaaaatccagcctggcaaccacagaaatcctccgcctaccatttgtcctcaaaacacgtgttccatccttgcccactgcttgacttcctttggccggctgggagtgggctcctccccgggcctctctctgccctgcctggagccttctcctccagtgggaactgcactccagtttccacctgtagcccgtggctgctgcctgagggcagggtcagctgctgattcatctgggtgtgttttccaggttcgtgtgtgtgctctcctttcatttctcgtttacaatgcattcatcgaagacccatttgaaaatacacaaaggttggaacaacatctacagtttcattaaacactgttaaaataggggtgcgcattcatctgtgctttatttcatattcagatataaacatgtttttaaaatgatgaacttaagtgggttgatggaagtctctgtctactcccacctcagcacagttgaataaggatggtcgacttggagcttgtatctctttagggtgaggccctcggctctcctctctacatttcctgggactcttagctggggtggggagcccccagtgcttgttagccatctgcgctgtgtgctgcctgctgcccctcccttggtaggaagcaagctgcctggcactctgaccctcctcaccacaattactttctcttgctggcaggttaaaggtcttgttgatgtgacctcagagtccccttgcatctgaaagcagctgctatggggcagtctcgactctcgccagcccaggatgcctgtgactctgctaccagccagagctgacctggcagagtggggctggagccgggcagcatcctggtgtgcccccccaccaccctaatccctctaatctcactccttctgcagcctctgtggcctctctctagagctagattaattttactagtcccacctgattttaatttctggtttattttaaattgttttccaaaatgtttttgtttgctcacaatatgttttcttcagtcagcaaaggcttactgagcccttacactacattaagcatgggggaggggtatcggagagagaagagtgtttcttaagctcccagtcttgaggggcagacagagtaaacagatacccataaaccaacatggggtggtgccgggggtgagcaactgaagtgtgggctggagttggagaaggtttttttttctttttttggtaacattggggtctcactatattgcccaggctggcctggaacttctgccctcaggagatcctcccactgcggcctcccaaagctctgggattacacgtgtgagccaccacacccgggcagctggagaaggtttggtccccagagtgacaatggaattgccccaaaggatgtgtaggagttcagctgtgtctgggtggagggaacagcaggtggaaacgcgtggaagatgggggtcagaaaagccccatccctgggctccgggttccttggggtaggggattcagatgagttctggctgtatgcctggatcttaaaggagtgagtgagtgagttgcctttgaaatgaagatgatgtcgggaccccatctaggtgattatcttgttgaatcctcacaaaaactgtgttgatggttactgttgttattcctgatttgtagaggaaagaatcagggtttagcagacaggttaagaaacttgtccaaggtcacatagctagtaaaggcagactctagcttgatttgtggtctgggaaggtctctgacagcacagctgggcgaggggggtgggagggctctgagcttgccccagaggttccgagctggatggcgacccctgagcccccaaagggcttccacctttgtaggccacttgggatcagatttacttctttagttagactcattgaatgtcatttcactcgagtgcataatggtttgatggccataattcaacactcagatcagaagtaggtgatgtttttaaaaagtgcttagtagaacaacattaaaattatctcaaagaaaaacattttcatattcctatcctgctgcatagcaactggttggtttcactttgttcctttccatctttgtgcttttgtatacatgtttataagcgtggtgtatatcctttaaaacatttttttcttttctcctccccatccacatttcttgacaggcttctcaccagtttggtgccctcttttgtgtgtattctagaatacttaaattcaactcttattctctgctgtgtgtgatgtggtttgagtgagtaatacctgtctctgggggcttggaggttgatatgcaaagcacctgatcacttacgcgtcaggcagccccatctccaaggcatgcagaatctgtgttgcttcccttaatcactgccgcctgggaaggtgcacgttatcatcccctttgcagatggtctcggagagcagatggcctcgggccactctgctagtaagtatgggagagccagattgaatttaggtttccggactcattttccagtgctcttcccctcagcccatgctgtgcacacccagccttcctgtgttaaatgtgtgttctcttagaactccctgggaaggtcagaatttcatgcagtaaaatcccctgtcttttctgaaccactttgcctttcagcatctctggcatttggattctgtctaccatttctcagcattttttgcaggttcttttccccaaagtcatagctggctgagtgcccagcattttcttcatgaagccaagaactggaagatgatatcccaagggtcctgtcccacctgtgggatcatccggtgcttctttgttacccagctcagtccccccgggtggaatggtctaccctgcagctgtgaggatgccaactgcctggttcagcgggtgcctgcagagctggcatccctcagctctgtggtttcttttccatgcctgtctcatgagctgagtgttgtctgcagcatagcattcgctcaggtgcgttgaagtcagcctgataatgcatctcctttgctctacctgttcacttgctgagctgcacctaccctgaattatgaatttttttgaaaatcatggtattaatataaataacataaaatttactattttaaccgtgtttaagtgtatgcagttaagtggcatgatgtacattcacactgttttgcaaccttcaccaccattggtctccagacgtttttcatcttcccaaactgaaactcagtccccattaaacattaactccctattttcactccccccaaaccccgggcaaccaccattctacttttttgtctatgaatttagctactctaggtaccccatataagtggaatcctacagtatttgtccatttgtgctggcgtatttcacttagcctagtattctcaaggttcatccatgttgtatgtagcaggtgccagaacttcattcctttctaacgctgagtaatgttctcttgtaagagtataccacgtacagtttatccattcatggattgtggatgtttatgcaggtctggaccgtcttaactcggtcctacccattcacttgtggcactgccaccagagacttggatgtccccagccctcacctcgtggtgttattcttggattctgacacctcttccctgggactcttctgcatcatgctgatcatcttccaaggctgtctgggcttcgtttgggggtgtgtggcaggcaagttttctcccccttacatttttgtctgagttgcgcagtgttggcaagccctctgtccagcacattctttagatttttaaatgatgaaatataaatacaaaagactctctataacatgaatagttttagagaaataacacaatgaacatccttgtgcccaccaccgagcttaggaacaaagaccatcaccaatgctgtgaaagtccccacatgctctgtctcagtcacattcccctccctccctccctcctgaagtttgtctttcatccctttcttttctttataggttctctgcatgtgtacgttttcctaaacaatatcatgttagttttgcaggtttgtgagctgtatatacatgaatttttccttcaatattgtgtctgtgagaatttgtgtcagtgagatgactggagttcttactgttttgtagttattccattgcatgcatatactggaattgatcctgtgtggacatttgggatgttttcactttggaactattagggaaaaaaaacaccgctttgaactttctggaattggtctctggtgtacatgtgccaggaagcatctatcctgggtgtgtacctgggaggaagagtgggcggggccctttataatcatacaaaattgttttccagagtccccacagcatgtaaaagcttccctaatccattcttctccaacacttggcattgtcagcttctttgtttgattttaccaggatagtgggagttagtggcacctttgtagtctctaccttcccccagttgttgatggggttgagtacctttcacctatccatctctctctctctctctctctctctctctctctctgtgtgtgtatttcttaataatagagatgggatctggttgtgttgcctaggccattctcagactcctggcctcaagcaattctcccatctcagcctcccaaagtgctggcattataggcatgagctgctgcatctggccagggttgagtgtctttcatatgttgttagcaatgtgtagttcttcctggaatgttttgttttatgattttcacatgtgtttttaggtggagttgtatttttctcactggcctctggactccatgagattgtctcccgtatcccgttccgcttctgaggtcacctcggtggaataagggagcgaacactgtaagccccaagttgacaagcttccctggcaggtctttcctcactaagtaggaattaatgttttgatttcacttttcactgtgaatgagctgaagttggttgctgctggtggctttttgtgagagcaactacgggatctatagtattcacatcagctctgcccactctttttgaagtttttattatggaattttctaagcatattccagagtagcgagaactatatatggaccctaagtagtcatcttcatttccgtacttatcagtttgtggccactctccttttatacccctccctactgccctttcctgattattttaaacaaattctaaacatgtaattttttttttttaaaagacggaatctcgcttcgtcacctaggctggagtgcagtgcgtgatcttggttccctgcaacctctggctccaggattcaagtgattctcctgcctcagcttcctgaatagctgggattacaggcatgcgccaccacgcgctaattttttgtatttttagtagagacagggtttcaccatgttggccaggctggtcttgatatcctgacttcaagcgatccgcctgcctcagcctcccaaagtgctgagattacaggcatgagtctccgtgcctggcctaaacatttaatttcaaacatgtatttcagtaggtatctctaaaagataaggaccagttttaaaaaaatagagttgattgtgatagcacacacctgtaatcccagcgacttgggaggctgagatgggaggatcacttgagtccaggaatccgaggccagcctgggcaacatcacaagacttcatcaagacttctaaaaataatgaacaattattttttagtgtcagatattcggccaatgttcaaattttcttctgtggttttcagcaaggttctttcattgcatttgatagatattctatctaagactcttaacctaaaaaccttctcttcacctttttgagccatttatctgttggagaagtgaggccgtttgtcctattacagtttgttactttccgagttttgttgattgcatcctcaacattggtcacccctgaggtacagttagtaccgggaatggtcttatttcaagcatctgatcagagcacacagagatcagtaagatccttatcctcaagaaggctgagtggagatcagctgttgaatgtcttcctcgagtgtgggttcttcctccctctagctcactcctgcttgggtccccttcacatactcgggaggccctccatgaacccattctgtctctcctggctggagatgccagcagacattttagggaatgcagaatcaatgagaagggaattgggccgagtgtgggacagcttgaaccagtggggttcgcctctgagggaaccgttggagaacacctggtccaaaatctcattctggaggcggcgaaaggcctttcccatctgccttggaaggctgctcactccagtctgctgctgctcaccgtggcaaatgagcagtaacaagggtgtaacaagtgtagcttcctgcacgtagccccccagcgcttatgagcgacatccagcgagcctctttgcccctctgagactctgccatctcttctgaaagcgaccagggttctcaaccctggcacatgagagctggggctttctccagctctcctgcccatgtgatggatgtgggcatcatccagggaaggccggtagactgtaaaagcctaccggggttagttattaacctgcagcgcactcttgacagcccattccatggcatttcaccgactggagtccttttattgctcttgcctgctggggcctgagacccaaggcccatatcacctctgctcagtcggttacaatctgtattgagtggcatcagcactgctttgatggtagcaagaatggctggttaaagtccagggaggggcccaagctggcttggaactggcccaggtcatgcacacagccagcagtgacacatccaatgggacactccaggatgaaacctgagaaaggaggtctgggatatgggatattgtaatgggagagcaggaaatttaaggtcggaggtatttgtttaggatacctcagtattctagagctatgggatttattttgctttgaagtccagaggtatttagctttattctaaaagcgatgaagttcctcttaattaaagacgctcctggaaaaaaaaaaaggaaaaatttaatgctgtcttttaaaagggaaaggattgtatgtactataatagaattactgtaacatgtcgtttattaactcgcttcagggaatgagctcttccacataggtaagttttccagatagttacagttgcatccatttactgacaagaactgttttatttcagctatttcatttatttcttgaagaaaaaaaaaaaaaaaaaaacaactgcagcacatctagtgtctgtaaggccctgtgggaggaatacaaaatggtcaaatgtatgggcgttgctctaaaggagctcatttagggtggggtgtggatgttaactgcattaccttgactttgccttggtggcccccagtggattcttgggtcagctctgtatagtgttccagccttcaaagcattgctttactctgccttttcgaaggctggctgattaataagttaatacaacagtggtttttgatgtttactgcatgcttagaatcttctggggagtttttcaaagtccagcttctaagctataccccagactactgccaccaagattgatgggcttgggaggtgggaccccttcaccagaatgtttttttgtttgtttgtttgtttgtttgtttgtttttttgctcgctctgttgcccaggctggagtgcagtggcacgatcttggctcactgcaacctccgcctcccaggttcaagctatcctcctgcctcagctcccccgtagctgggattacaggcgcctaccaccatgcctggctaatttttgtatttttaatagagacggggttttgccatattgggcaggctggtctcaaactcctgacctcaggtgatccatccccacctcggcctcccaaagtgctggggttacaggcgtgagccaccacgcctggcccagaatgttttaaaactccccaggtgattctgaggtgcagtcaggtttgagaaacaatgttttacagggctccttcccttccttttgtgtggtgttgtaggtttagatcaggctttcacctttgatcatttcatttaatccttatagcatttactcgagagaattttgggtgttctaattttatagaaagctcaccagtaagattttggccccatatcccacagctagtaaatacaaaactagacttaaaagtcatttccaggctgttcaagtccacttctccagtttttcttcacggctgtcactctagtggctctctggcagctccccagtgtccccttcacttctcacctgtgtatctgtacctgtgccttatttttttaatttaatttaattatatttttttgagacagagtctcgctctgccacccaggctggactgcagtggcgcgatctcgactcactgcaagctctacctcccgcattcaagcgattctgctgcctcagcctcccaagtagctggaattataggcactgggtcaccatgcccagctaatttttgtatttttagtaaagacggggtttcaccatgttgaccaggctggtcttgaactcccgacctcaggtgatccgcccaccgcagcctcccaaagtgctaggattacaggtgtgaaccaccacgcctggccttttatttttattttgattttttgagacagagtctccctctttcgcccaggatggagtgcagtggcgcagtctccacttactgcaacctcctcctcctgggttcaagtgattctcctgcctcagcctcccgagtagttgggattacaggcacccgccaccacacccagctaattttgtatttttagtagagaccgggtttcaccatgtgagccaggctggtcttgaactcctgaccacaagtgatccacccgctttggcctcccaaagtgctgggattacaggcctgggccacctcatccggcctgtgctgccttcgtattggctgattcttatcccttaagggcctagccatctttcagggcctgtctcagatgatgccacatttatgaagcttatcccatcattccccccatcctcccaccccaccaccccaccttcccgcgcttcttccacttctcccatatagcattccctctcctcctaggagcttgcagggcatttttttgccttgggtgggacctagcacatgttatagtaattatgtagtaattcaagcaatagatggcattattgacctttttagtttttgcaagtgatttttaaaattgtggtaaaatatacgtgacacaaaatcgaccattagtgacatttagtacgctgacattgttgagaaaccatcattactatctggctctggaatattgtcatcaccccaaaaggaaaccctctacctgttgagccgtcattcctcccctgttcctaaccccgacagccgctaatctgtcttctgtctctctggatttgctgtccctgggtatttcatataaatagaatcatgcaatatgtggcattttatgtctggcttctttcactcagcattatgttttcaaagtggattgaccatttacattgttccaagccctttccatggcttcactctgacccctcatccccccatggagtaggcagttcctattggtatcctcattatataggagattgaggcacacagagatcaggcaactaggagagaacacacagtgcctaagtactcttggcccctgcactgtcctgctggtgtctgctgttgactttgacctttagaagggcaaagatgaaacatcaaggaagaattcatctatggtataagaacaacatatgatacggctccaggagcagaaatcattagaggtgcccctcgggactgcagaacagaattcctggggttgattgtgcgcttaaagctcttggtttaattggagtgaatcagtattgctgtgaatttccctcaaatgttaggggtcaagtataggattgtatatctagtattggaagccagctggcgttctaagaccactgaaatgttgaggaatgagtcttaaggactcagaaaggcagaggtaccccaagtaaaggtttcttttcaaagtagtgcttactatgtgccagacacagttctgagcactttatgtatctttacttggttaattctcacaaaatctttacaaggtagctactgccctgttttatggataaggaagcagaagtgcaaaacagctaaattacctcatcaaggtcttgccactagaatgtggtggacccagggagtctggttccggcatccatctgcttcattcttttccctttaaaaattttaattttctttttttggttataacatacctttcccaagacagtgagaacagaacagcctagttgcttgaataggaagagaaaaagggaaaaaacataatgggaaaagcactgattttattttattttttataaaacttatccggtcatatcagttctgtgcctttaaaaaaaaataaaaggctgggtgtggtggctcacaaccataatcctagcatttagggagaccaaggtgggaggagtgtttgagcccaggagttcgagaccagcctgggcaacattgcaagagaccccttctccacaaaaagaaaagaaaagaaaagaaaaaaaacccagccaggcatggtggctcacacctgtgatcccagtactttaggaggctgaggtaggtggattgcttaagcctgggagtttgagaccagcctgggaaacttggtgaaaccctatctctacaaaaaacaaaaacaaaaaaaaccagccaggtgcgatggcgtgcacctgtaatcccagctacttgggaggctgaggtgggaggattgcttgagtctgggaggtggaggttgcagtgagtcgagatcgcgccactgcaccccagcctgggagacagagcaagatgctgtctcaaaacccgccccccaaaagaaacccacaacttataaaaataaaagtaatacatgtttatttgataatgtttaggaattattgattaaagaatttaaaaattgttttttttttatttatcactttcaccaagtgatcaccacttcattaacattttggtgtatattcttgtctctttttttctaagtatggagaaaaaagttttttcaacaaaaatgggatcatactatgtataccctttttttacccctttttttcttttcttttctcttttttttttttttagagatggggtctcagtcagtcacccaggctagagtacattggcatggtcgtggctcactgcagcccagaactcctgggcttgagtgatcctcccacctcagcctcttgagtagctgggactgcaggcgcatgctactgcacccagcttcttttttttaattgtgataaaatgtaagcttaatctttatattacactgtctcttatgtttgaggaaaagcttagggacatctggttctcttcatgggaaggagaaatcttatctttgcagccagggaggcagctgcaccctggtacagaaggatccagaaaggccatgctgtgagaaggcacattactgggcctttatgactcgtcataggaccgaagttggccagcaagctctaagatcctgtggagaacgttggatcttcgggtgtgttcttagtcctcatatagtcccctaggtcaggatacctcagtatcctgacagggatgacatccctgtcagtcatggcagagcaggttctgcagttccaacttggctaaggaggtagctgtttggggctgaattgtggccccctccattttccccaaattcatctgttgaagtcctaacccccagtacctcagaatgtgactgtatttggggataaggtcttcaaagaggcatttaagttaaaaggaggtcctagggcaggccctaatccaatatgactggtgtcatctaagaagaagaaatgtggacacagacctgtacagggggaggaccatgtgaagacacaggagaagacgaccatctaccagccaaggagaggccgagaacaatgaagagacaggcatttattgaggacccgctgtgtacacagaaccaagccaggctccaggtagataaagactaagtcagggatgccactctttccctgagtaactaccacttgggtaagaatatgtgtcttttgcatctgcagagaactctatggtttttacatgcttttacccagtttcggtctaccttgcttctctggggatgttgaaagttgactcttggtggccagagctctggcatagttgttttgctgcactttaggtgcaggaactggcatctgtaacatgggactaagggaagaagcaggacttgaatagtttattgacaaaaatggttctgaatccagttggagttgtttgtttatttatttttgagacagggtcttgctcagtctcccacgctggggtacaatggtgcgaccatggctcattgtagcctggaattccagggctcaagagatcctcccaccttagccacctgagtatcagttggggttatttttatcggaaatatttatctcaacgcgttgtagcttacccatataagatggcacaggaagtatgtagatgtgtctacatgagattagccaaaactgcatattgaaggcttttttaattcatatgcattatactgagtgaaattaaccttaaaagagtagcctctgtatgattccatgtacacgcagctgtagaactggcagaactaatctgtggagaaaacaaatgagaataactgttgcctcgggggtagggaagctcagggattgacgaggaaggggactcccaggaactttctggggagatgagaaggggctgagtggtagaggagtgtggggtacaccagtccatttgtcaaagtaggataacttagatttgtacatttcaaggcaaatgcaatttactaccatccccaaaaaagtataaaaaaattaatggtgggccagggaggaatgaatagaggaaaagatgatacacagtgttgatcattgtcaaagctgagtgacaggtgtttactgtactcttctgttgactttgtgtttatttgaaattgtaatctttgttgattcctccttctgagaagtcagcctgttgcctcttggggcagatgcaggatctcagggcgttggggctaagtgacggcaagaagagggtttgttttgtgttttcaaattgccattttatttttatgttgttggaaatatcattagtgatgtggaataaattaggcatatgtaaaattacaggttgagcagggctatggtggctatgagtataggtataatgaggctattattttttgttagttcttgagtgatggctcatttgggtagaaatcctgttagtgggggcagtcctcctagggatagtagagtaacaggcactatggatgttagtagtggtaactgatttcacatataggatagtgatcatgttgtagcacttatatttgtattgatttttttattgttgttgtttatttctttgtttttgagacaaagtcttgctttgtcgcccaggctggagtacagtggcacgatcctggctcacagcaatgtccatctccggggttcaagcgattctcctacctcagcctccggagtagctgggattatgggcgcccatcaccacgcctggctaatgtttatatttttagtagggacagggtttccccacgttggccaggctgttctcaaactcgtgaacacaagtggtctgcctacctcggcctcccaaaatgttgggattacaggcatgagccaccatgcctggcctgtatttgtattgaataatataaatatggttactgttaatatcaggtaaagtaatggatttaagattgtgatggtggggttgtaggttaaaattgcggctgttcaacctatatgagcaattgatgaatacgctaaaattttttggagctgcgtttaattgagtctccctcaaactcccactgagatggatagtgctgccgttgttaatagtatatttaggtccattgagggaaagatttggaacatgatagaaatttgggctagtttttgtcatggccccagccaccctggctgtaatcgctggacttgggtattctctgccctgtcggtgaccgtgaacttttagcttcttacctctggcacttgccaccgccccgtcccttcgctttccctttcatctgggaacagaccctcctcttcggttgactttgtcccccgccccacctagtctcttcttatctctgcctcctccctccttctgtgactcggaagcctttcttcactgtggtgaatccacttgggtgttatttctgttcaccgtagggttgtgttatggcactggtgtgtctttgttcatagctgcaagctctgctgtgagtgcggggatgggggtgagtggaccatccccacacagctgtaaaagaggcatgctatatgattccatgtgtatgaacttcagcacaggcaggaggaatctgtggtacccgtgggaggaaaggaaggggtagaaattggaaagaggcacacaaggaactttgcaaggggtgaggagtattgctgaaaatgttctgtattttcaccttcatggtggttgccaggcacattcacttgtggtaattctttgagttgtacatgtatgatctgtgcacttttgtctaggtatgtgatgcttcaattaaaaaaacaaaacaaaacttgctgcacatcatggctcatgcctataatccaagcactttgggaagctcaggcaagaaagagaatctcttggggccaggagttcaagaccagcctaggcaacatagcaagacccgccccaccatctcaacataaaggaaaaaaaatcagctaggcatggtggtgcatgcctgtagtctcacctgctcaggaggctgaggtgggaggattgcttgattccaggaagtcaaggctgcagtgagccatgatggcaccactgtactccagcctgggcaacagagtgagaccttgtcttaaagaaacaaacaaaaaaatctagagagccatacaaggttcttaaaaatcttcccattctacctaaataaataaataagtaatcacatttgtataattccttgaaagattggaagatctgatagcacgatctgatttcccatggagtggcagttggctagacctgtgtagtgactgcccacctccattcctcataacccacttcgctcgttagaatgtcccctgtctttacagcatccagcaggaattcctcaaagtgcctggtgtgtgggtggcaaatgtgtaaccccattgcagaattccctcctatttttgcttctctaggtatcttagaaggtatagggactgtggggggttcagtgcctggtctggtggtactcttgcaggggtacctttggacatggtgtacttttttttgtaagaatacttttggacaatacctgggacattggagccctgtgtgctcaaccattccagataaatttgctctgcttgaactggagaaaattggggttagcgaaaattggtcaactcttagcagttaaaagatgacgagacgttacctaggtgtttggttctgtaaataatttcctatttgtgtcttctaaagtaatatttcatcatagtaccagttaacacttgttccttggcattcagttgttgcttttaaaaatgcgtatatgggccaggcgccgtggctcacgcctgtaatcccagcactttgggaggctgaggtgggtggatcacaaggtcaggagtttgagaccagcctggccaacatggtgaaaccctgtctctactaaaaatacaaaaattagctgggtgtggtggcaggcgcctgtaatcccagctactcaggaggctgaggcaggagaattgcttgaacccaggaggcagaggttgcagtgagccgagattgcgccactgcactccagcctgggtgacagagcaagaccttgtcttggggaaaaaaaaaaaaaaagcatatatgattgggaaattttcttcttagtgaatgggtaaggaaaggctaactttttgtgtggtgaacttatagtcaagattctattcacagtagctcaccctaaccacaaaccacagacctcagggaaataatcttgataatctgtataaatccaagcctaaggagaggctgtcagcatcacacctttcttttctccagctgaacgtgtcattctctgccttcttcctgcaagaggcagtgacttttttttttcttaagactactgactcacccagaagaaaaaaggctatctataaaaagacaactttatttgtatactcctccatcagatgaatggatagtgatgccttagttatagttttatgaccctaacagccaagctcaccatagacagggttaaaggaaaaaagttcatgtgcttttccactcattgacctttttgaaaaccttacacgcagagccaagtacatagctctaaagttctgcttcttatgtacagaataccaggcatgagtgggacccaaggagcttggggttcaagactgtgccttggcccaagaagcatccaggctattagggacagctctcaccatcagtttcagtccaggggagtaccgtgcaaagcatccaggggctgccacgcagcgaggcctctgattgccgcagggatgctgtgggaggtcctggggcttagagtcagaggtcctgggcagaggccctggctttgccggtggacagccgtgactgtgccacatgacgcatctgcactggttctcatttcatcctcaaatcactcggtgggaaatgcgtgctatcacctccgttcacagacagaaaacaagctcagaaaggtgaaggggctttgttggggtcatgctggttgtaagtagtggagcccagcttcaaacctgccctctaacttgaagcctgtgttcttgtctcttgttagtttgctaggactgctgtaacaaagtaccccagactgggtgccttaaacaacagcaagcaatttattttctcaccattctggaggctggaatccaagatcgtggtacggcagggttggtttcctctgaagcctctctccttggctggcagatccccccccacccccccagctgcctcttctccctctgccttcatgtggtctttcccctgcgtatgtgtccctggtgtctgtgtgtcccgatctcttctttttataatgacaccaattgtcatccaatcagattggattagggtcattctaacaacttcacttcagcttagttacctctttaaaagccctgtctccaaacacaatcacattccaaggtaccggggttaggactttaacatattaatttggggtggggggtgtgatacagttcagcccataacactaccctgtctcttagccatcatgagctcacctccctcatttttttttttttttttttgagacatggcctcgttctgcagtggtgtgatcatagcttactgcagcctcaaactcctgggctcaaactcagtcttcccacttcatactccccagtgactggggctacagatatgtgccaccatgccagataatttttaaaattttgtgtagagatggaggtctggctgtgttgcccatgccaatcttgaattcctggcctcaagtgatcctcctgcctctgcctcccaaagtgctgggattacagatgtgagccactgcacctggcctcacctccctcttctgtaaataggcatgccacctaaaatgaggctaccttcatccccaggcccgtcccataggtgaacccaggccaaaccctgttaaattcatcatcatttcatataatccttttaacatccttgctaggtaagaaatttactggacatcaaacttagcctgagctgagtaatagagttaggattcaaactctcacctgctgactcccgagtccatgtcttcagtgcactgcatcataaggtgtattatgagattccaaaactatgatttcagggctatggaagcttcatggcttatgggggaacagtcactacaggacttggaagtttcaggaagcgtcatgtgcgagatagcattgacatgccttacttttcaaatgttctcacattcctaagttgcaaggatgggtaggggcagtcatccacccaaagttagtcctttctgttcacgtttcttggctagatttcctgggaatttgttgcatatttatttatgtggagttatttgctttcagaattgcatggagggggaatctgcaatctggctgcaaaaagtaatttggcaatttattttcagggctgcccttcttccagcagcttgtttcaaattcaacctctggcacagagacatccatcattttaattgcatgttactgtttagtgaggcacaaatttgtttcattttctttttctttctcctgtagtagtaggtggttgtgggtttttttcctgatttgccacaaaaaagaaaaaaaaacagaaaaaaagaattacctaaaccacttttttatggccaaggagtttataacactgagctgtctgggggttttttttggtgttgcatatttggttcttaacctttcagtagcagaaatgcgagccttgccttttcttttcctgttcagataatgtccataatacagtcgcctgaacatagtcccaagaaggaaaattgtattggtctcagggtcagaaggtttgcttttcattctggttttgcagtgactgcctggctgtgtgacctgcctcttgcctcactttttccatccataaaatgaaggacttgaatgtgcagatttctagaacattcctatgttcttgtgcctgtaatactgagtcctgggcagggtggccatccaagtatgtccactgaggagcttgtcttgttccatatcgtgatgttcttattctgctgggttgtggattatggtgctttagttcaaagtcaaaaatcaatcctgtatccctcagcaatcttctaagggataaaaatattgtttacataaaattagcttgggtagaaagttagctttgatgttcaaagctaagaacttagctttcattgctgcatatacttcgtttcttgctgtaaaaggacgtggtgtctgtgaagttaggcacaaagtccaggagtgcatcccctttataaggtgcaccaagcactggggcatggggacaaaatgtgactcaacgtccataggtgggtgctgagttgggtgccaggactcttgtgtattgtgttttgttttcacagtgtggaagagattaattgttaatggtttggagtaattttttctgtctgcatctcgcaacactttcctcgtcaccgtggatgtcagactcttcacccagtgacctggagtctccaagtcagggctcagcccacactgtgctgacaccctccaatccccaactcctttgcacgttacaagattttgttttaagtgtttattatggagatttaaaaatatacaaaatatcgagaaagtgtggtgaaactctcatgtacacaacacccacttatgattctgaaatattttaaagcaagtcccaggcaacttattgtttaacctgttaatacttaaatattcactaataaatacttatcacacacacacacacacacacacacacacacagccacaatatcattatactccacaaaacgaacaattattattttttttgagggggtacggggtctctgttgcccaggctggaatgcagtgatgtgatcatggctcactgcaacttcaacctcctggtctcaagcaatcctcaatcttcctcctacctcagcctcctgagtagctgagactaccggcatgtggaactgctcttggctaaattcttatttttagtagagatcaggtctcactgtttcccaggctggtctcaaactcctgggctcaagcattccacctacctcggcctcccaaagtgctgggattataggcatgagccatcatatctggcctaacaatgatttttttttttttttttttgagacggagtctcactctctctcgcccaggctggagtgcagtggcgtgatctcggctcactgcaagcttcacctcctgagttcacgccattctcctgcctcagcctcccgagtagctgggactacaggtgcccaccaccacgcctgctaatttttttgtattttcgtagaaatggggtttcactgtgttagccaggatggtctcgatctcctgacctcgtgatctgcctgactcagcctcccaaagtgctgggattacaggcgtgagccaccacacccggccaacaatgatttcttaatgtcacctgatacaaagtccttgatgggtttagtgcaattatcttaaaaaccttttatagttggtttgtttaaccagaagctactacagaccacacattgcatctagtagatatgtctcttaagttctttttatctgtacatccccttctcctcttttcaatgtggtttattgagttctaatatggagttggtgatgtagcgtaaggcagcctcagagagtccaatatcgttaacatctttctcctaaacagagttagtgcccttcaaaaaacagtttttagtttatgttttttttttttttttttttttaagaatgtgtatgttgtccaggcatggtggctcacccctgtaatctcagcactttaggaggccaagacaggtagatcacctgaggtcaggagttggagaccagcctggctgacatgaagaaaccccatctctactaaaaatacaaaaaattagccgagcgtggtggcgggtgcctgtaataccagctactcaggaggctgaggcaggggaatcacttgaacccagaaggcagaggttgcagtgacctgagatcatgccattgcactccagccctggcaacaagagtgaaactccgtctcaaggaaaaaaaaaaaaagaatgcatatgtttattctgcttccttgtcttcaagcaaatgaaacctaagttaacgtcatgctgtggggatgtcctaagaagaaacattttttaaattatgaaaaacatcataaatacaaaatcttttatgtacgcatacaataccatgcatacacactgtatctctgtatatatatggttttcattctggtaatcttttgttgcataacacactcccccagtgcttagtgctgtaaaacaaccacatttgtcatgatgggttctgttggtcaagaatttgagcagggctcacagctgggagatgcttctgctcctcatggcattgaccaaggggtcagttggaaggtgggctcgtgtggagtgtccaaaatggctgcactcacatatctggtaccttggaagggattgctggaaggctgagctcacctgggatggttgactggcacacgtgcttgtggcctcttaaacgtggcagtctcagggtagttagacgtttcacatggtagctggctcttctagagcaagcttcctaggagaactgtcacctagccttggaaatcgcagaacatcattaacaccatatttgattgggttgatgcagtgacaggctcttccagattcaagggaaaaggacagagaccccctctcttgataagagtatcagagaattgcagccatgtttgtaagctccacagtttaaaagaataatactgaaactgacaccttaggtatttggctacctggtactttttaagtccccatgtacttgcttgtcttttggtgtaagatggaagccactgggatgggaggcacctgccttagaggtcattcagggtatctcctgcctcccattcccattcatgagggatttgaatggactcaattgggcaagtgcactgtgacagtttacatgacttgccttgcctgatgataatggcaacagtgggaggctcccaatacaaactttaaaagaagtttgtccagtggacctttgtgttagggaggctgcctgatattttgttaatgtccctgtcagtagggatagtatattagccagtgtgtctgctagtattgtgaccagaaaaagtgatgggtgaaaccaagtctcagggcagccagaatcaagtagcttcaggtatccttggctttagtgagcatcttgaggaataaatgggaaacccattcgtacactattgaatcactggtgttagacatgtttggacagacctataggtagacaggaattgaggtccctagcagatgttaggcgttctgtgttgattgaaagagggttcataggaatgtgaccagtggggtcacacagtcctcatagcagccctgtgaaggagatgctgttaaaggaagaaatgagcgctttgaatctctgcagagatctaaatacagcatggcctaaggacagtttattggcctggaacagaggctgatcaatagctgatcagtaatgcaacacaaagtctcagtgttttaaattgatccctccgtgagtcgaagccagtgcgactatggttctgtggtggaacagttgagcctagaatctgcctgtctgggccatctacagcacattggaagccccttgcccatggagtgaggagggccctggtcatccgtggaactgatcatcaatgcctccttccacggactcgcacaccaagatgacaggcagtcactttcttctaagattgttcttacttccttgttgatcaaaattaaggacagttgttttgttgcttcctctgatttctaagagattgttagcctggcaagtcaggaaatcaataacatgtgctctgttttaccagaattgaatttccaggagccgcctagactgttgacgtcccttctcactacagcgtcttggcctctgtgttagtttgtgagcaaataatctgctttccctgtgctacagctttcctgcccttcagactaagtgggaattgggaattgcctccccaccgtgagatctgtttgttggactgtgtgtggccttgtatcccaaccctagccaagaccatgcgtggagtaggctttcagtatttatgtgttaaattgggcttaagaaatatttcttgtttgcaaggcatattgtatgtgcttggagctaaaaaggtgaatgagatggctagagaggtagtgggatgagatagaaagaactctgtcctaaaaatcaggaaggctgggcccctattatagttctgctacttataagcggtatgaactgatgatgtaatttccctgaggctcagtctcatctgcgaaatggggtcatagaacctttgtgacattgaggcacccttcaactgggaggtgaaatttataagctggacagcctggccataagtccagtagaccatggacacttctgcatggtctttgcatcatcgtgttctagttttgagtcaccaaatcttgctgatggctgagatggtatttcttactcatgatgaaatgttaaggtaacttatttggtaatttcagatattcgtatttatgatgtccaagagtaaacagtttatatttgtttgtgacggcttagcagtgttggcaatgggaattcctgggccacttggtggggggtgtgtgtgtgtgtgtgtgtgtgtgtgaggtatatatatgtatgtgtgtgtgtgtatatatatatatatatatggctagtttcctgccaaggctcatagaaagtggcaagttattgaggggagagcagagctggtaactaatcatgaaatcagcacttcctagaaatagctgaaacaggccttgaggttggtgccttctgggaactgctggctgggaagccaactgctgatcccaggtggagctctgggatagcaatttaaactaggggtgtttaaggactgggaaaagaaggaattgatctctagggatgaacatgggtttacaaaagtccccaaaccagactaacctcaatttttctttcagtgaaattactaaacttcacatacctctatttttattaagcatctgacaaagagcacaccatgttattcctgtggacaagtgggagaaataggtttcgatgaaagtcacaataattcctttgtgtagaacaccacagggcgcagtgtatgctcatttgctatcttgctttttcattattagcatgatttagcaagggtgacagggcagatgagagtactccaaaacttggaggtgcctaaggccatggtcatattgctagagaagtggtagaactagtttccaacccaccatttctgcctcacagagtcccagggcacagccccatgtggtacaactgtgtgcagtcatgcctgggtttgaagttaccatcggacaggtgccgttaggtactgtcgaagaacagaaagataccccagcaccaccactccccacgtcagacctgcttagcagatttcccacgtgccgtaaaacaggtatcaatcactgataagtggaataacaaactgagacttgtaatgttcttaataggatagatcataggccaatttaaataggatgcaatttagttggaacaaatgcaaagcctgcacttggggttagaaaccatcactacaactattttggttgttttctaacctaggacttgttagcattttgtatataaaaggcatagcattttgttagccacaaggataggccatagtgggatatggcttccaaaacgtcaatgtcctagtgtgcattaggacagacgaggggtctggaagggatgacaggagtaacagggttctgcatccaggtcctggccagctacagagaattccagtggatttggaccaggcagatcaggcttctgaaaagtgagttgtttgaagactgttgtaggaactgaggattctccttaatccacattagtgtttatgtttattgagcctcagaatgtcagctggcagagaagcaaatatgaatagggcagggtgctgccaacaaggaagctgaataatgaagagtgttacttgaaattggccctggaaactggcttgctgcaggtggagaaaggaatgggggtgcgggagaagggcatcctaggcaaaggaaggacacgagccaagcctgagaggcggggcctgctgtgtatggtggggtgggccttgtatttggagaacaacacgctttgtagtttgaccggagcctagggtacatgtagggtcctgggagggataaaacttgaattaggttaggcagggttgatgggtgcagagtccctgacaccaggctgaggaacctgcactttattctctggtggatgttttttgagcagagaagtgactaagacaagggctgtgtttacggaaagaccattctggcaaacacaggaaaggtgggtgtcaggagggacccactagggggtgggtgtcttagtccttctgggctaccgtgactaaataccttagattgggtaaattataaacaacagaaactttctttcctttctttttccttcctttcctttccttttttttgacaaggtcttgctgtgttatccaggctagagtgcagtggcatgaacagctgactgcagcctcaacctcctgggctcaagtgatcctcccacctcagcctcttgagtagttgggactacaggcatataccaccacacccagcttttttttttttttttttttttttttttttttgagacggagtctcgctctgtcaccaaggctggagtgcagtggcacgatctcggctcactgcaagctccgccttttgggttcactccattctcctgcctcagcctcccgagtagctgggactacaggtgcccgccacaacgcccagctaattttttgtattttgtttagtagaaacagggtttcaccgtgttagccaggatggtcttgatctcctgaccttgtgatccgcccgcctcggcctcccaaagtgctgggattacagacgtgagccactgtgcctagccctagttttttttattgtctgtatagatggggtttccctgtcttgcccaggttggtctggaactcctggactcaagcgaacctcctgccttggcctcccaaactattgggattatagacgtgagccatcatgcctggcccagaaactttttcttacggttctggggcctggatatccaagatcacagagccagtagattcagtgactggtgaggtacttgtggatggcaccctgttgctgcatcctctcgcagcagcagaggcaaggctgctggcttcaatgtctttcataaaggcactagtcccattcctgagggcagagccctagtgacggggcctgaaggccccacttcttagtaccatcacactggatattagttttcaatgtatgaatttggagggacgccgttattcaaactgtagcatgggaccacttaggggcctgttgctgtagtccaggtacaaagtgacatgacttgagctgtaatggagatggaagggaagaggccttcccgaagctggccacagaaagacttgccagccaggattggtggctcacacctgtaatcccagcactttgggaggctgaggtagaaggatcacttaagcccaggagtttaagatcagcctaggcaacatagtgggaccccatagtggagtgcacctgtggtctcagctactcgggaggctgaggtgggaggatcgcttgagcccaggagatcaaggctggtgttagccatgatgacaccactgtaatccacccggggtaacagtaaagaccctgtctcaaaaaagaaagacacatcatctgatggatgtggggcaggtagataaaggggagccacgtttaccctcaaggagatggttcctgagatcactttgactgcataggcaccgtgcttttgcaattcacttcacaagtaggatgtatacatctgactggcacgctcacatacagcttatttcctcctttcaaacctgcctgggatggctggcatcttatgctattgagactaatgagatttgatgggttggtttctatcttctttgttcttccgggaccagatctgacctgttaatgttgcacttgggtcaggttgcagtcagacattgtcagcagcatcttacctaagaaggtcaggatagttcatttattttggggggcagttaagacatcagctgtccagcagtctcccttatcaggagcacagctaggaaccagtgaataagcaaaatgagaatctcaggctggccagcaaagatatcccaatgtccatcccttgtcctgctggctgcctgcctgccccagtctttcactggcaactatgtactcttattttacacatgattttaatgagctgggttatttttagctcatgtcatcagaaggagctgctacagagacatagactgactcaaaaacaccagttgttggtctttgggaaaagttaatgtgttggcagaaaaactagaaaacattgatgcaagaactcaaaggtaggagctctctggagtctactgtgtttgggaacagctcaccatacaagtctggaaggagatggagcattattgcatttcagaacggggatcccaacttagctgtcacattcagtacattctgcttaagaaggcagggagggaaatggtgttgcaacctctgggtttgcgtttcaaccctgttttggatgacttggcccctcaagaagtacttgttcagtgagaacttcctttagttcctatagggcttcccatagtgagggagtaacgtgagttgtgtctgcaacacccagagtggtggttgggacttgatgagcaattggcaaatatttgttaaatgagtggatgaattcgtcacagagagggagacctgggtaacgataaggcaacaagaaatggctttccaggctcgtcacagtaactcgtcttctgttataaccactagacaacgcgtcgcataatggcaacaaaattatgcttaggtaaacagctttggcagtgcacacagttccctaggtgcttgttcatggaatactgaatttgaaaagattttaatgagtgtatcctcttttttaggccttctgctggtagagcaccaccagtctgttgtcagtgttgtagcatggctcatccagaacatctctttcttggccccagatcttacccacctcctgctgctatctatccttccattcacatccatccatctacccatccatccacccatccatccatccatccatccatccacccatccatccatccatccatccatccacccacccacccacccacctaccctcccctgcatataatagtcatttatggagcgcctgctgtgtgccagccaggcactgtgctttggggatggagggacagagatgtgggtactcagatgaacacagctggtccctgtcctcagggagggagtgctctcagtcagaagtaggattctgacacaggagcacaggcagctgcagtacagtgtgatgagtatgtatatacttaaggcacacacctgcttacgggaatgctgaggagggagcacttacttctccgggggcaggagtagagttggggaggctcctgaaagacggaatgtttgggctaagcctgaaatgacagtttgtgtcatctcagatttgtaggggttgccccgggtggggtgtccaggctggcggtgcaggcaaagtaagttacctggagctttcttagttttgagaggggacactgcaggctgggaagagtgagagatggtggtttcaagggcagtgaccttgatcaccttgtcttcattctacctggtaacccactggggacccctgtttggaggatccctccattccagccctcataatttaaccagattattcttgaagctggaaagggctgttgggaattctctcttccagcagaaggtagcaaacaaagaacatacttgggggacatatgggaggggcagttacagatatatttaaaaaagcatcagagttgagtaaagatgatacctatcccccagcccctgctgtcttccacctccgagccagctcagtgagcatctagcatggcaggagggacctgccatcccttgaaagatccctttcccaacctccacctcgagccccttctacactaagagccattttagaaacatcagaaaagtgagatttggaatgacctagacagaaacttaggctaaccctcttcattttacgtaagtagagctgtgatggttcagttaatactctgtgtgatgggatggtcagcccagaaccaaaacagacccaggtggggaatgggttggatttggggccatttgagttttggtggccctgtgtattcagggcaccatggcagatttgctgctgcaggataagtctgggttggcgatatggatttggggaaattgtgaattgcttaaggtcgcagttggtggtgcatctgggactagagcacaggtttcttgcttcctcctggcccaatttttctgccacatcctgctgctaaaagtgttacttaactagttctgtcccactagcagattctctaatgaaacacttgagccatgataataggtattgtgtagagccagtggcaatggatagtaatagggaaaaaaatatccaaagggtgggttgttaaggtcaagaaggaaaagtaccagaatggtgatttttaagaaattgtatttggtctctgacaactgccagaagatcactgttaaaacttggggagaagccaggcgtgggggctcacgcctccgatctcagtgctttgggaagctgaggtggatcacttgagcccagagtttaagaccaccatgggcaacatagcaagaccccgcctctacaaaatattttaaaattagcccagtgtggtggggtgtgcccgtaatcctagctactggggaggctgaggcagggggatcctttgagcccaggagttcaaggctacagtgaactatgatgctgccactgcactccagcctgggcgacagagcaagaccctgtctaaaacaaacaaaaaacttgggaacaaagccatccgcggtttctctatgcttcatcctaatatagatggtttccaatttacagtggtttgactaaggattctgtggctttatgatggtgtgaaagtaataatgcattcagtgaaaaccgtactttgggtacccatgcaagcattctgttgttcactttcagtacattattcaataaattacctgagatattcaatactttatcatacaataggctttgcgttcaatgatttttgctgagcacgtttaaggtaggctaggttaagctgtgatgttcagtaggttaggtgtattaagtgcgttttttcttttctttttttttaagtcaaggtgtcactctgtcacccaggctagaggtacaatgcagcttattgcaaccttgaacttcaagtgatccttctgcctcagcctcctgagtagctaggactacagatgcatgccaccatgcccaactaatttttttttttttttttacttttttgtagagatggggtcttgctatgttgcccaggctgatctcgaactcctggcctcaagcaatcctccagcctaagcctcccaaagtactggaattagaggcatgagccaccatgcctggccttaagtgcatttacaacttataataggtttattgagatgtaatcccgtcataaggagcatctgtacaactattttcattttagcaaatttcctgtttttatcaagcagtctatgtacataacacatatgtatttttatttagttgcaatcacagcttgcttattcctttaaagtctgtttacctaacattgtcattaaaattttccttgttttttatctcatcttcgtaattatcttgtataatggctgaacagtattctggagtgttgatgtatcgtggttctgcgtccctgtggtggagagatgaggccgtctcatccctccagcctcctttctccagttgcatatcctgccttctgcttctgttgacctgttgccttcagaggagtatgtcgaggaaggaaagagcctgaaggctgtaatcccatgatgcagttttcattctttgtttttactttgtgttactgctgctatgtgtgtcacacaaatacagctgcacaaagaaaacaaaggtacccagtttactgggttacaagaaggcagacatcctggtaacactacacaagtcaggggagaaccctgcccaccgcccagaagcccttagtgtaaccttgccagaagatcaacaattaccctgactttattgtggctgcttccttgttcttctccagttttgtcacccaagtgtgcatctgtagacgttgcattttcattttgcctttaagaaaaaagtgtattttaaatctcttttaatctgtaggtatcccctctatctcttctcttccctatattctgcttgttgaagaaagaaatggaatcatttggccgggcgcggtggctcacgcctgtaatcccagcactttgggacgccgaggtgggcggatcacttgaggtcgggagttgagaccagcctggccaacatggtgaaaccctgtctctactaaaaataagccgggcttggtggcgcacgcctgtaatcccagctactcgggaggctgaggcagcagaatcgcttgaatccaggaggcagaggttgcagtgagtcaagattgcaccactgcactccaggctgggcgacaagagcaaaactccatttcaaaaaaaaagaaatgagatcatttgtcctgagtggttctcacaggctaaatcttgcggagagagaggttggggagcaaggttacatcttaggtgatggggtgttcttatcaggaggtacgtaatgtctggttgtctcctgttgtgatgttagtagccactgatgttcagtgcttagaacctactacccattaggggttgcaaaatgatgatattgcagttctgttatttcttcatttatttgttgaaatacttcaataaagaaaaactccacccacctactatttttaaaagctttctttagattcacgtgtcatacagtttgcctatccaaaatgtacaatccagcagcttttagtgtattcacagagttgtgcagctgtcaccacaagcaattttagaacatttcatttaaatcccccttccccctacaaataactgtactccccttagctgtcgtcccccaaacccctttgcccgaagcaaccactaatctaatttctggctgtatagatttccctcctttggaggtttcttataaatggatcatatgatgtgtggtggctccttgtgtctggcttttttcacttagcataatgtttcctaggtccatccatgtggaagcacatatcagcacttcattcttttttacggccaaatgatagtccattgtacagttatactgtcttttgttgatccattcatcagttgatagatatttgggttgtttctacctttgaatattataaataatactgctatgagcatttgtgtacaagtttttacgtgaacatatgttttcatttctcttacctagaagtagaattgttgggtcatgtggtaactaactctatgtttagccatttgtggaactgccaggctattttccagagcagctgcacagttttacattcccatcagcagtatatgagggtttctacttctccaacatttgttatgatcttttttaaaattaattaatttatttatttatttatttatttatttatttatttatttatgagacggagtctcgctctaccgccgaggctgagtgcagtggcacaatctcggctcgctgcaacttccacctccccgacctcagcctcctgaatagcgggattacaggtgcccatcaccataccctgctaatttttgtatttttagtggagacagggtttcaccatgttggccaggctggtcttgaactcctgatctcaagtgatctgcccgcctcagactcccaaattgtggggattacaggcatgagccactgtgcccggcctttttaattacagccatcctagtgagtgtgacatagtatttgattgtaattttgatttgcatttccctcatgactagtgatgctgagcatcttttcatgtgtttattgaccatttgtatgtttggggggaactagctgtatgtaccctctgtccatttttaaattggatacttgtctttttattattgagctgtaatagttctttatatattctagatttgcaaacatgttctcccatctgggttgtctgcacttcatgtctccatgtcctttgaagcaaaaaaaaaaaaaaaaagtctcacattttgatgacgtccagtttattttttcttttgttgcttgtgcttttggtgtcatagctaagaaatcattgtccaactcaaagtcatgaggctttatgcctgtgttttattctgagagttttatagttttagctcttacatttaggtctttgatgcactttgaattaatttttgcatatgctgccgtctactcttaggttacccagtgctgcagttaaagggagagtcagtgctggattctttccctttctttaccagtttccataataaggagttgccaccgagtcatcctatggagttgggtttttttttttctttgtgattatggcacttagatttaagcatatttgtgtttggatccattgagaatgatgtcgttttatctgagaagcgtgtctgctccgcttgggtgactattaagaagccttttcatttgtcagagacttcagtatccttgtggtggtttctcattcagactctctctcagttttcccaaggagaggtggggagagtaggtatcctgaggcccgttttacaggggcaggaatagaaacgttaggaggagtgacttgtacgaagtcaagtggcagatgcaggacttgaccccttgtttctccgactgctttcttgtgctcatgccccatgtgtataccacatagtcaaaaccttggcatgaacctggaatttgagtttgagtcctggttatggcctgtgacctccagcaggtctttgggtttccctgagacttcgttacctactttgtgaaatcggaagactggaagagccaatttcagaggatgagctttctttcctaagtaaggttgcctgcattgagaaacagcccagcttttgctacgctagagtaaggccctgttacacccttcttcaagtgtgtctgattttggcaaagcttatcttcccatgtaggtattcatccaaaaagtattctttttgtaagaagagactagcaaaagttaacagggttatctagattcttaactttatgctattatgtggcatttgagtttctttaatcatgagtttgtattacccttataatcaaactaattacaaatttaaaaatttgtgtgtgctgacatgtatgcaatttacaaagagaagtaggttttttttaaccttttttttcttatctagctgtctcaccctaagttttttcatcttcccaattgtcttccagaaacatgccaaaggccaggatttgtttgatcagattgtgtaccacttggaccttgtggaaacagattactttggcctccagttcctcgactctgcccaggttgcggtaggttattgctttgattcatttcagaacagattggcttttcattgctaattgcacgtccacagttgctagaaatgggtagagaaaaacaagactaaaactgtgatactgtgccagtaacaggcattgggatggaggttgtggtgcccaagtgccatgcgtcacaatgctagtaggatgcctcacccttgaggtggccagtaaccaggagaggatgtgaatgggattcattagggatgcattataggcacatttctagaaaaggtagaaagaagaaacatcattatagaagttcttttaggctgggggcagtggctcgtgcctgtaatcccagcactttgggaggctgaggcaggtggattgcttgagtccaggagttcaaaaccagcctgggcaacaaggtgaaactccatctcaacaaagaatacaaaaattagccaggcatggtggcatgtgcctgaagtcccagctactagggaggctgaggtaggaggattgattgaacccagatggtcaaggctgcagtgagctcaatcgatcctgccacctcagcctccctagtggctgtattccagcctgggtgacagagtaagaccctgtctcaaaaaaaaaaaaaaaggaaaagaaagaaactcttctaatggtgctgcttttatttttaaccagcagaagaggctgtgccaccatcttcttacagagtctggctgggtagagagcaggtgctgtgaacggagctgaatgccagccaggcttagtggggttgggggtggatggggttggagcaggtcttgctgttgccgagaaccatcttgcaggttccaggaagctgtgttaggtcagcactttacttactttgcctgagacagaactgttcacagtggagatgttagaatgagtgaactccacaaagctcagacccactctttttaaaagcaggaatgacttcatagttccccttcccaacaaaatctagcttggggtttcaaagataatttattcgacaatctaaatctatttatggagtgcccattatgcactgggccctgtgctgagcattgcggataaagcagtgcacatagatatgtcatatgccagatggtaataggagtcaagaaaaataaaggcgaggaaagggtggactggggggaggggaagcactattttagacagtgtattaaagtctgggttccctgatcaggatgtttgagctggagacctggagctcccataatggttaaggctgtctactggaagatacttatcagatacttcctgattgtatctggaagttgtcaggtgacatgtgacatttgtaaggtgaagatgtacaaaatcggtacctgggaattaggtctgctggagaatgttagtgacatgctgagtccttcggtgacagattggaatctggacgggaatgcatcctggctacagtgcctctggggtggacactcccactggatgtccctgtgcagatgtgtccctcaacctcagccacttcctctgcatcttcaggacgtcctgttatgccaccccaccccacccccaaactgtgtcctcctcaaactgtcctcctcgaaccctcccgggttccttctcatttctcagccagagactctcactccgtccaccggacccgggagaagggcagaacaactttttctctttccacctctgagtccaattccgcttcctttgaggttgggccgaccagtgtcctaccctctgacctcatgactgtccttcgcatccctcgaggcctttggtgtctcagtttttctcttcctctgggtagcctcaggactgaagttactggccctcctacatattctggacactgtttcctgtcatttaagcttcatttgagcagattgacaagacccacatagattctcgtgtgtcctgtcaccacctgcactccaagatccagaattctgccagtccccattccaggataacttcccttgattccttccattttcccagttcccctccctctgggcttggcccacagcggtctccttctgccctttgtcccctcccagccttctcctgccctggccttcctcccagccccagccaggcctcggccacctcacctgtgtcctcacttggcctttgattctcctgcccccgtgactgtcccctggcctccccttgacacgcaggcccatctgtttcctctgtggcttgtcccagcctgccaggcgttgctggagagagccacggtctgtgccttctggcatcagcaccgatcacaggttcagcagagtccaagctcccgagctgctccctgagcctcagtagccccagattgactcttggccacccgacaggtccatgtctggatctgagcacagacctttagtccagtccccacggaggctttgttccagcagttgcctcacctgctgagaagaccgaggtcgttcagctaaaattccttgaattttcttcccctacacttccgattctgtctgtccatcttttttttttttttttttgcatgtctacttctcaatctactctctacacctggagcggcaggcctatttccacttgcttcctgaatgccatatttagggttctctctgtccccagcatcctccacctgtttccagcacctgccactctccagccctcttcttccctggaactcttcttgattctgccttctcctgtgtgtcttaaagcgtgtggtatttttggcttcagaatatctgtggccctgaactagaagtcagactggaccttgttcctggctctgcctctgactcatttggtaggctttagataggctgccttgctcctctggcctctgttttctcatctgtaaaatggggtacttggacctgttctccaagaaaacttacacttctaatgttcagtcattctgagtctaaaggggacgttggcatgtctgctgcaaatgcgttctctagttagaaaggaggaggtatctttcatttctgcccttagaacctatgcctgttaccttggcagcatgtcctcatccccaagtgacccctcattagccactcagattcccagaaagccaagtctgtgactccattatgaaggcctttgccatgagcctctgctgacttggctggcaggctttcccgcccgccagtgccctgtcactgtgcagcaggaggggtgttcacagcaggatacaggcggctttcccaggccagacacctgaagatgctcaggctctcaggcctttccagcatccaactctacaaatttgaggcaaaaacaggtgggagggcgagggtcctcatctgcctccagctctgaggatgcaagagctgtgcggcagcagcagttcccaggaccctctagtcattcccatctttgctttctgagctggactccttacagtctgggtcttatgatgcctgcacttatctctgtgcctttgcttatgctgtttctccttctgctgtttctcacctgtttaaactcccagccatccttcaagaccatctcagatgacccccccctcacccttcatgaagcgtgtcctgaactctcaaagtgttttttctactatgcaaatcttattttgccttctgtggccatttgactgtttggccttgggtttgttatttgtgtgtgtgtgtgtgtgtgtgtgtgtgtgtgtgtgtatacacacacgtatatattatgtatatatacactatatatgtgtatatagatacacatatataatatatatgtatatatacacatatttatgtatatacatatattttatatatatatataaaactttaaatttagatcctaagacttaggacctcctcctcttaactcggtgattcttggggacaaggcacataacctagaaccttcttttttagccccagaaggaacctgagggagaggcatttgtcaaatctttctagatctttcttttaccatcttctagatggtgaaaccaaagcccttagatcttggcaagtcatttagtgaatagcacagcttggactcaaactcaaattttgcaatttcaggtctatgtgctctttctagtacaccctactcttgagtctcagtttcctagctgtaaagtggaggtagtgtaataacatctgtttcatggggaatttgaggagctcagagaattaatggaggagaaaagtttttgtaacctgggacgtggatatgggtctcctctttgtagctgggcagtgtgaggggggaccggaagtcatcactgcccccaggggtgagcatgctaagaaggtacagttagctgattggaacctgtaaggcccgccttgcctgtgggagaaaccttagccaatttaatcaagaggcttttgggagagtctgctgagatggcttttggggtcattgatttttataggacctgggaggtgattggatgtcataggaggtgtttctgcaaacagtagggtaatagatggacccggaagggaatggttcacttggctattggcttattgccccataattgagcctccttcaagcaatggtgttcccacccagcccctgacatgcagatcagaggttggcagctgcagggctcttggcatggctctctgcatacccagcttatatccccagctccctgaaaagaaccacgcctggtttccatagtgccctgcccagccctgaagcaactgtcaaagcgtattgatatcacctatttttagcagttgggactaggacctcctgtttcccttttccatgtcaaaacaggaggccatccaggaacccactctgcagatttcactttggtacagctcaaagcaggggctgggagtctgtgtctacatatcaaagcttgcttctgagagccaagggctcaggcctgcactgtctcactttcccactgcctgatcacgataagtgctgtttacccagttctcgccctgagcccagcactgaactacagtctttgtgaactcttgtttaatattcatcactgatctataaagtaggccataaaacagaaccattttacagatgatgaagctgaggctcagagacactgatgttcctaagaatgttgtaaaggttaaagccaggattcagaacttggtctcattccaaagtccagcactttccacttggctatacggcttgaatatgcacttggttcatgcgtacatacatatatagaaggaagaaagggaaggttcagtcaatcccattcagccagctttgacttggagcttactcagtgctgagctctgtggttgcacagatgagctggatgttgtccctgcctgccacattctgttgggagacatagacaagtaatcccctgaactacggtgtattcagtcctctaaagaaccagtgtaaaggtccctctgtgggtctggaggagagactgtctacgtattactgataaaatgaacaagatatccaagagaaagggtgaacactgatgtgggccacagagaatgagaggagtttgccaggcagaggaggggcagggatttggggcagtggtagtaacagccccaccaagcaggagcctcccttcctctcttgggagcaggtgtcctggagggtagatgtggccactgtaagtccttccctaagctgcttttcaacatgaaaagggagctttttctgatggtacattttgcagtaaggaatccaaaatagattattttgacctttgtctcaagacttgtcagatgtgcgtcctctggcctttgcagcatagaatctggcagtgagaggcgcagggctgcatagtgaggttggtacatagatatggcgcctgctgggagggttcaatagccactaaagggactcttgcagctcctttggctttgctttaatgattggtcagaatgtcatcacatttgccacttgtgtggacactactgggtgctcttgccatctcagatgtaattataagaagaaaagagtgactattaggtatacctggaggggacataggagagtataaatgctaagagtgggatctatggggatctatgttacaactgctggaaacagacaaaaccccttccttccacccattgggttcagtgcagtttccatagacagtgcttaggggttagttctgttcacaggggctgaaactgaggctcaggtgcccgtgctctgaggtgggctgggggtgtgggggggcttgcttgtggccacacatgaggtgagtggcagagctgcaacttgaactctaatcttctgcctccttgcatggtggtccaaagaaatgtaaactgcactcaagaaatgccacagggcgtggtgtggtggctcacgtctgtaatcccagcactttgggaggccaaggcaggtggatcacctgaggtcaggagttcaagaccagactagccaacatggcaaaaccctgtttctactaaaaatataaaaattagccaggcgtggtggcacatgcctgtaaccccagctactcgggaggccgaggcaggagaatcacttgaacccaggaggcagaggttgcagtgagcccagatcacaccactgcactccagcctgggtgacagagcgagactctgtctcgaaaagaaaaaaaaaaaagaaatgccacaggcctctcctcatcctgtctctgaatgctgggaggcaggccgagtgttttcctgcccacgtgcaaatactggtgctgaatcggaagctgctaaaggggtctctaccactgatttagatgattccaaggaagtcatctcacaccagcaggtagctggtgttaagtgagtttatagggcttggtcatcatggggagcaggaaagatccccccacaggcagagaaggcactttaggctagtccgtggtgtggaaacctagagtactggatgctgacgctgacaggggtgtgagtttgaattccagctctgcctcttatcaaggctgcacctcccacaccccagccttagtcagaggatggatgtgatacagtaaactccaaaggcattcatccccttccttctcttttcatcctttgggtacaatttgattatctcttcagattccttccagctctagtttaaacacaaactatatatatgtatttgagatagggtcttactctgtcacccaggctggagtacagtggtgtgatctcggcccactacaacctctgccttcctggttcaagggactcttctgactcagcctcccaagtagctaggactacaggtatgcaccaccacacctggctagtttttgtatttttaacagagatgggattttaccatgttgtccaggctggccttgaactcctcacctcaagtgatccacctgccttggcctcccaaagtactgggattacagacgtgagccaccacgcctggcctatttttaatatacacagggtcttattgtcacccaggctggagtgcagtagtgtgatcgtagctcattgcagctttgatctcctgggctcaagtgattctcccacctcagcctcctcagcagctgggactacaggtgtatgccaccatgcctagctatttttaaaaaagaaaagtttatagagatggggtcttgctatgttgcccaggctgatcttgaattcctgggctcaaacgatccttctgcctcagcctctcaaattgttgagattacaggtgtgagccaccatgcctgactcagatactcttcataagccaagaaaatttgcaggtcctagaaatcccgttatgagtttcgtcactcagacttaatggtgaaggctcaggagatgttccagcagagagttgttagatgctcttcaactcctgagctgctctgaggccttgtagttccaatgctcccatgtagattttagatgattaaattctacaaccagccttatgggtgtcatatttccagaattgatgtactattggaacagatgggccttgccaagatcatctcacacatcttgatttatggaaaggattttgccagatggacttggatgagaaattcagattagaaaccacctttctaacacccgttagagtgtttgagtgaaatgtcctgccatttgaactcagaattgcacctgtctgtttccagtgactggtttaatggtctgctaagagggccggagccgtttgccttggcgtttacccacaggcggcatggctatatttagccaagacacaggtgaacatctgagacaggtcccgccgctgctgaatacagtcctcaaagccgagcgtaggatacagtttactaaatgccatgttgggctttcattgccccagcgttcaagccacaaggtggtcttgtgggataaaacacgagtgatcagagtctggaaggcccctgcagctaagaagaaagtcagatcattttgaactggttggatacaagataggttttgtcatctctcattttaggattgtgactgggtttcttattgcctctgatgcaggcaagcaaaacctgatctgaacaccaaggggtcaaggagcttttaaaatgaggaagccgtttctgattccattctcggcttcaccagccccagacttttcataggcatctatcctggcaggtcctgctttgggcagggctctgtggctgagcaggaaggatggagcccagcccacaatggctgaaggggtgccttttgcagtgtggccagagggcaaagcagtcagccacccggtaccagcatctggctgtggtctgcctgtgaatgcacaccagccacaggtgtttggccatttcacctcttggactagcctgtaaaacctgaaattgcttgagattttgcagagcccaaacagcaatttcgagaaggggttgtgcatgtttcaagatcatcagaacctcttcctgggtaggagaggatgtggaaaacttcagtactaaatatttaacgggcacactggaagcatttatgaaaactgatgctctgagactctgtttaatgagtcttgggtgggacctgaattttgactttttcgaagttcctcaagtgatggtaatactaatacacagccaggatcaaaaagcacagccaaggagactgcacaagttggacttggctaaagatgagactttgacagtagagggagaggaaagggaggcctaaacttgttctactcaacatggtggtgagaagactaaagaaaggaaagaaatggaacaagctcctttaagtgacaagcctctcatgggctaattagactaggggatgaatggtgaattcttttgaaagtgaaaagaacagttttagtcatagccattagcatgttacttggtaggaaagtaaatattgggcttaaatcaagtctgtatcagccccctccaggggccaaagttgggggttttcagcttgtttgagggcactggcagcatctgattctaatgaggtgaactcataaaacaacaaatgaatatggacgtgacaacccagcccaccccctaaaaataatattctcattaaaataaacaattatgaagcaaggtaaaaagaaagtaaatggcattcacagccccaccatcccaaaataacctctacaattccttctggatgtatctagatagaaaataataattttatataaatgagattccacctgatttttttttctcatgtaacattgtgctgtggatctcttgtcacatcaataaatacaggcctacatcagttttaaatagtatttcattatatggatgagccattttctaatccgtctttgttgatggacatttaggtcatttccaattcaaagctattaacaatgagataaagcatcctgcacatgtgcgtctgagatacacatcctgctgcggtgacattacatggctgcctagcctggagtggagatgacaaaagccccacaacccacgttctcccatggcactgcccccagcttattgtattatcaatcatctgttgttcgcttttgtgtttccttatccccttcctcccacacagtcataatggcctctttggttaggtgtggagtacactgtcctggttgggtcctgccgctccttgttattagactgtgcagagtgcaaatgtgtctgaaagcccattggcagtcagcagaatggcctctgactctgagtaactcatgagtagcccactctgcttgtatcaccccagccgtctttctaacagagaagttccagcatgcattaggtccacataaagtgatgggaacagtccctacttgcctcactttaaaaaaataatttatatttaatatttatttatttctcaagagtcttaacaggggcctgctgggtgccatatcttgtgcctggcacaggaaacagtcacaattaagtgcacggtccctggcctccaggagctgatgtctgtctgcacagaagggctcagtagaatgctcctaaatgcagttctccatggaagttaagtggctgagactccttaggacagcagtatcaacgactttgacttcatagagaaacttttgtgtgaggcagatgattttgtaatctcctcagataagactgaagcagttcttttggtcaaagctagaggaagttaaaatgccctcattgaccagagcaaaatgatcttaggcaaatccctgcctgcctttgcatttgccgtgtggctcattttcctggcaaaagaataaaggggttgtgaattttagttctgtactttaaagagtttaggacgacaacctcaagaccagtgcataatgagagattattggtatcatagcttgtactttttgctagattaatggagacctggaatgcttggagaagattggctgtaacttgagaaactcagaaggaaaaggcagttggtgattctgctgatcaattggttaaggggttttatgttctttcaggcaccactttgtaaaacttccagaaactagggagtcccctccccagaaaaatgcacatatatgcataaacgttgaatttttttttttttttttttttgagacggagtttcgctctgtcgcccaggctggagtgcagtggcgcgatctcgactcactgcaagctccgcctcctgggttcacgccattctcctgcctcagcctcccatgtagctgggactacaggcgcgcgccaccatgcccggctaatttttgtatttttagtagagacggggtttcaccgtgttagccaggatggtctcgatctcctgacctcgtgatccgcccgcctcggcctcccaaagtgctgggattacaggcgtgagccaccgcgcccggccaacgttgaattttttataccatcccaagcagtttgcagattcccagcctaagaacccatgatatgatccaaaccctggtttttgtgggtagaattactaaggcttttagaggagggtaactgtgagggctgaataaccttgctgatgaactattcctaaagaaactttttttctttctttcagcactggctggatcatgccaaacccataaaaaagcagatgaaaagtaagtaagcagaatttagctcactcatttattttttttctgagagtaaactcctttgccagtgttttgaggtgttatgttttcattagaacttggaagcattttaaaaatcaattcggtattaagtggatgatttttaatttcttaaggctagccaaagatgagagtttaaaatttgaataaaaatgtttagtggatattgaaaaaccaactgtgctctcatttgaaatcagacgcctctgccaatgagaactgattaacctgctattcagaaactcagctttatacctattatatctacttctaatgagttacaacatagactcagaggatgagagagtaggagggctctttgatagtctgctacagctttctcaatgtacaggtgtggaaaccacattttttaatgttgtttatgcttgggtaatttttaaaaattcatattctcttaaaagtactttaaagtatttttagagaacagaacactttgcatcactttcctttagcctttgtactttgtaaaaactagctgtcagtttggagtattgtggcatcaggggtgaaaataaaatgtcagcttttagtaatctgtctaaatcactagggtttttctcctggaatgaggttactagctaaactatcttagtcagcacaaaagtccatccatctcagtttccctgatgaggactgaaaagaattggctagtgtcgcgtgcccagttatgctgtcctgatgttgtgctaaatgttatagatttaacgtgctttcccttttgtccatcctgtgatcttcaaaactgggggaaaaacatcttcaaccttccatctccaaatgtttagttggacctgcttatgctttacactttcgagttaaatactattcttcagaaccaaacaaccttcgtgaggagtttacaaggtaggccacgatgcagaacaagctcccgcccagcagggcttgccttacatgtcatttatggctcttctcaattgtgggtttgcctcttcttctgtctgctgtctatttctcagcaagagttattagtacttttccggtgcttccgtgttccgttaaaaatccacaactttgcttaatttgacatttttctgagtgaatagaaattagaagatacattttcttgtcacacttctattttcttggaccctgggtaaattaattggttgctctgcggcgttttatttttatctcaactacaaaaagggaaggcagatattggaaaagcatttctcagtccttaatcgccatcttatgttttaagagattgcaaaatattctcttgattgttacaatacaaggaacctctttaagaaaaacagagtaattatagcaaagttgttaaaatcccttcatgttatcttttaactcccctgaatttctttttttttttttttttttttttttgaaacaaaatcttgctgtgttgcctaggttggagtgcagtggcatgatcttgggtcactgcagcctccacctcctgggttcaagcgattctcctgcctcagccacccgagtagatgggattacaggcgcacaccatcacactctgctaattgttatatatttgactggagacagggtttcgctgtgttagccaggctggtctcagactcctgacctcaagtgatccacccgctttggcctcccaaagtgctgggattacaggtgtgagccactgcgcccggcctgaatttcttttttgttttgtttgcccatgtctatgtcttggacttcagaaacagggaagaagaaaaagaaaatttgagtaacattttaaatgtggagtttccctctacccttttccatcagtgaaattctctacaaagccttttcctgcttttgatatccccagagcctccttgtcgttgtttgtgtgatggactgcagtggtgacatataggctatgtaggctgctgggtggttcttagggagatgacccctaaataatgccttaaagactgactggttatcaccatttcccctgggctttttttttggagacaaggtctggctctgtcaaccaggctggagtgcagtggcgtgatcacagcttactgcagcctcaacctcccaggctcaagtgatcctcccacctcagcctccctagtagctgggaccacaggtgtgtgccaccacccctggctaattttttgtattttttaaaatagagacagcgttttgccctgttacccaggctcctgctaggctgctatggttagtttttcttataggaatcaagagttctggccatgtttatactgtgtctcttgtgagatgagtatacaagatggtatcctgacattcagaagtgaagttcagtggtggccaaacacctgtcaggaagcaggaacattctggaatgtactagaaccttcagcacgcccgatctccttgatttctggcgaacagtcattctagtgttgctcctcagagtcctctatgaatgctgcttctagctgtcatcaaagcgattggtttttaacccaggttgtgtgaatcagaaacacctgggaagcttttgaacagctcagattcctgggggccactcttgtgtgtaggattctgtttccgtaggtagggagcagagcacaggcagttttggtttttacaaagcattgtgagtggttctgatgcctacatcctcctggtaaaaaacaaacaaaagatacccctcttatttaagccaagacatttatttttttacttgagtaaaccccatgcgtgttatttgctggcttctttctcattttttgttacccctctaaccatttgcagtccagtgccaggatttttcttgtttcgtgtgtgtgtgtgtgtgtgtgtttgtgtgcctgtgcctgttttgtgttttaaaagagtctgcagttacactgcatcaggggaaaagaacccccagtggttttttgactagaatcagctgcaaactttttgttacaatccaccgcagcagatctggaatccgctggtggagctggctgagagccagaccccgcggccccaccctgcctgggttattggacatgttgcatgcccatgtgccacgttcggctctcttctccagcacggagggggttgtggaggccgtcattggaccatgacgtgtatcacgttccatcctacaagtatcttgcgagttccccacatgcactcaccttcctagcgtggttctgggatgccttcctggagacccaagaggagatgcttccaccaaagttctcatttgatttggactccttttttacaatgcaaaactccatgctgtgtgtggggtggggtttgcagtgggaagctggggattgggagcagctgggaaagagttaccctctgttgacttttgtatatgtttgtcaggtacctgtttgttttacaactcaggcatgacattctttctggaaagtaagtatgtttttgttctaactcttaacccaggatagatcatagtgtatttcaaaataattcactgttttaactcttttacccttgttcccttttcaaaattcaaaaaaagtgcaccaggcattgtaaagtgagtctaatacttgtatcactgtcattatcatcctattttaaatgattactatatggcttgaagcatttccaagaccatttaatatcttaagtgatgtgtatttgggaataactctctccctgatcacatcactgtcccattcataatggcttttgtcgtatttgcaagcaagatacgttattagtatgtatacacttacaagtatttggacagtcaaaaagtgtcattcatcaccatctgcatatatgtaatggaaagaggttatgttctgattccagtagaaagttttagacatctcatctcacttccttttctcctcttaaaaatggctttgaaatactaggcctctggcagcacacagtgatcattgagtataagaagcattggcactgaagtggttgatttcgcatgcagtcttaatttaccgtaaagataagaggtttcaacaggcatagctcttataactgtgtcatttttcagcatctgtattgaatattttctattacatgaaaaactaaggctatattgagtctaaaaagtaacccctgctattgaaaagaatacgttctgattttgaatataatctgaaggaaattaaatatgtaatttccgaatttgcaaactctccatagaatatgtgctataaaaacctcagtgaaatgtactccatagaccaatagaacaagtagattgtacagtgtatacatttgccttattcagccgtgcaatacagacctttggttggtgtgtgtattatgagtgtgtgtacttttttttaatcctctctccctctctctctctctctctacctctctctctccatactgtgctcctcatactaaaggctgtgtaactctagaaattgtcttcggtttggaaaaatattaatggcaacaccttgcatttgtacagtactttgtagtttacatgcagtttagcctgctttgtatttcaaagcagaatggtgttcaagtcccaacattgctcctttccagctggatgacctggggcaagagcccttaacactgagttcctcatctatataatgggagatgggtcgggggggctcactggcaacacctatcctaaaggtttacaaacttgatgcattgaccaaattggataatataaatgaaaaggctttgaaaactatgaagtgctataccaatgtatgtcattattatttttctaaccaaatttgaaatattacgtatgaatgagatcactgaatttgcagtagtactcttctatggctgtgccttagatagacttagaatgctgagtgtatccagccatgctggcagtgttcgatatggtgtctgtgtgtttatttttaacgctatgaccttgtttcaagaaagatttgaaggcagctttaaaaaagatgcatgtactatatcaagataaaataaatttaaaatatgtttaaaaataataaggcaaagggaatacttttcattctgttttccaaacttttccattcttgccaaattcagtaaaattgtacacgattgatagaaactatacctacattgggttattttgccctatgatgagaattgactttgggaaatttgtagtgcaagtcgcttgttgcattctttaatgtagacagcaaaaatatgactaagaatacaagtcattatctaaatagcgctaccttttgaaaaatgattttaatgacattttgtatggttgtacttaagttcctatttcgaattaatttcattttatttttttcaagattgaaatgcccttatgaaacagctgtggaattagctgctctctgtctacaaggtacattaatctttagtagtaattagcattttaatgttattgctttttatttcaacaaatgagtgtccacagtataccaggcccagtgcttagctttggggatataaatgaatatgacacggtctctgtccccaagtggcgtgcagtccagtgaggaaggcaaggagtagcaaggactgcagtgcagttccttcaggaacagagacgtgcaggaggtttggacaaggaaggcccattgtggggatgagaagaccatgagtcaaggaaccaaggcacaaaagtgcagagaggttagcagcagttgagtgatgctacagagtgaagttcaagcatttggacaggtggatgacctcgggccccatttaaagagaaagaatttcatgcagtcagcagtgacacctttgaaagctcttaagagggagcaggcctggccggatatgcactttagaaaggccacgttggctatatggggagaagggatcagagcaggaccaagactgggactgggagtccagtgaggaggtgctgctgtaatagaagggaaaggaaactaactagggcaggggtttgcacacacacacacacacacacacacacccccacacacaccaagaaatagcattggcagtacaaggagaaggacttggtgattagacttaggtgttgagggaggagtttgagatgattctcaggctgtttctggggatggatagaggttagaagaggtggactctggtggaggaaatggtctgtgttgggtcccttgactaagaggttctagaagctccagcaggttcttgagtacctgaatctggctcactcagagaggtcagactggaagcattaatgtcaggactggtggggtgcaaagggtatttttgcatgtgagtgggaactggatggtaagaggtctgcctgcatgattgtcagcattggccgtttatctgtgtgatgccctggtggtgtgtagtttcggatgcagaagaaacacttgctaaagtctctagcactaattaagagaatactaatgtgtaactgcatatccgggatttcattagtacatcagatagacatatgttgtgcactcatttgccagcatgttcatcagcttctactggattatggattatgacatattcattcataattagtaattacttatgaataccataatgagaattgacttctcacttttgtatttggccagtttttaaaagtggaactgagaggttttttcaaattataaaattagtacacacttactacagaatatcaggacaacaacccaccaataagacaagcataaggaaggaaggaacccactgtcctaccacccacaggcaaccagaatttctagctatgagttttgagtggacttttgaaaatgttattttgatcagtcatctgcaaatttttgtataattttttttacttggtatttttagtatgtgtattttgtcatgtgtacactcatagagatggtttttaatgaccgtaggatgctcccattacctgaaacttctattcttcagtcaccttttaattcctgttgtcttgaactcctggcctcaagcgatcctcccacctcagcctcccaaagcactgagattacaggcatgagcaaccgcacccagactcttaattcttattatctaatggggacttggcatatagtagatgcttggtaagtgcagagtgagttgaattattgaaattggagagacccccctcaccccacccccgccaagaactttaaaggcagaacctttaaactggtggtagagttgatggtaatgtcatctatagccatctgtgccaaatacagtgctcagtgcttccgatgtatttttctgatatgacagtctttatggcaagtgctataacgacaggcatggcttggagaacatggccgtggcctccgcactccggccactcacccacttagcaagtggctttcctctaccccagagttcctgagctgccagaggtcacaccatcaggcttgacagcccagcagtagatgtcagggtgtcacgaatgagacaaaagagacggaaggccattaatccactggaaaggtttcctcctaaagccattggcacaatattgcaagcttgtacgttgtcctgaaagatcagaggatgaggtgcacgtattaccatcccaccccattgcaatgaagccctcaccacacttaacagagtagtgtagaaccaaaaccttgccccagagccgagacagacacaaataaggtcagttctctgtgaccgttcttggagaaattatcctttgagctgaaatcataatgtcagtgtgattttaagatacaattgttggccgggcgcgatggctcacccctgtaatcccagcacttcgggaggccgaggcgggtggattacctgaggtccggagttcaagaccagcctggccaacatagtaaaactccatctctaccaaaaatacaaaaattagccaggcatggtggtggacatctgtaatcccaactactcaggaggctgaagcaggagaattgcttgaacccgggaggcggaggttgcagtgagccaagattgcattactgcactccagcctgggtgacagagcgagactctgtctcaaaaaaaaaaaaaaaaaaaaaagatacaattgattgttatgtcagatagaaataaaaagacttggctgggcatggtggctcatgcctgtaatctcagcactttgggaggctgaggtgggcggatcgcttgggcccaggagtttgagaccagcttgggcaacatggcaaaaccctgtctctacaaaaaatacaaaaattagccaggtatggtggcgcatacctataatcccagctacagactgagctgggaggatcacctgagccaggggaggttgaggtttgaggttgcagagagctgtgatcacgccactgcactccagcctaggcaactaagaccctttctcaaaagaaaagaaaagaaaaacactgaagatttagacacaaggcgaggctcttgttacattgtccctccgtgccccctctccccaaccccattccatgagtaaatgctacagtctgctttccacctcacccacagctgagctagcttgtctgggactctaaggatcactagagcatctctgtaggtttgaataaaatgaagggttgtgtttcctcctgtgcttgagccttgaagacatgtcttgctgtggttgtcctcgatgcctcctgagttgtgatacagtggccctgcagggaggctgtgctcttttgggaactaaatttgtggtggatttaaaaattaaaccaggtaaaaggaaaagaagggagaactaataggccactcatctgttgcatgcctgtgctcctttttcattcttgtaacaattcccattttacaaatcaggcaccggagacccagagatgttaagtgacttgcctgcagtcacatagatagattatgatagggttgggatccaagtcctcttgtgtctgagctgtttccaccaccctccacggcctcctagagctgaggcctggctgcagagattgcaaattgagtgaagtgttagttgatgggatctgatgtgtgcagcagaggttcttaaagtgttttccagggtcgccacattagcatcacatggggacttgttagaaaagccagttcttaggccgggttccagacctagggattcaaaaactctgggggcggggcccagtgatgtgcattttaaccagctcaccaggtgattctgatgcgcacccaaattcgaaagccactattatacatcagtgatttttccaacaaatgggcaggcctgtgacctgggcatcttgttaaaaggcaggttttgcttgaataggtctggggtggggtttcaggttctgcgttttgggcaagctcccaggggatggcagtactattggtgtgtggtccacacttggtgtagcctagtgttagagggaactctagaggattccttttcattctggggtctgcttcctgagctgcagggggtgggggagagtggattttctcatcatccctggaggagggggccacctgtatcctcaggccctccatcctgtgggggacttggcaagggcagcacaaattgcagcacaaattgggcttcttgctcggatcactcgtgtggctgctcctccctcctttctgcacagctgtctccctcccaggttctgcctgacttcccgcagttgctcctgcagccctcgcacccctcctccctgcctccctctcgctctgcctctccctccccttcctactttccccctggatgctgcatgtgccgaattcttgatctatcctctccagcactgcagaccctgaagtgctgctctgacctactcttaacgagaggcttgttaaatggatgtttctgggcagatcctcattccctgcaattgccttttattgcaaattcagggttctaccccttcgtggggaaaatgtaactggtgcttccctgggtgggaacaacagtggagagaaagacagtaataactaggatgatgctgtatcacccaacagggaggacattagaatgcttctaggattttgagtgtacatatgactacccaagtgagagttaagtcttcccgaaaggagagagttatacattggggcggggggctgtgctttataatgatgcaaaatgcctttggacctggttgcagcaataactgaaatcattcaatgtctcctattttcctcccttttatgaaacttacagcggagcttggggagtgcgagcttccagaacacacaccagagcttgtgtctgagtttcggttcattccaaatcagacagaagcaatggaatttgatatcttccagagatggaaagagtgcaggtaccttgatgcaaccgtctagcattctgatgtatctattttgtcataaataagtgttgatcacactcctttatctaccagtagaattgttctgttgatggccataaaactgcagcgccaactcttctctccttgtgtcagtcctgtttttccaaaggcccacatcttgtcctttttatttttgagagagtctcgctctgttgcccaggccagagtgcagtggcactatgttggctcactgaatcctcgacctcccaatgctcaagcaatcctcctgcctcagcctcccgagcagctgggattataggcgtataccaccatgcctggctcatttttctattttttgcagagatgaggtttcaccacgttgcctaggctggtctcaaactcctgagctcaagtgattgtcccacctcagcctcccaaagtgttgggattacaggcaggagccaccacacctggccgtctgtctcttaagagatgtgcagcaagaaccaaaccacactccttttctctctctgcaaacagagcctggttctgatttgtttattgcggatgggggagccaccactgtcttagtgacaccccagggcatcccaggcactctcacatacctgcatctctgggacctcagggcctgaaccttctgaaacaagccctaaatttagaaatataccctgttgtataggaacatacatatttgagaccgtgtgctgtacagtgttacatttcaggaagtgtgatcatcatacctaaatccagcagtgtcatttatcccctttgttttttccctccattccccctgcaggcaccactttcatgcctggactaccaacgccacccctcactcacgggtttcctagatgttaacctttcctccctcccatcccatcttccccaaacactgcctcctccaggtcacccttggactctggagcttagcatgactttctcttatccctcagtcattctgaaaagctcctgtgactattttagtggaaggtggcattagtccattctcattgtgtaacactgaaacaacgtaaatgtctgcgggtatggcacaccccacccacacacttacacatccactctcctccctgcaggaagccatcattggcagcctgtagtcttttccttttgcatttacatatacaacttgttttgttgtttccttaagtgatcatattgtaagcactgttctgtgattttgttgttgttgttgttgagatggagtttcagtcttgttgcccaggctggagtgcaatggcacgatcttggatcttggctcactgcaacctccgcctcccaggtttaagtgattctccttcctcagcctcccaagtagctgggattacaggcatgtgccaccacgcccagcgaattctgtatttttagcagagatggggtttcaccatgttagtcaggctggtctcgaactcctgacctcaagtgatccaccaaccttggcctcccaaagtgctgggataacaggcgtgagtcactgcgcccagcctgttctgtggtctttctagtcaattaacagtaaggtcttgggaatctttttgtattactataatttggcatccctcattgctttaattgctgcataacgttccatagtaaggccgtgcccttcagaatcctgtgggcttacgagtcgcagtttacatgtatttccattggtttttctaaggggaaagagccctgcccaggcggaactctcctatctgaataaagcgaagtggctggaaatgtatggggtagacatgcacgttgtcagggtaagaactgtgtgcgtttaagtaatttggttttgctgttactgaaaaatgtatgaacattatgcaaacaaaataacttgtggtgaggaaactgtttttgcattttgcattctgctgtgtgacgacctgttagaaccctctaccgattgtcacttcgtttgtttgtagggaagagatggctgtgaatattctcttggactgaccccgacaggcatattaatctttgaaggagctaacaaaataggcttattcttttggtaatttagttttgtctaatattaaaaatgtcttttcctattttgtggtggaattctatgtgatggatgattattgaggggtatctgcaacacccagattcatcctcagagcacacggtgctgctgttgtgggtctgtggcagttgcgctgaaacttctggataatcacacttggatgaatgtttttattttttttttagtctaagctttaaaagtagaaaggaaactgctatttgatgtgtagatagttttactgcagattgtgcttttaaaatgctttctgtctgactaggcctaaaattaccaaaatggattttaaaaagagcaaattgacactcgtggtggtcgaggatgatgatcaggtaggcctggctcccatttcttcccccttgctgtgaaaatcctgtgttggggttgcaaacgcccactcgaggcccttgtgcttcctctttaagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcaggtagggagccatttctgcaacacggatcacgtcttctgaaggagggcaactgtgatttctttcttgtatgcgaatagagtagtggatttgagtccagaaacttaggttgtgtgtcccatccccacgtttcttaaggtgagtaactgaagctcttttgacccccacctggtcattgataaaatggaactaataacaaaattgttaataactgacatttagtcagagctgtgctgttcaatacagtaggcactagccacacgtggcaatttaagttaatgaatatgaaataaattttacaatgtaattcttcagtatcgctagtcatatttcaagcggccaagaagccacatgtggctagtggctaccatattagacaatatagacacaggacacaggatcattttggaaagttctgttggccagcactgtgccagaactgttcacacacccttaataaggtaggttgattaaccccattttacagataaggaaaccagggccagaggcattacgcttaaaatcacacacagccagtaagtggtagagcggagattcaaccctgtgaactctggctgttaaatttctaactgctactgtattgccttttgcatgccaatgtccagaaatttggggtaattaagaatgagagcagatatcaatgtgtaacccaaggtaggatgagtagatatttgaatctgaaaagagcctgaaaacatcaagagcttattctgatatatttttgcttatcatcctaagaccatttttctcaaagtgtgtgaaaactttcttggtgtttgttaaaaatgaggacaacaacctcatctgagacctttgcagtcagaatctgtgggtatgcatgtgtgtgtatgtgtaaggcctggcagtacgcatttaaaatgtgctcccagggtttttgaggcctatttacatttgagaatctcagttacgatatctaaaacttcacatggtttcataacctctacccacacatggcacatccctgaactctatttaaatgccaaaagatttgctcatttcaaatgtttctactgtgtgaggaaatagctatgaacttctgtttaaagaattattttgttttaaatgctccaaggggtcgggggcggggtggggggaagaccaagctctttttgagaaacaatcaaatcccagggtcctgtggaggatgcagaggttaccggagacactccacagaatgctggtgtctactcggagtggagtgaggcgggaaggacagtcagggcagttgccaaggcaggcttttctctcctgggaggaaactgccccaggcttagtcccagaccatgttcctttctgctcctctggaagtgtaagaaggaagggagtttggaggagaagaggttgcccttagaggcacacagagcaggtgacaaatggtgactaagagcaactggaatgaagcagttgaggagtacatcagacgaaaccagcaacctcctggaatctgcagccgggtgtcacgttggttgaaacccaaaaagccttagtgaaatcagtaatgtttgccttggcatagcaaagaaagctgagacctagttaagtgcgtattgataacagtcttctaaaagatgggttaaatgtctatgcagtgtgttctgtgaaaggttattttatgtgaaaatcaatgttctcttaatgagatgtatcaaacctgcttggtttgtgcagccaagtggctggtacctaaattgcaggttttgccctttggtggaaatatctgcccctggactgtagcctggacttggcaaaggagattttatttccaaatggaaggttaaactttgtgtttctttacccaagtgagttcaggctaagttgaaacgtacgttggagctcttggaaataaaagtgcactttcaaaaacaggtaatgtactgagattctgatattgataacacacgagaaaatatttacttcccagtgggcggacagaatatcaagctacacatggctccaggttacgaagaaccagcacctttgagaggaagcctagtaaacgttatccatcccggagacattcaacgttcaaaggttgtgtgtttttcattctttcttggaattttacattatgcttgagtcatttaagccctcgaggagcttggtcaagcagcttatgaagaaagtacccgcagttctccagtctggagcttttggaaaaataatcccagtggtgttcttttaacgggacctggccacttccgccatccctctgtcattagtgtttgccgtggatgtgttcatttatttctcccctttctccatatttctttccatgtgcctctttgcttcttttagacctgggctcaagccccggtacctcaggaatatcacagggaaacacctttcttgcctatagaagatactgtatctccatcatcttgcaattttaagtgtggacatcaggcccatgctaactggaattctgaccacgtacaagtacatgaagaacttttagatattcggctcaagtcccacagtcagtccaaactttcctcacccttaaatttagccaggccctagaatgcctgcccccttcccctttccaaaccccttcaaccttgtccatcagttacagctggggcctcatacctgtatgaggcccggaacacagtacaactcagtcagtgaatgagcaagccaggctcatttctgttggatcccagcctccagatcccatcttgtagctcttctttctctacactaggttgctccccgacttaggacgcccagtttgtactcagtgtttgctcttttatggcagagcctctgcactcccagcctcctggccccttctgtacatgatttccttgtggccactccatgcatttttcttggctcaggacttagtgggcctccatgggacttggtacctctacttgttcccttctggaatctgtaactttgtgttccccaccattctttcctttatgaaccgatggtgcaacagcatgactacctgaaattcttagtcactcccagctgctttagtggagggaaaatgcccacagcacaggaaatagtcctgcccttcgagagaggccaggggatgggagcgtgtccagagaagggcgatgggttgatgaagggtggccacagcgcccgggaggaaggggccagaacgctctctgttctgttccatgaggaggattatgctggtgtgtgtagtccactggttcagagttgtccagaaatagctcagtgtaaggaacaattttccaaagatcaaaagagctgtctcaagatagcagtgcgttcccagcccctacaggtgtatacagcacaaagggagggaccccctggtgtggctgtcacagagggaagtggacgtcctgtggtttgaccccaccagatggctttagagatctgggccccagggtctgtgattcttttccccctccctcttttctctcccttatttcactgacttttttccagccagagttctagcatcttctttgtcaagcttttaatgattttccctgccacatctatccttttaaaaacaaaatggagtgtaagcggctaagctgtacctcattcccagggctctgtccatgcaggccctcacggcgtccccgaggcccctcagtccagacccatgcttatattgcatccctgatcaccgtgtgctgttttcccttttacccacttctctgtatctgcctttctctgtctctagacagggaacttcttgagagcagagactgtgtctctttgtccctgcctcccagagcgcccagccctgggaacctgctgagtggatggttgctgagtgaatcagagggaggggtagtttactctccctgaggaaaggagaagtagccaccatgcagttctgcctgggttggagttggaaaggctctgtgatggtagaagtctcgcatggccattatctgtcattgcatggtgaaagcgataaagttctctaagatgtcataactttctgtttttcctttatagcaagcaacccagtgatagcagcccagctctggtgagtgtccttgagctctagagcacagctctcctctctaaggatcgtatttatttgcaatgttgactttttccttactacagtgaaatcaggaagtgtgtcatctggtaatttttttcccctttttctgctgcctggctattccatgctcatggctttcaataagtacacaatataatgttccaagacagtttggtttttttggcaaacacagctgctttgtttgagtagctgtgtgctttgtttatgataacagtgggtgggaaaggtagaggcctgtgcgcagcacactgtgctcatggcgtggcaggcagtgctgggagaggaaggccttgctcgcgagcaaaagctggacgagagcagatgctagatttgctcagtgacgtgcaggttttacatcatagaagacattaaacacctttactgaaattcctgcaggaaaatgaacttatcacaagagtgaaaattgccagcacaggattcagcaaacattttctgtaaagggccacatagtccatgtttgagactttgcaggctctgctgtgtctttcacagctactcacctctgctgttgtagctagagagccgctgtggaaaatatgtaaatgagcgaacgtgactgcattccaataaaactttacttataaatatcagtggaccagatttggcccaaggggtatagtttttgcaggcctcttccctggcacaggtgtccagggtcttgcctgtatagtagaatgatctggtgagcataattatctgaaacatcctccgcagccacaccccaggcgcattgaatcagtctctcagggtgggacccatatagcttgtttttaaagctgcccaggtgagtctgcccggcatataccgctcttgctctctctgaaacaactgcctgtcttatgtgagttttggcttgttgagtagacaagctgtcatgtgagagaaccacagacttgcattgtttggacctttggtctgaactgcagccgctggtaggtaggccaggttcattaggctctcagtcatcccaggcgcaggtctcaaggcggctgagagggtggtctttgagatgggcacagcttgactgtgccatgcactatcagtcaggacagttggcaaaacgtggcacggggtggagcgggttgcagataccccggtgagcgaggagagccctggctgaggcatcaggaaccctccctccaggtaccagctgtgttctaacccagctctggagacttaggccttcctacttctgggcctccgttttctgttttgcaaatcaggaggttgggctagatcagtgtttttccaaactgttttaccctctgattttcaccctctagaagaaacctgatgtcaaagcccaaaatacagaacagacaaatgtggaggtcctccggatgaagccgagtggggagggagaggccagttcctgcctgctcttctgccactcctcccaccccgtagctccagggcaccttcaaggaacccagggttctagagaacacagctggtccctcatattacacagctggaaactcaacctcgcatctctgattccaaatcctactttcagcgtcattctgccttttgtctctgggttttgttctcagcatctgatgaaggggctcaggggtcctgttgaactgctctgtgtcgccccctgccccggagggtgggaggaggttgcagtattctggatgggttagttgtaggtccctagattcaccccatttttaggatccttctggcagatagtatgccaaatggtatctgtacctttcttagcttgtcggggtgtcttgcttttaattctctggggcttgtaagttacagccccaatttctttactttgctctctaaggtagtgattgttttgcttgtttctccctaataaaattacattttcctcccagcatctagtggagattatatattgggaaccaaaacaaactaaaaaaaaaaaaaaaattctgcccaaaaaaaaaagccctgataaatataccctttaggaacaaatgagctaataactgctgttcgcagctgttcaattgctcttcacagcctgtgggatcccagggtgagtaggattgctgtgggagccgtggatgaaattgtgctctgggctccagaggtactactagaaaaatagcaccttgcggaacgcttaacttacctgatgaagtccagccagaggtgatctggttcagagcctagctctgtgtactggtcctccctgaaaaccagaacacagagccatttagaccccaagcaagacttataacaatgatctgtttgcctctcagtgttggagaagccagcaataacacttgatttcaagcacacctcctggcaataatgattgcctgctctgtccatatatatacatatatatatatatatatttttttttttttttgagatggagtctcgctctgtcgcccaggctagagtgcagtggcgcagtctcggctcactgccagctctgcctcccgggttcacgccgttctcctgcctcagcctcccgagtagctgggactacaggtgcccgccaccacgcccggctaattttttgtatttttagtagagacgaggttccaccgtattagccaggatggtctcgatctcctgacctcgtgatcaaccctcctcagcctcccaaagtgctgggattacaggtgtgagctaccacgcccggcctatatatatatatttagcatttaagatctcatcagccaagcacagtggctcatgcctataatcccaacactttgggaggttgaggctggaggattgcttgagcccaggagttcaggaccagcccgggcaacatgtgagatctcatctcttaaaacaaacaaaaagattccatcgaaataggatcatgatgaggagccctgagccttttctcagtccctctaagagccaagttggtttagcagaaagaagacaggctttaggattctgcagatgttgattctagccctggctcccactgaccagccaggcgaccctgagcaggtttcccaactctctgttaggcaactgttcctttatctgtaaaacgaggtggtcacatttgttgacctcatagccttgtcgtgtggattaaataataacagatgtgaagttcccagtacagagtcttgtctggagagaacattccaaagtggtggccagattattgacagtggttttaatagcaaggggacccacatgtggctcccaccacagtacccagtgggagatgctcaggagggatcggtgcctccccctgccgtgggaagaggctctgcgcatcactggagcttctggtgccggtgctgtgaggtctcccagcaatgccagggcaggcctgaaatgggagtaaaattacttggtttgcccaactgaaacaggacctcatttttgtcaccaaaatatgacattgagactgcattctggaatatttcctactgtttctgtttgtgagctctaaaaggacaagtgaaagttgctgtctggggttttccttgttatatgttcattttaaacagccaataaccaaaaaaaagtcattatgtggaagttcctattagagtatgtagcacataggaatagttcatgattgttaaataaatcattaataatgccactctacaacctatttttctttttttttctgttttttgtttgtttgtttgtttagctctaaaacaaatccagaagtccataattaccaggtaagatactgcttttaaaggttttctttaaagaaggaaaattttaaaaataaaatttaaaaaaaggtttttgtaaagtttctaaattttccataatgagcagtcatcatatttgtaatcagattttgagaaaataataacaatatttgtttttttgagaaaatggtaagagaagagccctttccttctgacccctgccacttcttggccatctgaactgcctgtttttcttaaccttgtcaactggcaagcatcagggacatatgtttaagtttctgggtggccacacacagccccttagtggcattcaagtgaggcagcttttggtcaaagtgtgttttaggcctagggaacatgagtcccttgagatgggcttccaggaaaggatgttttggtcaaatgtttgggaaatgtcacatctttcattccccttcttggattttacagtgtccactgaggtataaaagtactgagaaatcctgcaagaaagacatgttttatttttttaaatgtattgtttccccaaattatttgcgaattgctcccctctcacgcccctgattaaaaaaaaaaaaaaaaaaactagtcttgagctggcacggtggtgtacatctgtagtgccagctatttgggggagctaaggcgagaggatcacttgagcccaggaattcaaggctgcagtgagctattatcatgaataccactgcacttcagcccagacgacacagtgggaactcatctatttaaaaagacaaacactagcctcagccccttcatatcttttttaaaaaaacgctagcctcaacccctaccattttttggtagtggtgaactcattaacacgaatagatacatggtttctagaacctgctttgtaaagcactgtgctaggtgatgtgctaggcccattgcctgcaggaaggagcacaggtacgtttctatggctggcgtcttgctgtttctcaggacggccaaccagggcctgtgccgcctgccagctcacccatgcctggtaacatggaaggtgtggtttacagctcagcctggatcaagcacattcttcctaagccactgtgggtggctctctctctggccattcacagccttgtaccacctggttccaacttctctatttatttctcaccactcccatcacgctccatatgttcaactcacagggaattgcataattgttgccccataatttcttcccaccattctttgcccgtgtttgtctgcctggaattcctttgcttcctatcagtatattaaagtatctctcaaagaccaactcagagttggccacagtggctcatgcgtgtaatcccagcacgttgggaagccaaggcaagaggatcacttgagcccaagaattcaagaccggtctgggcaacatagtgagaccccatctctatttttaaataatcctgggttcaagtgattctcttgcctcagcctcccaagtatctggggttataggtgtatgccaccacgcccggctaatttttacatttttaatagagacaaagtttcaccatgttggccacgctggtctcaaactcctgacctcaagtgatctgctcgcctcagcctcccaaagtgctgggtttacaggtgtgagccaccgtgcccggccagggttcttgaatcttgttattcactgattgttttttgttaaggggttttcaggtgtgagtaactgaaaagttgtagagacaggtaattgataggtgatcagtgcttgaaggagagaaaaattttagaaaagcaaagcagctgagcactgcctgtgccctctccgcatagcctgtagtgtgttctcactgtgcgttttctgcttagagtgaacatgaggcgattgttgaaatcagatctactgaaactcatctaggcattgttatcgcaacatcattggcaaccacgggtcctttggaccttgccaatcttagaggtcttgtgttctatcaagggttgggaataaattgaccgggaagagaacgtcctgagaagtggcctgattggcatgtgaataccgtgaagggtatttgagaggatggtgttgcagcatttatcttatttcaagcactgcaaggtcagccagctgcaaaggatggatctctgtgttctcaatgaggacgctgttggcatttggggagggagagttcttcattgtttgggactgtccctggaattgcaggatgattagcttcccttttctctcttactatgacaagcaaacatgcacacagtcatttcccattgtcctccaagggatatgagtgtaccagttgagaaccagctgggttaacactaaaatactccttgacagttgagaatgtgaataaattgccagaggagaccaaggaagtttccaaaatctttttccaggtctgtggctaaggttcccacctctctctctgatgaatctgatttggttgtgtttaaagccagaggaaaacatagagggtccagttctaggtcagcctttctctattgttgaacagccaatgaatggaacctcattctgggcctgtctatgtgatcaaaacacctggaacagttagactctgggcaaatcatctaaactctgtgggtttctgtagcccctaaaggagaaatatgcagagattgcagcagggagatgctaaagccctggtcagctcccagatcctgctactgaggtattttctccagattccttttcctgcagcatgtccttccgggggctgcagagtctgcttgctgacaggcgtctttgaaggagaaaggaaaggctgcttgaatacagaacaggcagggagggcatctcaggtccatgaaaatggaacgaacagaactgctgagattctctgtgccagagagcaggccactgcttactaagcaaagtatcctgagaaggaggggaagaaataattaaaagagtaacagtggcaagactgtagtgacttaaatgtcaggagggcctaatttgccccttaggagattgagccttgagaagcccctgacttctgctgatgtctaggaccactgccctctgcaggccagaagtggaaaggcaggctgctacctagccggctagggctgcacctcagtccgtttgtgagtacagggtctgtgttctcttcttaaaatggacaacttccttcaaaattagcggggtgtggtggcacgtgcctgtaatcccagctacccaggagactgaggcaggagaatcgcttgaacccaggaggtagaggttgccaagatactgccattgcactccagcctgggtgacagagtgagactctgtaaaaaaaaaaaaaaaaaaaaaaaaaaaaaaaagacaaccttcaacctccttccttctcttctttctctttcttccttcccttcccttctttttctttcttctctctttccctacctgccttccttccctccctcccctcatcccttcttctcaaactctctccctccctcctgttttatcaggatgataagcgctctggatggttttgtttgttttggtattttgttttggattgcattttagaagattatttttattgcataaaccagagagaaagaaaaaaccttcacccacggccctgctgcttcacttagcatccctgtccagtccttgtctgtgtgcagatgtaactgttccacatggtcattgtcattttcagcaatgacaaaaattgtttctgaagagagaagttgcctcccactctccccatctctctgacaccttccgcctcttcccttgggaagatgaatacagcttgtctctggtactccggacgacccccttcaaggccggtgttgtcaccttctaagggcagcttcccagccccttcacagggagccgcctctggagagggcaagaaccggcactgggtgccagcccccagcctttgtcagagggggaaacgtgatcgtcctgggaaacatccaccccctagccagggtctatagcctttccattcttagtcccccagcccctcgggtggatgccaggaacagacaaagcgaatgaggaccattgaaattaaaaggtcatcaaataatcaagtttggtgttttatttctagcctcaatatcatcctaatatccatcccagccagccccggtggcatcctcactctccaaatgtcaggtaagtgctggtgcttccagagctgcaccttcgaaagctttcctttctctagaaaagttcagattctgcttagttaggagtagaaagtctgcatcagaaataacccttaagggatgcattgtcatggccgagatgaataaattttcaaagcaaaggtagccagtgatgtgtgtggatgtatcaaaggtatgctttgtgaaataaaaaatgaattgattttttaaaatcattctgatctcatatattcttggtttttagttttgtgttcaagatgttactgaaaatttctaagtaacatttttctgtcctgagaatttgtttactttaaatgtgatgaaagcttggggattttgttgtcatggggtttttttttttttaaggattttttttttttttttttttttgcgggggtgggctgggggaatgagtttgctttttgtggcaatagatattttttccctaaactgaggggtcaataaactttttctgtaaaggatcagacagtcaatatattctgctttgtggtcgctgtcacaactccttaactctgccattgtactttgaaaacagccctagacaatccataaatgagaggctatggctgtgcttcaatgaaactgatttagaaaaacagtgggattgggccgagggctgccatttaccaaccttggccccaacctaccataatcctttctaagccaactggcatctgctggactgtgtttatagttaggcttgacaggttttttgtttttttttttttttttttaaggctagctttgtgaaagcaaatgttccttttaagatttgaattttagatcagtcttaattggtgtttatgtgtgaagctatttcagaaacatagttggcaagttcagtttgcataaaggtgaggttgctagcctttctctgagaaagtatggagaataaaatgctggaaataaacccacttagagcaaggccaaaaaaaagtttgttggggaattttgtaaccccaaagcgtgattgtttataaacacttggtagtcacttaactttttaaagcagattaggttagtggagtaataattctaaatcttactgtatttcaaaggtgctttattcttcagacgtaagaaacagaagagatttctagaaacgctattttaattaacattgtttttacaaaagtttgtgcttatcattgcctgttttatcatgttagtttccttctgaggcatggcctagaagcaggccttctgaggaaagccgtaaacagtgcctctctggggtgggcctgctgttggcagctttagtgtcatctggaagcttgtttaatgcaaattctcagccccaccccagacctactggatcagaatctatggggtggggcccaacattttgtgtattttcaagctctacaaagataccccatgaaaacagagtttgttagtccaacacttttggcaaatgctgcctgaggcattcatggtgcatgctggcatgcctccaagcagccctgtagtaatggaacattttccaccttcacttagctttctccagacggacttgacccatgagacaccctttgagaaatgatgacttgaccatagacagacccttgctctgcttggaagttcataggtgatctgcatctgaatttttaaaattcttactaggaaatccattcatttccattcatagccatccccattcacatggctcatggttccccctgccccatttcctttgtgcttgtgttgtttcacttacatttctgcattttcttccattctcccactaaccattcgctctgcaaacaaaacaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaagtaacttgagtggtttcagttgtctgcaaccaagaagcctcaccagtatgcatacttatgatatcctgattgttaaatgaagtgtacacttttcattccttaacttagtggacctttctctacagcagttgaccagttcagtcttaacagcctccttttctgccatcctattacctgttggtgttttctaaaggtctttcttctgctcactgctcttttcaccacagtctacccaagtcttctcattctgtcatgattttatcatgctgttgactctgaaaccatcctctgtaacccagactgtcctgtgaacttttggactgacatttcaacttgggtatcctgtgtacacgtcaaactccacctatcaaaaatcaaatcgatcatcttttaccctcctcccacaaaacttttcttctgcctgaattcccttttttacccacagtaagaatgtatacatcatctacaactcttctccctgtcgccacccatatccaaacagtacctaggtctgttcacctctgccttggtattcatacttgggctttcttctctcttcttactggcatggatcccataggagcatcttttctctggctcagaggtgcccttcctgatctccctgactccagttgctcctgacaagctcatgctcctcccagtcactagagtgatctttctaaaacacagtcggcctgtgccattgcagtgcttgccattaccctgaggatgaagtccaagggcctctcagtggaattccccactccgtgtctccatcctcttgctctagcatatatccaccatttctcaccctactgttgaaaatccttcaatgccaaattgcttgtggttcctggcatgtgccacaccctgctgttactcacatctgtgcctttgcaaatactgttctttctgcctagaattctgtcactcccatcccttcccctaactccctgctcaatgtctgcctctgcccagacatcttctcccagggactcttgacggccccacctctgcaaattgggttaatttctgtgttccagtaataaccccctccctttctacccccatctatagcaacgttgcacttacagctttgtattaaaatgggctcttttgtttatctcatcctgaaacctgtacactgcatcaatctgagctttgtgtcttacttgcctttgttccccagcacctgacagatagcaggtgctcagtgaatgtctgctcagcaaatggattattccacattcatttgaaaggagatgtctaaccagataacaggcaataatacatcatctctgggctggtctgaaggtatctgaacaaccttatccagtatgggggcatcatactgtgagtaggacactgaccaccatgtgacttctagattcagtttcatcatctgaatattactcagtgtgtcagctgtgttctcgtttgaggcattggtatcatgctgtacagggcagaagaaagtccagccacgtgacattggaaaccccggtaggtagacattgatctgcgctaatatataggggctagtcatctaatgctaggctttgcatgtgtcacttcatttcctgaccactctgtgagatgggtagtatcctgtttttcatagatagggaagctcaggcttagagtttaaccaagcagcctgtattccagagcctatggtctcaaccacagtggtctcttgcctctcacccttcatcccaccatttgcaaccgtggggatccatatctccatgagactgctagatgatgttgaacagttcactccactgaaatctaattgctaaccagagagccatccactccctccagccatctagtaacccctgtccatctgcattaccaccacaccagtaggtagctaactgtccatacagcccccaccagtgtggcctggtaaccatgttccctccaccatcaccactaccagtcataactgtccatatctcccactcacacacaccagggctggtaaccttgttcatctccatcacctgtgatctaataacgctgtttactgtcttctccccaaacacaccccctccagtggtctagtaaccctctccacaccttaccacccctcccccagtctaaaaatcctgtccccacaggcatcattcagcagtagtcccgcagagattggacattattcttaatgaaccactgcttatttgagacggtccactctatggcttccttccaaagagttcacaaatgaacaatgtcttctggaatattacttgacagtaaaaccacactcactattccataactaatggaattaacttttacattttggaactcgggtatgtactggtttatcatctattcatgtttctgtggtccctcagaacatccaacagtgtattgacagttgtcatttgattgatgtaattcatgccagaagtctctaaatcctgccaggtaattaattaccttggtcttcaaaacccttttgcctatttcgtttattggtctaccatttctgttgaagatggttctccttaaccacaaagatggaggaataaggacagtgtggtaattcctctcagtccttcttgcctgttaatattgcaccatccttccaggtcagcgactccagcctcctgggtcccgctctgaacacaagtaatgacagagtctttttgttgcccttgactttacagcttttaactagtcctttaaaatctgagctcattaaagaactccctgaacagccatattgatcccttcggatcagtatttcccaaacttaagagttgtaaatcaattccctggctgaccaagtcttccaaacgtaccaggaaaataccctacattggtctaggatgatttgcttccactctcttgctacaggaggcggtggacagatgcagaggcgaagcataagggggcggagagaaaaagcaagtcactgttaaaggtcccttgcacatgagaaatggcacattgtaagaaaccctggggatatcaaaaagacaaacatgtaaaatggacattcagctaagccttagcaaaagaaatcctcaatagttctgcaaataggcccacttctgccaaaattagggagctaaagaatggcttggacaacttactaaaaatgtggattgtggcattctaaatggtcagtggtaagacccaagatcctgcattttagcagcccaggacagcctgaggtgggcagtccaggtttgcttttcacttttggaaagcaaagctacttatctgcttgtgttcatcgttattttaatgcctcaattttaactctcagtagaggtcaactcttttttttttttttaaataggcataatgttaagtcaatggatggacacatcataataagtaactagatctgtctgctcagcaaagctatgcacttccttaggcccaaggtgaagcagaaaaatgcgagcattctagtggttctttatatggctttaatttcatcattaactggccccctgcaatctatcaaaccaagtgtgtgttctgccctcccttcccacttcagaagcaagggactagggaattccagctgttggagaaggactgggcgtgtgtatacaccagtctaagcacctgggctaagactggagcccatgattgggaaacagatggaagtttgcagaagtaaaatggcaagacattgccagccagatgagagaaggattaaagggtccacagtgtggtggtctggttttgtcaagggacaagagccccatagttctctgattaggtgaagtgtggaagctttggaatctcacacgatttgaatcccagctttgccacttactagccatgggacctttggccaatttcttctggacacctcattttcctcatccccagatggaatttaccagtatctcactgataagagaattatcaataaatgacattatatacaaaagatgttttgcgcagtgtttgatgctagatggtaagaatttttagtggttcgtaaggtcgtagctgtccatgtggacagaaacaggccaaagagattcaaaatagctcaaggccgggcgtggtgaatcatacctgtaatcccagcattttgggaggccaaggcaggtggatcattcaaggtcaggagttcgtgaccagcctggccaacatggtgaaaccctgtctccactaaaaatgcaaaaactagccgggcgtggtggtgtgtgcctgtgtagtcccagctacttgggagactgaggcagaagaatggcttgaaccagggaggcagaggttgcagtgagccaagatcacgccattgcactccagcctgggtgacagtgtgagactctatctaaaaaaaaaaaaaaaaaaaaaaaagtctagctgaagaaatggtatttctaatagattgatggtttgagatgtatattctaagtttacaaagggaaaggggtgtttggttccaaaggacagatcagatgtaagagcattaacacatatataaagacatgtctctttgaaactaacaaactcagagcagaaacaccatggggatcttttgaggaaagaaaaaagaaatagaaatgatatttctgtccgagaatactaggaaataactgtccaggcagaatgtggacaatgctttcccatctgcacatggcagaattggcatagagtaaagaattggtgagatggctgagagtccattctgctgctacgattgggactcagaggcttggagaattgaaacagagcgtctgctccattcccaccttgtctaatttgggatttcatcttagacgaattggaggaagattttaactatcaggagactgagtggaaagttagtaacaaaagggaaccactgtgctttgttgccattttgttgttgtttttgtttgtttgtttttgagacacggtctgtctctgtcacccaggctggagtgcagtggtgcaatcatggcccactgcagcctccacctccggggctcaagtgatcctctcacttcagcctcctgagtagctggcatgcaccaccatgctttgctaaatttttaaaaaatttttgtagagatggggtcttgccatgttgcacaggctggtgtgaactcctgggctcaagcgatcctcttgccttggcctccccaaatactgggtttacaggggagagctactgcacctggcctgttgccttttttaagatagataatacaaacaatagtaaaaattcaaatacaaatagccaaaagttacttttcctttccaccttcttattccccagttttccttggaagcaaacattgttagcatttttccttgtcaatctagagctactccatgtataaatgagcatatatttaaccaatcaatattgatggacatttaagctgcatcaactccctcaagttacagtggtgctgccattcttgtaccttgtgtttgtgcacttgaacaaatctatctgtagaataaattccctcgaagtagcatccaggttaaaaggtatgtgcatatttaagttggatattgtctaatgaaatttctctccaaatatattccacctgtttatactccccccagctcacagacacccccagcaattatgacaatgcctttgtgacctcacaggaagcaaatcatagcctttgctagctttttttttttttttaacttagtctgatgggtaaaatccagaatttctgttttaattacattctctgtgaacaaggctatgcaccttttaatctttctaaagacggtttgttatatgttttctgtgaaccatctgaaacccctattcttgagtcatgctccttaataaagatcaggctgatgaagtacaattaaccatgtcatcttagcatttataatagtgaggaaagggaaggcttgaatgagttgatatttaccagacatttttttaaaagtaggtttccaggctaagcgtggtggctcatgcctgtaatcgtagcactttgggaggccgaggttggtggatcgcctgaggtcaggagttcaagactagcctagccagcatggcaaaaccccatctctgctaaaaatacaaacaattagctggacctggtggcgcatgcctgtaaccccagctactcaggagtctgagacaggagaatcgcttgaacccgggaggcggaggctgcagtgagccaaaatcacaccactgcactccagcctgggtgacagagcgagactccatctcaaaaaaaaaaaaaaaaaaagtaggttcccagaaattcaggtaacagtcagcatgatactgccctgcagaactgaaaaagggaatgtgggcaacataaagatagcaaagggaaaggaattgattttgaatatctgtgtttcctttcctgtttgggagggtattgataactttccactcaggcttcttagatacccacccagacatcatgaatttccctggtgcattgaccaaggaaggatggatgtacttctagttacaattaaagtttcaatatattggaactgaaattacagccacatcccaagagtcacctgtggttttattggatgaaaggctgcagaatttaaaatattaaaactgctgtagtctaggccatccactaaaaaaggattagaataattagaggaacatccctgtaggctcatgttataagaaacccacagaaacctcctaatcgtcccctactgaatggtgaatggtttaaacatccacattctgcactgagacctcaaaagcaagaggtgttgctatgctaatgctcaaccagcttcattccctggctgaataatggacactgtctgtattaaaggcaattaaaccattaagcccttaaaattcatatcagtgttacagcttcggaggccaactaaggatgttcataatagaagcttctgaaaaacctgcaagaattggggaacagagagaggatcatttgcggaaatttttaagcactaatgaataccaaaataaattaatcctcatctgtatcaccctagaaacacgtacccagtgttcagctccaactctgactcacattggtgtcttgtgcaattagaatgtctaaaacctactcttaacagattatgcatcttattcatctaacctgaactacattccgggatgaataatgttttaatttcattcattcagtgagccggatggcgtctggggagtggaaaaataacacttcccagctcatgcctgagtctgccgtagctctgtcagagtgcacaggatgacaaagaatctgctttgtggacattattttacactcacagctgagctttcgtgacaatgattatttttgtcttactgtccctttggggtctctcatataacactgtttgaggatgtatttaaacaagtggttaggggaaagtctgttaatgctgttgccacctgaaaaaacagaataaaggcacaggaacacagaaatgagacgcaccaaaaaaaaaaatctgtaagaaacccagaagtgaccgggcacagtggctcatgcttgtaataccaaaactttgggaggccaaggtgggcagatcatttgaggccaggagtttgagaccagcctggccagcatagtgaaactccgtctctactaaaaatacaaaaattagccaggtgtggtggcacacatctgtaatcccagctactcgggggtctgaggcaggagaatcatttgaacctgggaggcagaggttgcagtgagcggagattgcaccactgcactccagcctgggcaacagagcgatattccatcaaaaaaaaaaagaaacccagaatggaaagtctagcttattagaagtgactgttgtaaggcaaaacaactatatttgtatttttttttctttaggcaagaaaaagattgaataaacttggtcatgagcctctgagcaaaaatcaactcatgaaatagtaattctctggactgcacacacatgcacacctgtgaaggcacacacacaatgaggaagccattgcaaaacctagcaagaatagcattgcaacacaacagcctttctggcagaaaaatgtcgggacctgcttacacctatttattgaaatcatttgatagttgtttgccaaaagaaaattccagactcagagatggaagcacatatcctgtcctacctcacacaggactcagacccaggaactactgaaccccaaaggctcttgtcagtccttaggatgtgggatgttaatctgcagttttgcagagactacataatgtagttaggaacaagtagggaattcatgtcaaaagtgcaacttttatgaatagatatttgataaattacctaaggagaattaaaatttaaatgcactaaaactaattaattgaataaagttctgctatgtttctgtgcagtgctggtatgttgaagaagatgccatctttggctccaggtaactaatcatcatcagatcaagagctccccatctagcatggattcatacatcaactgtgctagcatcagaattgcttgcaaagttgattggaacatttcttgaaagaaatacaaattggaaaagttttgggccaattagtctctataaaggaatctaaactacacccaaaaatgcagttttgacctttttttttttttttttgagatggagtttcactcgtcacccaggctggagtgcaatggcacaatcttggctcactgcaacctccacctcccagattcaagcatttctcccacttcattctcctgggtagctgggactacaggcgtgcaccactatgcccagctaattttgtatttttagtagtgttgagttttcatcctgattgttggccaggctggtctcgaactcctgacctcagatgatctgcctacattggcctcccagtgttgggattacaggcgtgagccaccacttgtggccaattttgaccttttctgaaaagaaagatgaagtagagtcaaccttctcactagtcttttttttagatataagaccactaagttgctataagaaatcatccctaattaatagatacaacattcataatgtatgacacttctaagatgtcgatacaattttcttcgaaaatccattatgaaaaaggtacagtgtttcaaatatagactctacttgttgccaaatagtatgctttccctgaattcaataagaacatgtaacaatgtatcagtctgtttagtctctaccaaattaaaattgaaataagcgacagctatctgggaaaccagaatgagtaaattgtactttctctcatctctcagtcggacatggcacagatcaaattatatcattgagctgtagttcctggcatacgaatgcttaatgtccaaaaatgcaatgtctgccacccagataagtgagttacctaaggtcacgtaggcaaacagcagcaaagccaagctaagtaccaatgcatgttccttttttgtcattagattgctccttccaaacacatggcaaagcagtattgcctagcaattcagagagcccaggttacctgggttcaaatcccagctctgccatttactagctacatgacttgaggaaagctccttggtctttctgctcctctttccttatgtataaaatgaagataataataattgtcctttcttca

SEQ ID NO: 1343 - DNA, 3202 bp, Homo sapiens
cctctgcactcccagcctcctggccccttctgtacatgatttccttgtggccactccatgcatttttcttggctcaggacttagtgggcctccatgggacttggtacctctacttgttcccttctggaatctgtaactttgtgttccccaccattctttcctttatgaaccgatggtgcaacagcatgactacctgaaattcttagtcactcccagctgctttagtggagggaaaatgcccacagcacaggaaatagtcctgcccttcgagagaggccaggggatgggagcgtgtccagagaagggcgatgggttgatgaagggtggccacagcgcccgggaggaaggggccagaacgctctctgttctgttccatgaggaggattatgctggtgtgtgtagtccactggttcagagttgtccagaaatagctcagtgtaaggaacaattttccaaagatcaaaagagctgtctcaagatagcagtgcgttcccagcccctacaggtgtatacagcacaaagggagggaccccctggtgtggctgtcacagagggaagtggacgtcctgtggtttgaccccaccagatggctttagagatctgggccccagggtctgtgattcttttccccctccctcttttctctcccttatttcactgacttttttccagccagagttctagcatcttctttgtcaagcttttaatgattttccctgccacatctatccttttaaaaacaaaatggagtgtaagcggctaagctgtacctcattcccagggctctgtccatgcaggccctcacggcgtccccgaggcccctcagtccagacccatgcttatattgcatccctgatcaccgtgtgctgttttcccttttacccacttctctgtatctgcctttctctgtctctagacagggaacttcttgagagcagagactgtgtctctttgtccctgcctcccagagcgcccagccctgggaacctgctgagtggatggttgctgagtgaatcagagggaggggtagtttactctccctgaggaaaggagaagtagccaccatgcagttctgcctgggttggagttggaaaggctctgtgatggtagaagtctcgcatggccattatctgtcattgcatggtgaaagcgataaagttctctaagatgtcataactttctgtttttcctttatagcaagcaacccagtgatagcagcccagctctggtgagtgtccttgagctctagagcacagctctcctctctaaggatcgtatttatttgcaatgttgactttttccttactacagtgaaatcaggaagtgtgtcatctggtaatttttttcccctttttctgctgcctggctattccatgctcatggctttcaataagtacacaatataatgttccaagacagtttggtttttttggcaaacacagctgctttgtttgagtagctgtgtgctttgtttatgataacagtgggtgggaaaggtagaggcctgtgcgcagcacactgtgctcatggcgtggcaggcagtgctgggagaggaaggccttgctcgcgagcaaaagctggacgagagcagatgctagatttgctcagtgacgtgcaggttttacatcatagaagacattaaacacctttactgaaattcctgcaggaaaatgaacttatcacaagagtgaaaattgccagcacaggattcagcaaacattttctgtaaagggccacatagtccatgtttgagactttgcaggctctgctgtgtctttcacagctactcacctctgctgttgtagctagagagccgctgtggaaaatatgtaaatgagcgaacgtgactgcattccaataaaactttacttataaatatcagtggaccagatttggcccaaggggtatagtttttgcaggcctcttccctggcacaggtgtccagggtcttgcctgtatagtagaatgatctggtgagcataattatctgaaacatcctccgcagccacaccccaggcgcattgaatcagtctctcagggtgggacccatatagcttgtttttaaagctgcccaggtgagtctgcccggcatataccgctcttgctctctctgaaacaactgcctgtcttatgtgagttttggcttgttgagtagacaagctgtcatgtgagagaaccacagacttgcattgtttggacctttggtctgaactgcagccgctggtaggtaggccaggttcattaggctctcagtcatcccaggcgcaggtctcaaggcggctgagagggtggtctttgagatgggcacagcttgactgtgccatgcactatcagtcaggacagttggcaaaacgtggcacggggtggagcgggttgcagataccccggtgagcgaggagagccctggctgaggcatcaggaaccctccctccaggtaccagctgtgttctaacccagctctggagacttaggccttcctacttctgggcctccgttttctgttttgcaaatcaggaggttgggctagatcagtgtttttccaaactgttttaccctctgattttcaccctctagaagaaacctgatgtcaaagcccaaaatacagaacagacaaatgtggaggtcctccggatgaagccgagtggggagggagaggccagttcctgcctgctcttctgccactcctcccaccccgtagctccagggcaccttcaaggaacccagggttctagagaacacagctggtccctcatattacacagctggaaactcaacctcgcatctctgattccaaatcctactttcagcgtcattctgccttttgtctctgggttttgttctcagcatctgatgaaggggctcaggggtcctgttgaactgctctgtgtcgccccctgccccggagggtgggaggaggttgcagtattctggatgggttagttgtaggtccctagattcaccccatttttaggatccttctggcagatagtatgccaaatggtatctgtacctttcttagcttgtcggggtgtcttgcttttaattctctggggcttgtaagttacagccccaatttctttactttgctctctaaggtagtgattgttttgcttgtttctccctaataaaattacattttcctcccagcatctagtggagattatatattgggaaccaaaacaaactaaaaaaaaaaaaaaaa

SEQ ID NO: 1344 - protein, 146 aa, Homo sapiens
LCVPHHSFLYEPMVQQHDYLKFLVTPSCFSGGKMPTAQEIVLPFERGQGMGACPEKGDGLMKGGHSAREEGARTLSVLFHEEDYAGVCSPLVQSCPEIAQCKEQFSKDQKSCLKIAVRSQPLQVYTAQREGPPGVAVTEGSGRPVV

SEQ ID NO: 1345 - DNA, 110218 bp, Mus musculus
  misc_feature (1)...(110218): n = A,T,C or G
tgagccctggcaatcttacaaaggtctttgtggagatggtcaccagaagcttgcattcctcatactgtggtgtagtcactgaagacaagtcctttaggattcatcccaggaagctgagtagcttggaaactgaatttcgaggaagctaaaggctcagcgctcaactggctctgcttgggaactgaaatgtgtggaaggggaaggctcagtgcttgactgacttggcttttgtacagttccacccttgttttctgtttagtcctttctcataaaaagtttgtgcaaaagttacattatgagatactgaagcatcccttaagcagtcagtaatgggaagatcagtggtgcggtcgggtttggtggtccttctttgcaagggtgtgaaccacattgggttttttgacatacacttttgcaggccagacttgtgggggcagattgtgttgccaggttgctgctcccctgtgtgtctggtgtgcctgcatcttgtaatagctcacacggttaagcaaaacctgtggttagtgtcttcagtgctcaaaatgttcaggcaaaattcacatagcacgattcttgttccagccctttaaagcattaacttactggcattgctgtgtgtgtattatggcatgctgacgtgtcacgtagcaagtacagaatttcactcctctcccctcaacaggattctgttgtatggagcaggttttagtctcttcatttgttggtggtcccttggttgtgttttacgtattattataatactgctttaaacattcatatataagcttttgtttcaaattatgttttcacttttcctgggtatatgtctaagagtggaatttatgagtcatatggttattttataagaaagtatgtgtgtgtgtatgtgtatgcatatatatatggagagagagagagagagagagagagagagagaaagagagagagagagagtgagagtgtttgtgtgtgtgtcaatcaggcagaatcgggtccaaatagtagcccctttcctatcaagctgtgatttggagcaaattatttaatcatctttcttcacctaatgtctatgagcagtgaattcctgtctctagataataaggactcaggagacataagaaagccttttatcaggacagtttagtgtgtggggtagtcattgtgttcattattttatagtgacagggcctcctgagcctaagtggtattggccgtacagacaacagtgtgtacttttgtcacacccaagagaagccagagattagcagctctgaggaaatcttaactttggtgtttcatagcacttggcatggatgattttccttttattttaagaagtatctgtcagagaaacgacttttaaaaaccttgcttgtttaatgcttgaacttttatgtgggaactacagtttgctagtgactggcctgaactctgagcatgaggatatgacagacttctccctgaataagtaactagttaaaaattacttgggaggcaggggcaggtggatttctgtgagttcaagtctggcctgcaaagcgagtttaggacagccagggctctgttacacagagaaaccctgtctcaaaaaacaaaaaaaccccacgtttccattaaattaaatttgtataaaaagcaaggtgtctcatgactagaccatgattatcattgttagtatttgacagatgctttacttacttatttattattatatgtgagtaccctgtagctgtcttcagacaccagaggagggagtcagatctcattacagatggttgtgagcgatcatgtggttgctggaatttgaacgagtgacctctggaagaacagccagtgctcctaactgctgagccatctctccagcccttgatagatgctttacaaaacacctacttatgtactactttttaaaagttttgtatgattctatatgccactaatactgtttttggaacatctttctattaggtagtatttttatactacttatttcttagtgtcaaatgatattctatcttacatgtagatcatcatttaatattcccattttccttttgggcatttacaggtaccgttttcacagtaatataggcaatgccaggagagcatcttcatgacagataaagtctgtgcatatccatggtaattattgctgtggcctgaatcctgtgtgtgtgtgtgtgtgtgtgtgtgtgtgagtgtgtgtgtgtgtgtgtgagagagagagagagagagagagaaaggagagagaatatgagaaagtgtgtgtatgtgagagagagagaatgtgagagagaaagtgtgtgtatgtgagagagagaatgtgagaaagtgtgtgtgtgagtgcatgtgtgtgtgtgagagagagaggaatgtgagaaagtgtgtgtgagtgtgtgtgtgtgtgtgagagagagagagagggagagagagagagagagagagagagaaagaggagagagaatgtgagagagaaagtgtgtgtatgtgagagagaggagagaatgtgagaaagtgtgtgtgagtgcatgtgtgtgtatgtgagagagaggagagaatgtgagaaagtgtgtgtgagtgcatgtgtgtgtgtgtgtgagagagaggagagaatgtgagaaagtgtgtgtgagtgtgtgtgagtgtgtgtgtgtgtgtgtgtgtgtgagagagagagagagagagggagagagagagaatatgaatgagaatgcgtttgagctttctaccatagtgacaggtgcctgggaagaacaatttcagagaggaaagatttgcttcagatcatggctttagaaatgctctcctgtagggctgtgtgaggcagggtaccgtggtggtgagggtgtatgatggagagggttgcttcatgggtgggtggaagaatggagagagaggctgtgttggttgccacagagggtggaggggaaggggaagaagaagggaaggggaagagggagagaagagatggaggaggacacttggagaagcacagttctacagcaggccatttgcctctgagttaacccagtgatgtttagtcccagtgccatccaggcactgaccacaccatgctgctctcagaccaggcttttagtagcctttgggggtggtttcacattaacacacagttacacgtcttagttttgatcatttcagcatgtagtaagtgtgcaccacactgttctgctgtctccattcgaagttgcatgtgcttgttatggacaaggcaccgctgtgattcgttagtgcttatttatttatttaatgttttatttgacactactagtgttctgcctgcttgtatgctatgtgtgagggcatcagatcccctggaactggagttatagatagctgcgaactgccatgtgggtgctgggaattgaaccccgggcctttggaggagcagccagtgctcttaaccaccgaggcatctctctagcccctgttagtgcttctcgtgaccgtctatgtgtctttctcgtaaccgacagcaggactgtggtgctgcatggcagtgaaatgtaggatgtggtcgtggtaggatcagattgccggggtttgacttgtaattccgctggttggttgcttgctaggctgctgtgagattcttcttgtgcatcttctctgtatgctcaacctcagagctcactcagtcttcctggagtgccacgtggtgtaagcttctgattatgcttgcttcttcatttctccagtaaggctctttccaccccaccgacacctcagtcgtctagactcttggtacaaatgtaactctaccaggtgcatttgccaggcttctcacaaagtccttgctgatctgtcacatttgctgggagccaaccggataaaaaaagttgctagttctttgagagttttgtacaatacattttggtcaaaatcacctctcaacttttcccagaccttttctttgcccacctagctctgtgaccttttacaaacaccaaaaccctcaagataatttgtgctgccaaaatattcttggatatatggttttctcctagagtgtgatcagtgtacttggggctgtattcccagagaaaatgctcttctctccacagctcacagttgtcagcagctttgctgttaggggtgggactgtgtgctctatactcctgagagcaggtccttggggcttgctgagttcatgcagacagcggggatggggggagtgggggggttgggtgtgtgtgtgtgctttcccagtcaccgtcaccacctctgctttcacactctttccgcccccctcttcctcagtgatctctgagccttggtgggtggagggtatacatttttgggctgaatagtctataatcttttactctctgaagcttggctagttgtaggtctgtgttaattactttctattgctaatagaagcttctctgagcgatccattggactgaacagggtgtgccaaaagtggttcaggaacttgatgatgctatcttgtgtgcccccctgccccaccctccaggcccttcactttggtgctgtgcacatcccaaagctaactgcctgccagctttgtcacatcttccctgtcctgagtgcccaagctcaggcccttgttgttatgcaaagtcacttacttcttctgtgtagtgctcaccttgagggttattttgagagttagactgtgattcgtttatttaccatcaacggtactgaataccaggtgttgtttgaactgtggggatagaataaggaacagacagagaaaccttctgccatcatagagtctgtccgatgatggagacgggttaaacgagcactgtgaaactagcacagcagagtgaagccctgagggaggtgtgtgcagtgggccctggtcgtgagcagaccgttctggagaggtggggagaggtgcccaaggccctggtacaggaaggagtgagtgccaggagcaaggcaataagagtaaacagggctagcgtgtgtgttagtgctagaggcaatgtagagccgaaggggggggggggggcttgtgttttccttaacataccgtattttatttaaattttatttttgaaattgtaattatacaaattccccccttctttcccctctccagattctcccacatgatgtcccagactcatggccttctttgcttgttattccgtgttagtgagactcatcacagtttgatgtcttttatcccgttcatgtggtagattacattgattagtttatatcccacttgccctggataaaattgaaatggttatataaaaaataagtcatttagtgtttggtttgtttgagtggtgggcggttgtttgggagtgtgcattccatgggggtcagactactacctgtcatgtcccactcgaccggcaagaaagacacaaccatggcaagctttattgcttcttcaggatggaagaccccgaccctggaaaatggcgttgcttatatagccctcagccatggcgtttcagcacctgatgtggcgtgtcagctcctgattcgttgctcgcccatcaccccattactatgccccgagatgggcagtgactaggtgtgagttcactctcgcacctgcgtacaaggcttgtttactagttaggcacagcggaggccagcaccatcttataatggcgattgcttgcggcacggctctccacaactaccttgtagagttggcttcccctttgtcttcactcatgtcttgaggataattggtcaagcttatgtgtcaagattttttttttttaatttcttgctagccttcagtagtaattttgtttacttctgattctttaaaacaatttgttttctgtgtatatttgttttgcctgcaggtatgtatactgtaggagtcacacagactggagttacagatggctgtgagccgcttacaggggtgctgggaatcaaatctgggttctctagaaatcagccagtgttcttaaccacagagtcacctcaccagcttctcttctctctctttttaaaatttatttaattcatttatgtgagtatactgttgctgtcttcagacacaccagaagagggcatcagaccccattacagacagttgtgagccaccatgtggttgctgggaattgaactcaggacctctgtaagagcagccagtgctcttaattgccgagccatctctccagccctaccagctcctgttttaatgtttaatttcactgtgtagcctcattcatgtcacatgagcctcattcaggtgcacatgtccgtagtatgaggctcatccacagttttatgtaaaaacttctaggactctttttttttttttatctccaggactgtaaccatgtcattaagcaactccctagtgccaactgcttttgtgagccagcattttactttcttattttatgaatttcaccattctagatgcctcttatgaagagaaccatgggatacttgccttcttatcacagtcttatttcacttggctcagtgtccttgggttcacccacagtgtagcactcagaattctctcccctttcacggctctatgtggctgtgaaacggtatgcagcagtcatcaatggacagttgggtgcgtacttgagtacccgttctccatcagagcccatgcatctgactaaggcccatcggctggctgcctttgggaatccccggctgctgcagccacaagcaagccagactcagctgctgccaccaagagtctgtgctctactgcaactgaggtgggaactaacaaagaaacacatttcttttaaaactgaatttgtgacatcttaggatttcttacagtccacttcagtcacagagctggtgaacctaagctcacttttgtcaagacaagtaggatggattgttgtagggtagcttcaaaatcaagggaggcctggcagcccccttccttcctcggctccatggctgactgtcagtgtttcttacctggatcatctgaacagccttctgcgtggactcctcttctattttcgtcttcccgtaatctcagtgtggggactcagatggtgatgtgacttggatgcactatccttccacctaacacccttggccccaccccagacgccctgccactctcagggaaggctggaagcctcctcaagcctccgggttctgctcactgcttcccactaccttggccttatagtctgtgctttcagtgtggctggttctcttgcctgttgtatgtggttctgtttaaagcatgagtatttttattttcctttggtagattttcttctccaaatatctgcatggattacttgctaaggtctctgtgcagatcttaccactgagaaaggttttccctggctgcccatatagaatgacacctacctcttccactagaagtctctccccattaagtactaaggctgaggaccaggggcctgattcataagaacaagccttgcttcccagtgccactgaggatcaactgggggtgggagtgtccatcctccactgtctttagctagatcgtctgttagatcgagtggccaccatcttgagctctggtagaggaaaagaacatgaatggttcactgactctaagtatctgtctggaagtgacatatcttaggtttatgtggctcaagcaagtcacattgccacacataatgtctgttgatggagattagtaacactgccttgtgtctgagaacccacatgagatacatgtcaagggatacatggtggatagcagcctcagtcgttgcctgcttggctttcctgtagcatttgtttccacatgtcaatctttcttttctttttttttcctgtggatggtaagtaccacaaaagtagggcctttgtcctgacgtccctgctgaatcctagggcctaggaacattcgtgattgatagaaagtgcttagtgattttagagttggggtcagggatataaccaaggtacctcattgatagtcattggcaaagtgacctttggaggggttgggaggagatgacatgaaataagaaggccgggtaggtttctagagagcagtgttggaattgctggtcagagaattggaccagcgtaagacttgggaccaggaatttacagctcagctatgtttctctagtcatgttgagttgctcaggcaggtgtggctgtctgtcacaggaaaggtgaaagtggggagaagagctgctgtcctctgggtgtgcctgcatgattgcatcttttctctggtcctgtcataggaataaagaatctcacctggacctggagagaaacccatccaccagtggtggtgtcatggtgagggtggtaggagggtgtgtgtgtgtgtgtgtgtgtgtgtgcagtggtgaggcccgaggttcagttccgggactgggcaggtaccataccacggagtctcatatgagttctgacacagcagctgagttctcattccgcattctacaggcaaggaaagctgagacttaaactaaggctggctatgctcacagccttgggccctcgtgtcctgtggaggccctaggcaatagtgtgctttgtcaggtttggaatctggcaagccttggtgaagagagtgtgcagcactgtatagtagttccggtgtagatgtgtgcaaggcctaatcagggaggaaatagctgggctatttctgtgtgtttgcacaaacactataaccacagcaccaactgtgatgggaaagtttacccgcaggaatttcttataaataagacacagaatctgaaaggtccatcagtggtgtatccagtggccttgcctttggtaagctgggcatgtcttctctctggcctgtggactcccttctggtgtccttcacatcattgggaagttagaacggaagggaaccccaagtgccacagagtgggggacactgtctaggctagttccctcagtctggaggaaagagaaataagtctggaaacattttcccaaaagaattgaaagccactgtgtgcaagaagtagtgaggtgcacagtagggtcgcagcaaggatacaaagagcaggagataagcagatgagattggaggcagttgggtctgggagcagttgggcccggagtgtagaggtctgcagagcaagagtgaggctggagttcttcctaggaggaaatggggagtaggagtgtacaggagctgctgaggaaagatctgcatgtgcgcaggtgcccttgggactgcaggaccttacaaatggtcatattagctgaaacctctttctgtcgttacaaatgtacagggaaatgaaagtagtaacattaataatcagtatatcatagtgtatgaaaaacatttgagtgctaaagtgctttgcttctttgcaaaagcattgagtggtttgagaagagtggatctgttgttaggtattacaaatggagtgtttaataagaaattgtgaattgcccttcatgtgggtttgactgggtttccagtatttttcattccctgtgatgtcagtgtcatgtaatatgcctggcgagttatcttgtgaagactctacctgccgcatgtcttctgggatgtcttagttcttgtcatgtgttggttgcctgtagcttgagttacagatgatcacacacctgatggccacataggaaaaggcagaggtcccataagccctcctggataacttaacttagttcctcctgttcactgtggaaaacctcgggaggccacttcagccagcagtgttatcatctaaaatcttttcaaaccagtgtatgactctgtcacccccaggtgctaactggggggatctgtgctgtttggaggttattgggtgtttgctgcctttgatctcctgtccaaaccagctgacagtgaagcctttccagagagtcgtgcctgcctgctgccagtggtcacagctgctggtagatgtttcaggaagagctaaatgcctgagtggcaggacttaggcttcctcctcattctaaacaaattagctctcccacttttcatcttgtgagtggtttgttttgttttgaaaatcccagtcattctgaatgtggttttcttcctagataaggcacctctgtcgaagagtcttctgctggtccccagtgccctgtccctcctgctgactctcctgctgcctcactgtcagaagttcttcgtgtatgacctccatgctgtcaagcacgacttgcaggtgggcaccctgctcctttggcatctgggtggagagggggcgcttttctagacttgccctttcttcctacagttccttagtctctcaaaacccctaaagtttcaacaacagcttttaaagttttctttaaatatatgcttgtattttgattatatctaccatctctatccccctctagctcttcccagccccatcatgtccttctaacttcatctcctcctccaatcactgctgcccgtctgcacatggatataggggtcattctctggaacgtgggaaaatggtcagtccgttggggtcacacctgtaaagaaatagatccttctctttcaacagccgtcagttgctgatatctcctcggctaggactggggctcatgagcccccgtcttctccatgctgcagtgttgactggcttgaccttgtgtgggtctcatttaggctctgcagcagtgagttcacaagtgagacagccttgacacatccaggacagtttcacagcatgtccccaactcctggctcttacagtcttggtatcccctctttggcagtgttccctaagctttaggaaggagcatgatagagatccctcatataaggctgagcacaaagcccctgagtctgtgagagatattactaatgctgtattaaccagcacactttctagttatgtccacaatattttcagtaaaacagattataatggagaaacaaagcatgcccttatactgactggtagtttctatttcagattttactcatggaaattcagtttataacttcaagagaatttgtgggctagtgagatgggtctgtcactaaaggcatttgtcaccagctctgagaacttgagttcattttctgggacccacatggtggaaggagagaacccacattttccaaaacctgtctctgtatatttgatgagatgatttacactcactcatctgagacacgttcagaattaatgcatctataaagggagttaaaccaagaggaagagctttgctatggaaagaacagagctcagtcttcaaagttgatgagtgggtctcgtgtgggggttggtgttagtacctgtttgctgggtgccctggcagctctctttgccaccctgagcataaacgtgtttctgctcattgatatcttcctcacgatgcatgtgtctaacaaaggcaaattataggcagagagtgagagagaggtcaccagggctgtgggaaaggtggcaagttaattcacggtaggtacagcgtttaggataatagacagtgcacagcactgtacgttcccaacagcgctgagccatgggcttaaaagtagttaacacataagcttgacttccttttcacagtcactcaaaggaagctcagggttaatttgttgtaactgaaggggaagtgaagtcagagtgttttgcagatgtcttaggatcgttcacatttggagaacgttaaagactcaaaataggtctttggaaattggtgttttctttatgcatgtctttattttcacctagccagaggatggatttccaaagctgattgtctttataagctgaaaatacttatcaacaggtccccagagttgctgtgtgtgtggtgattaagctcagaaagtacagtttgtgacttttacccaaattatatctttgcttttaaattcagtagtgtaaaatgaacgttcactagtttttcattttagctgtgtttgtgtgtcctactaaacaccctccccaccctttttgaaaaccatctatttacttatttttgttgggtgtggtggtgaatatgccatggtgcctcacgtggaggtcacagttctgtggagtcactgtctccatccaccaagacgtgggttctggggcttcaactcacagtgtcaggcttggcagcaggtgccctgactgcggaggattttacaaggacttttctgttgccttagcaagatgcatcttattatgataagtgaagagacttctcgctgttgggggtgtgtggcccccctcacaccatgctctgcttttaacctctgtgcagatttggaggctgatatgcggaagaataatttgccttgacttgaaagacgctttctgtagtggtcttctcatttataacttcagaatatttgaaagaagatatggaagcaggaagttcgcagtaagttatcccatgctttagtgtttagttttcgactgaggttccagaaggaactgaccagatctgcagtcctcatttgcatatgtgttacttcctcgctctcctgtgtgctaggcgtgtgcattttaccaccaagctacatcttcagcccttgtagtttattttttaaactttgaagtgaagtcttgccgatttgtccaggcaggcctctgggaccacagatgtacaacacttttctgggcccttattttaaaaatgccttccattaaaaaaaaaacaaaaaacaacttagtatattatttatcattattgcctaaattgcatgattctagatctgatttttgacttggacattaaccgaagaaaaaaatttacttaaagccaatagcatgataaagtaattaaatgacagtgataatacaagacattaaggacatgtcagaattaaggattctaattagaaatttatctagtgaaattctggtcgtttatttggcttactagtatatgtgctacttattagcactatgctttaattagatgtcttttccaacatatctagaaattggagaagctagtgcatgtgaacagttacggctcatttcccagttttgaaaagtaacaaaaacaagcaacatagaaataagcttatgcgtgtgttcatatgtatgtaatgtatatacgtgtatccgtgcaaacctgtatatatagactgtactcataccccacaccctagctcattaattaaatagctgttaattatttttaggtaacttactttcgtctgtctttacttgcagtccttcttgctgggttcctgggtcttgtcagccttgtttgattttatcctcgtggaagccgtgcagtattcgcttggtgtcacagtggccagcaacttaccttctggattgtaagtagctcatagtttggagtcatttaattagaattcttaaggatttttaaatctatttgaaatggtgtcattcacaaactctcaccaaaagtcttttaagctggccacacctttagtctaggcactcaggaggcagaggaaggtggatctctgtgatttcaaggccatcctgtgctacatagtgagtttcaggccagcctgagctacagtgaatgtgattctgtctaaaatccgagactttatactttgaggtatggtaggtatgtgtgtgaggagactgcagtgtgtgtttacagatcctcatgtcctccaactgatcggtttggcagtaatttcctttttctttcagctctaacattatcccacaattttagttagttagtttgtttgtttgtttgagacgatgtctcctatgtagctcaggatggtctctaattaaagatttttctgcttcaggctttctaagtactaggataataaggtcacaaccccaaattcctcgagattgaatttgtttcgtatatttttatagtgatattttgctgttgtaattttatgagctaattaaatgcaaaaatccaaaattaaatagatgataataaaataaatactgaagtttctgaagaaatttttagattattatttctgtacttccacaaaggtagagcaaagttggtgtataggtaatagctttgtgcttcccacagtgacagaccagcttggttgtacttccatatagtgttgatctttaaagtaagacttgttagtgtgtgcagtaactgggagccaagaccagtgctgacagtgggtgcaaagggccttagcgaatatcacagtcaagtctatgagcctatgtttgagagacacgatagtgtgaaattagaggctggatatttaaatttctgttcaggctaattttattcttgttctaagttttcagtatgggtttgagaactgttaggtacattaggtccctcgattgtaaagcaggctggatctttggtttggatatgtaactagtgctgggttagagtttgcatgaatggtcccttcagtttttttaataacgtgtggttctgagtcttatctgagtgaagacacgggtcctgtgtcaccactgctgcacccttgttaggtctcatgtgttgttactgtgggagtctgggctgcgcctgtgagctgcatgtagtcctggagaagaactcggttcacagcattgctgaggcactcatttctttcagagtgtttctcatcaggccagttcttactggttctcaacaaaggctgctgagttttggaggcatgtgtgtaatttgtgggtgtaagaatgggactggagagtagtcacacaataatccagatgacctaagtgaatgcacataaaggtggagggagaaaagtgagtcgtcctatggccgccatatgtgtgctatagcctacacatatacatacactctcctcaacacacacacacatatacacatatacacatttttacaatatactttcacacacacacacacacacacacacacacacacacatacacacatacacacactataaaattcagtgttaaagaatggaaataactgtcacagctgtggtagacttaaactaaaaaccaaaacccaaaccttgaaatctctacttccttaaaaataagggtcagagtcctcagggaccacccggagtggcgggagacgcagcagtgtgctctaggcctgcacagggctgggttccagctgtgccacttactagtttcgtgacctcatgcaagtgcctgtgctctgtactgtgtgtgagcttggtttgtagctggccctccgctcattgattggaggtgctctgcacagactgtgaagaggtgacgtaggcacctttactagcagcttgtaagttgcaaccctgtttggttcccttctttccttaagcttctgtattctaatgctgtccaccctttctagcctcccccaaccggcttgctcttggatacctcttgccatgatgggattgctcagacttcttttgtttttgtttttgtttttttcgagacagggtttctctgtgtagtcctagctgtcctggaactcactctgtagaccagtctggcctcgaactcagaaatccacctgcctctgcctcccaagtgctgggattaaaggcatgcgccactaccgcccagcttgctcagacttttgtgtacagtgttacaacaaatgttttactaattcagctaatgtatattgcatgcatttattttcatgtcactaactcctcaccgttgaccatctgtgctactgactaggtctttgtgaaggattgtacttggtatattcagagacactgaggggataattatcaacatgagcctgagttagactctaagcaaggttgttgacgtttgcatagactgggctgtctttctctagtgctctgtgtagaaactgctcctgacatctagggatgctcacaacttacttcaactcagaaaaaaacaaaacaaaactccattgttttcaatgtagctacattattaaaagctaaatacgagctgggcagtggttgcgaatgcctttaatcccatcacttgggaggcagaggcaggtggatttctgagttcgaggccagcctgatctggtctacagagtgagttccaggacagccagggctacaaagagaaaccctgtctcgaaaaaactgaaaaaagaaaagaaagaaagaaagaaagctgatgtttagaacataaaatacatcctaagggtgaacttgatctaagggagatccatcaaattattttgaatgatagcttctttttttccctcccatgagtatattgtatacagagtctaaaaatgttaagtcagttaaccaccttctcagataaggcttgattatgaagcctaatttgagtgctatccccaagtaattcatgaacgtgttattttttattactttgggtttttgttttttttgagacagagtttcactgtgtagcctggactggccttcctacgtcttcccagtgtttgtttggatcacagtcctgaccactacacatggctcatgcacatgtttcgtacaagttgtcagataagaatgaatgagcatatcagaatactcagtttttaatcatgtggctagaatacacagaataccgcagaagtttttaaagttcatcattattatttctctttgttagagaagggactggatagtgtagaatgctggttcacccgaaagtagataggaaaagaattttaaagagactgaagactggcagcttgctctgactcaaagcatctcactgttcatgttgctaagtgaccgtaaactgcccgatcggacactttttctgcgaacactgcgaaggtaattgcggtacagcatgacgctgatgactcgagcctggaactgtttggaaacgatgtagtagaggactacatcgagacaggtgctgaggttcatgaggaaggtggtgaaggctccccaggggctatagctgttctcctgtccttgtagcatcaggacggcaaagcagatgtggaagggcacgaagcagacgagcacctgcagcaggagggtcatgatgatccgtatggacttctccttgaccttgggcttcagcttagacgtctgccctcggaggagactgtgaatgatgaccacgtagcacccgatcatgatgaacaaagggatcaggaagaaaaatatgagtcgcgtgaagttgagcacgttgacagcttttaagtgggtgatgtcggagatcttcaggcaggtggccggggaggaggccttgtctgggtcttcgtagagcagtagcagggggacagtggtggtcagggtcattacccagacccccccacacgcaagcacggccttgccggtgttcttcagctccttggcatattttggctgtacgatggccatgtatctgtcagcactaatgaaagcaagaagccacagagcgaggcttgggtaaaacaccaccagggccccaagaatgtggcagaagtactctccaaatggccactcgccttttgcatagtaaaacatccgaaagggcagactgagtataaatacgaggtccagtagtgcaacgttcatcatgtagatggtcactgtggttcttttcttggtcgtacagctgaaaacccacaacgcagtgacattaacaaacagcccaatcaggaagatgcagctgtagaagactagggctgcgattttgtattcctctgggtgtgagccattagaaagatcaagctggttgtgattgctcagggtggccatcttacagcaggctggctcccatggtatgtagaacctgtgaggattgttgagaaaacaggggtgagaactttggttagaggtggagaccgcagagcccagggctgctttctgagggcatttcatactgaagactccgagtgcgtgcttcagcactgcgagaacacacctagacgtcactgccactgttgactgcctctctaactgactactcgtttttatttttggagcactgggcattggacacaggtcctctgaatactgtgtactcactgagctatgaattcctgcccatctgcctgtctgactccccccgccccccattactttggttttattttgagacagggtctctctatatagccttaggtgtcctggaattcagtatttagatcaagccagcctctagctcacagagatctgcctgcctgagtgttggggttaaaggtgtgcactcctatacccagtcctggtctttataatgtactggtcagttcagatgggtccaagccccaagatgctctaggagactcatccagtttcattgaccctgctcatctctctcttccccaaataatcaaagtacgagacagtaggacttctctggagtaatgggaaaagggccagtctgtattttaaatcttataaaaaggcttgccaatttttattatctttattctgtttaaatactttataactcaaataagtagtgatcaaatacttttcattcacaaaatataatcataacttacaaaaatatgaatcagaagaaccaagcagctggtaactgattctcatgtgtgagcaggtaggagctttggctttctctctttgcctttgctgcctctccagcacatagtgggagatgctgagtggaccgtccgtgaagggaatggtatttggtgaggtaatgcagctctctggcttgtcagtcaaatctgttggccccaccccctttatcgaagtttcaaacacttctgactagtgtcctgtattctcttcagatgattgtaggtctagaatcactactgtgtcatggtcaactggaaacctagagcaacagttgggagtatctggggcaggggcttccactacccagggtcctggaatttaagtgcagttacatcaatgcgacattgagttgagaaggagcgatttgaagagaagtttctttgagttaaccactttcgtactactggcctgcctagatgaacataaattctgtcaaagagaagtaggtctgagaggctctaattgtgtacagaaactaataatcccaccatcaaaaactgcatatttaaaaagcaaaggattttttttttttttttttttttttggtttttcgagacagggtttctctatgtagccctggctgttctggaactcactttgtagaccaggctggcctcgagctcagaaatcctcctgcctcccgagtgctgggattaaaggcgtgctgggattaaaggcatgctgggattaaaggcgtgcgccaccaccgcccagctaaagcaaagaattctaatagtgcttataaatatggtgctctcagtgtgacattcccttccccagggtgcattagccagtagaggctgtaaagatacttcatatgtagagtgcagcctggggggcatctctctgaaataggagggtggataaggaattttccttaagaaagtcactttgcagcgtgctgatgtttaattcagctctgaatctttctttagtgaaacaatagggaggattaacagcctgtggctggctgatgagagttagtttgaacagttgggtagacaggaccaggtactgtgtgctttctcctttggtcccattgttgtttgccacataattggcttaaatgtgattttggaataaaatcctatatatctaaaaacctgtattaaaatttccaaataaggctgagaatggtagcaacatgcttttaactctagcacttctgaggcagagggagggggaatctctgtttgaaactagtttgctctacatagcacccccaaaatgtatataactagaatactagtttctacgcaaataagaaaattactgcatagtaaggttaaatctttagtattaagcaaaggagacttagaggcttaaacactgtggtctttaaagaagcctctgaggtataatgaagtcctggtctttcctctatcaccattctccctggtgttgtcatgaaaacacctgtatctacaggctgtccttccctggctgcttttctgtagtccacctgccccagttttcactgtgctcagtgcgatgctcgatgcttgtgtctctgtattaccatccggactatgttctgcacgattttgagcgagtgttgaaaaccgattgtctttcaggttaacttttgaaaacttaagtaccatgactatctgtaggttttgtgttttttgtttttatttttttttaaattgaagccaagtaatttcatgaaacagtaattgaaactatatgacaaagacattgaattatgttatgatgtactatgtcatcaacataatgtgttaaatgacaggggaatgagagcgaggcctcagtcctacaccaagaactactagcagcttctgtgctaaaagtgggagcaataggcctccctcaggaagagcccaccaactggttatccagtactaaacggtcagctctgaaaacacgtgtgagtaacactacacagaaaagcaggttatatgtatttaggtgtgtgtgtgtgtgtgtgtgtgtgtgtgtgtaacaacaattaagagaaggaggccatgaatttgtaagcggttaaggagggtcacgtgggagggtttggagggaggagagggaagaaatgatgtaattatattggaatctcaaaaataaaataaaaacatttaaaactctacacttaactattaataaaaaatattgaaaatgagcgctgaatcctgggaaaagaataaccagttgtttcaaggtcttcatctgatggaacagaagttttgagtttagtaaacacaacattacttctgataatggtttgccatgaaattaattgaatgcagcttacctcctgtctgtcaaaggctgtctgagaggtgaccgtttgccgctctgcccagtcccagagagagagtgctcagagtcgcctgtgttaggtaggtggtgtctctgtgctgtgtcttgttggagggttgttgaaatgtagtaccgatagtggggttggtctgctgagctctgagcactgctctgccgttttcaggaaacgctctgaaatgagacactcagcgtgggactttaccctggatgtggttttctctttcacaagtgatttgtttatgaagtcctgctcatctcgggctgctcttgaaacaatggcatatcttgaagaaaggcagatattcttgaattaactgcttgttttgatgtttgaagtttgtgtcacttacaggcaggagatttgacactgggcaaagcaaggttcaaagcctagctgctttctaagctcctcgactttgtctagccttttgttgttcctgtgtagttcctatccagttgaaatgcatagcactcatgtgataggattgagaactcctctccagaaaagtcctgcctgaaagagagcaactgccaccctgccacctcggtcacctgtcatcttctccatggccctgctctgctctgctctgccctgccctgccctgcagatctgttcctggatcctgtaggtacttcctacactttgtccattttctatctcagggaagacttgcagtaatttttttcttgcatgaacatccatgtaaaccatgggaaggactggggaatttacatgtagctggaagaatttatatgtagcagtgttctcagctgagaagggaagtgaaacccacagaagggaggattgggcagcccagagcatcgctgtctagctactctgagtttaactttctctttaaagtagcccagcccttgtccagttctaagtatctctacattggctacacattatttgccagcctttaaatggtgcctaagcttagctgcttctgtgtctatagtgtgagcgatttaaactggctcctgtcatcttgtctgtcctgttttgagacggggccttactggctgctttggagctgtgttgaccaggttggctttgaacttaccctggtcttcctgtctctgcctcctgagagctggactccagctgtcagccaccacagctgccacagcgtgaacttgaggtagtttgagaaccttgcttcttttcccagaagtgctaaactttcattctacaaaaggtactgacgttagctgtgctaacaaaccactgggtgccgtgggagccttccagaataatgtgctatagagccactggagaccactgcagcagttcctgtgtgggtgagaggtgattgccttgaaaccttctctagacatgctttggcattgccaagttacatcataattgttttatatgaagttatgttttttcatatgctacacaggtcagccacatggatacctcttgactgggacccagtgtgttctgtgagaaggtttctgacaggaagtactgattgtgctgctacagtcaacagatgaggagcctggggtgtcttctcattaagacttgagtcttccccgtatgtagcattcttagttgagaacttgcatttcttagtgcaaggtgcccagggcagatttggaacctcccaaaagcttggcagaacccacctgtagaccctccctctaaccacctcacagctgccattttccctcagagctgggctggcctggacggttccttgccccagctctgtgccttatgcttgggtggccggcacacaccttgctgtctttgatgctccaccactacaccatgtgcttgggggtgctgacatgagttgtagctaaggagcatttaacattgttcgatagctaagaaagtgaacatgtgaagaggggggaggggtggatggtcgtctgagcccagaaccaactgcaaggacactgagctgcctgagatgtggtgagaggtctgtgcaggaggcggaggagtggccctcctgcacgcctcaccttgccttcaggaatctgttactcttaccagggactttgtgaccatgcctgcagttttggtcttctcacgtactttggaatgtgagagaattcttaccaaagagggttttctcatactccagagacgtcagggtttcctgtactttatgaaatgttttggtctcactttgaggtttagtttgagcattgaagactgtaggtgagtttatatacttagtaggagaacctagtttttaaatcaacatgatttagttaagacactattgggagtgttattacatgcgtgtagcatgtctgcatgtaggatgactccaagggtgttattacatgcgtgtagcatgtctgcatgtaggatgactccaagggtgttattacatgtcatgtagcatgtctgcatgtaggatgactccaagggtgttattacatgcatgtagcatgtctgcatgtaggatgactccaagggtgttattacatgcatgtagcatgtctgcatgtaggatgactccaagggtgttattacatgcatgtagcatgtctgcatgtaggatggctccaagggtgttattacatgcatgtagcatgtctgcatgtaggatgggtctcttttgttaaagctttgtttttgccacacacagagttgtatttcatggtctgaatggttcacaaccgtaacaagtgtcctgatgacctcctgcagtggctagaggtctgctgtaacactgtttacctggcctgcccctgcatggggacagtggacagcaagccctcagtggttggtagctggagaagagtgagaatgatggacagagactgttctgcaagaggggaggagtcctgaccaggtggccctagcactctgatttgacagttcggaacctttgtcccctgcctcttactttctcaggctgtgtcccaacaattgttgcttcagaagggccaggccctgggctcgggtgttttgaatagtaggaatttctgaataaagacttaagagattatttaaatgttcgagacagggtttctctgtgtagccctcactgtcctggaactcactctgtagaccaggctgccttggaactcagatatctgcctgcctttgcctcccaagtgctgggattaaaggcacacactaccactgcctggcttaaatgtagtttttaaccccagtgatttatagacatactcttatagccactttagtatgaagagaaatatatgttgtttaatttagccttccttaattctgtctcttttgtgcatcttaaaatgtttatgaacatataatcagagttacttacttcataagaaatgacttgaatccagatatgaccatcaatgtgctagatacgtttagctaaattagcaacaacagcgttgtctgtcactaagaaattctcggaggaaagggcttctgcctgggagctcaccagacctgtagcttctgaagtcttaggactccaggccaagagttcacagacttattcagaggtccaaccaattgaaaaccccaaggctattgcgatgcacttgactctaaactgcaaactctgatttcagttaaaggagatgtacaaagaagagagtgtgtgtgagtctcgtgtgtgacactaggaagtcaccattgagtgtgtgggggggtattgtgtgtgacactaggaagtcaccattgagcgtgtgtgggtattgtgttcgatactaggaagttaccattgaggagaaagaggactgacagtagaccagggctgtgacatactccgtgttttccagaattccgtggtcaagagtttagtcctcagcctggagttcattttcagaaggtggcagagaccttagggagtgacatgatacctttccataggtgcagaccagatccaccaaagctgagcccaaatgaactctttgtgtttagagctttatctcgggcacgtgggacagtaatttaaagatggtgggcactgaatgataagaaagaactcccaggtgaatgtgagatggaggattttagtgtataggtgtctgcatattagaagtacatctaatgtttttaattactcaactgatttttctgccattatctgtataattgggaaaggcagtcaaaatgggctgtttctgtttttcagcctgtatgctctgttctgtatcatgtgtcatatacttaccatccttgttatagttggttctcagaaacagtcatttctccttcttgttctcattaagcacgttggtagaagacttcatcttcaaggctagattttctctgcccgcagatctgcgtctaggaagaactctgccatctagtgggcaagttgaacacagcctcccccccaaaaaaaaccccaaaaaacaaaaaccaaaaaacccaaccccaaatgtatctacatcatcagcaaacagcatgtctgctaatttcatttgtgatcatgaaaactaaacccaaaaaatagcatcacccacaggccaggtgctcacagagatgagggtttgcagtgtgggtgctgggcgcctgtcactcaaaatccatgcatgttgctggtgggaattaaaacacagaagaccttttggtattaagttgtaagtgaaggtgtgcaaatgctatggcccaggtgactccctgacgtacagccagtgagaccagaagacaggtaaaaagcattcacagaagccttgtctgtaacagtctcaaagtagaaacaacccctcactcaccagctgtagagtggacactggaatgttcttcgtgtcaagagagtggtgtacaaggaagaggcagctaccacaagagtaaacctcactacagaaagccacgtaggagggaacccttgatgagtgattccacctttgtggcttccacgaagtagcccaagtgtgtgtgtgtgagagtccatgtgtgtgtgtgagtccatgtgtgtgcgcgtgtgtgcgcgagtcctcgtgtgtgtgtgtgtgagtctgtgtgtgtgtgtgagtccatgtgtggtggtatgtgtgtgtgagtccatgtgtggtggtcactgctttggtggaggagaaacagttccgatagacagggagcagcagatgcctgtagggcaggaccctaggacagttgtaaccctcaccataggtctaaagagaggcaggcaggaggcgatagaacctggaaggagagagccctgtgagtcggctgtgtggaggagtgactaggctctctgcaggaaggagtcgggaataaatgtgccctcagctcaggcctttcttgcctgactgccctccatgctcccttttctggacttggctggaagccaggtgctcctagcctttgattcctcagattccactcggtttctgtatgtgtggtacatttcctgtcctacccagagagacttttgcaggagagtttgggcttcagaattggcactctgggtatgggtgtctctgcctctgaagctgttcccgtgagtgctatttcactacctggggtctctgtgaattgccatgtacccagtagcttgcatcctgggttttgtagacaccaacactagttctcgtccttccctaatttggggctgggtggctgtgctggagtctttccctgaatcatgaactttccaagctgtgttaagttagcctcgatactgtacagttgggcagactcctttttctgtgttttactttggccttccagatcttttctggagcaatataaatgaaggctggcaagatgggacctcagagtccccaggagtcacttaatgacacccctatctctgccctcgcagggaacactggggcccgcagggactcagaagcatctgtgtcctgaggtgtgtgggccctgctgccttttgtcctcatttgctgtgacctttgtgtgtgtgtgtgtgtgagtgtgtgtatttttatcttatttattttggggttaacttcttgaagacatgatcagcctgctgaggagacaggcgtccatgctgttttttccttgataatgaatagcattggcttgttcacaggtcttcctctcagtgtgcgcagtaaattgagcacgtgatggttgtgatagtgttcctgtcttactctagcactttccatatggacacaaaagtttgtgactcttgtatgtttcttgtcacgagcaggccatgcagccccagaagaatcccagcaaaggcagttcagtggcttaagcacagagctagctcagtcagtgagatgcttattaaatgcgagggctggagtttgcgccccagaactctcattcattcattcattcattcattcattcattcattcattcattcactcagtctctctctcactcactcagtctctctctcactcactcagtctctctctcactcactcagtctctctctcactcactcagtctctctctcactcactcactcactcactcactcactcagtctctctctcactcactcagtctctcactcactcactcactcactcactcactcactcacccacccacccactcacccgtatgtccaagcgtgatgacttgcaagcccagtgctgggaaaccctgacaagggcatccctggggctttctagccagtcagctcagtgtgctttgcaagttccaggcctccaaccccacaaagcaggcagtgcctgagaaatggtatctttgacttccacgcacatatgtgtattgcagtctccccctctcctcctactacccccgccaccacaggctgcaggggctggaaagttctgaactggagaccagggcatattgctgtagcatttctttgcatggtaaggcattgttcttgcctgtggtatgtgatttatttttctagcacttaatgtcacacttttttgggggggtctgcaatcataggctttagaattaatagcaggagttgcctgtggcatctctcacagttatgtatttacagacccttggctgtttttccacttccttttttcttctcgttttgttaatgaagaactgccactctcaaatgattctgtgtccagcatagtgcttcccactggaggccctcggtaaatggacctagtgattcagctagggatatgtttttctaaagttatgcagtggctcaaaaatggatgcctctcttgatgtcaccttaaggacatcaagtgagagcaggatataacaagaaataggttgtcaggcttgccttaaagggactgagagggtttgggatgagagactctgttgtttccagaggagttagctgcggtgtgcagttagtcacacatggagtggttccaattcctcatccactctcgtttcctttttggtgattggacgctgtcgagctgctttgataggtcctctgcttctattgtaacacacaggtgatcagtggcacctgaactattggccttaacctgatttgaaatcttgttaacattggaataaaaaattaaaaaaaataagtggtaggttatgcaaatgctttagcattcacttaagattgcttctatattaagtagtaccctgtgataacaagccctttagtcttctaagacgttttggcttatagactatttcttccctcatcagaagcatcctgtttattttaggaaacagatttcctttgtatgactgggctagtgatagaactaataggtcatatttttcaaaatatatatgcatataaacaaaaatcatcatctttttaaaatatactatctgtctgtctgtctgtctgtctgcctatctatctagacaattttatccatgatacagtgtatccatgatctacctcccaacagcatctcctcctcccccttccttcatgttttccctcccccaactcagtccagttagtgcagcctggctcagccttgtgcaggtacgcatagctgtggagaattcgtgagtgtgatggccatgctgtgtcctgaagactgtttcccatcatttccaccccccaccccccacccccttacattccctgagccttgtgggcagttacacccacaggtacagatagcgctaagtcagggcactcagcactgtgaccagttcctagtctgtgctcactgcagctgtgaagacagcgcttccctggccagggctgagagcagggctgatctcttggcccatatgtaactgtttagagggcagcacgacagcacgtacatttactaaaacagcagtaggctttcccttagggcctgtgttagtttcttttctattgctgccataagataccacgaccaaggcaacttacagggttagagtccatgatcatcatggcagggagcatggcagcagccatggtgctgtggcaggagttcacatcttgagacacaaccacaaggcaggcagacactgggaatagggcaagtcttttgaaaccttaaggcctggtgacagacctccttcaacaggccacacctcctaatcctaacagttccaccaactggggaccaggtattcaaacatatgagccaatagggacattgtcattaagacttccacagggcctataaccgtctgagccatgggcttttgacaggtaacacagtatgagacacagattccttcctgtagcgggtcttgaatccaatcagaaagtggtcaccccatagccctcgccctgctgctgcagaatttgcctggcaggcagtattttagcatccagggattcctgctaggtactatcaattgatgccccacccccaccccagtggcatgtgtagcaccttctggagctatgagagatggcccatgggagcaggtttttaggtcagtttcagcttgatttctgtcttcaaagtgtgctgtgccttcagcaacaggatcttaccatctagtaggagtgggccaccaagaggagtgtcagtagcctctgctggagggccgctaggatctcctaaccaacaacttagaaggaagtaccccatgcccagcactgagactttcacttcacaactcttgtctcttaagagaagcattgcctgcccaccgtctagggttcagtgttcaaactctttttaaaaattatatttttaaattagtttacaaagtgttagtgtttcatacatccttagttttgcttaatgtcccccagctttctcagctttcctgttttccctttcctaccccaaatcttactcaatttgaatggacagttcaacatggttacatgcccagtctgcagaatcagctttgttttcccaaactgaagctcagtgcccaccgagtgatttcttactaacccagaccccaggtccctgcagtctgctctctgtcttctggggtcagactgctctgcctcaaaagtagaatcgtggaacatttgtctttttgaaatctccacacattccacagtgagtgtttgtgggtcagaggacagcctcagttctcctgttcacggctgtgtatgccaggccagctggctcctgggtatctggaacttctcctgtctccacctcccatctcactgtagtatgctgggattacacatgagagctgcagcatccagcttttgtgtcctgagttgctgagctcaggtcccactcgtgcagtcaacactgttccttttgtgtcgtctctcaggcccagcatcggacttttgtaacggttcatttcgcctagcacagtccttgggccccattcatgatgtaatatgtaagaacatataatctacatactattccattgtaaacacacacgctgtgtttgcccattctgtcatcagacgcctggttactcctcctcttggcttttgtggacggtgttgctatgaacataggtgcagagacacacaccccttggcatctgctttcagttcttctcagtataaactcagaagtgaggggtaaatttcttttttcttttatgtgaagaatcactgtttctatagcagttaaactgtatatatccctgccaatagnnnnnnnnnnnnnnnnnnnnnnnttccctccctccctcccttcctgtgtatgggtgttttgcctgcacatatgtctttataccacatgtatacttggtgcctgtggcggtcagaagagggcattggatgctccgggactggaactacagatgattgtgagcctctgtgcgccatcagtgaactgggacccctgggaaagtggtccttagccacagaggagtctgtctggcccttttccctctccatagctgtcatcccagtgcatagggaagtgggggttccagatgggtttattttctagtgattaggtaaacagcttttcatgtgcttgttgtagatgcacacgagtcttttcagcgatgtagcgttgtctgctaaagtgctgtgcctgtcatgtagcccagttgttggtttgttagtgtagtttttctgtataccctgatggcagcccttctcagctgagtgctttctcaccccacagggcactcctgtcgatggtagagggctatgtctgatgaaactgttttctgtatcattaggcctgtccatttgtcttatccccccgataaagatgaatttaaaggctttaattttgtgtgtaagaggtaaagggtcccttcagggcctttcctgatgatgtcacatgaaccagcatattgagcagacaagagaccttcccttcttctggaagagcagtcagttaaccactgagcatctctccagccagtgctgctgtcttatgctcttggagtcatgtgcttttgttattttgtaatacaaaagtgagaatatttacttgtccatgacattaatttccacgttctgtcctagtcacttttatcagcaattaatacagaatcccgtgtagaggacagaggttgacatcagctgtcttcctcctccttatctacatttatgtttgagacgatgtctctccgtatctgtaccttaggcagactggctgccaagccaggcccaggccctcctgtttctgtctccccagcactgggataatagataaacactctaccacggccaccaggtttttcctgcccgtgctgggaatcagaactcagatctccactttaaccagctagcccatctcttcagcctatcagtagtcgtaggaaggctgggaagtgtgacgatagttggcagcttgtgttttctaaggctgcagcatgttggatacagcagtgaaactggctcctcagaggagcagtgttagcaataacatcagtacgcctgcaaggtggaattctaggttctgtcacaaatacatgaaaagcaggacacaaaaacagcatctagtggctttcctctcaggcctggggagcttgggtgggcgcttgactggttgttggcagtttgtgaagtggcatcatggtgtagttgccagttaccactgctgtgtggctgttggtcacgattacagggcagcaggctttgttctgaacataaagaacaggatgaggatgtgttcccagccagagaaatagcagacaggcgtgatcatctggagcgggggaggagctgggaccagagaactgttctcagctcttgaagggtgccctgtgaaagaacaattaagaatggaggatggggagggctagcctaggtggctgctatgatagggaggtggcatggtggcatgtcgcttctgtccccaaccagcagaaaagagcgacgacacagcgttcttctcaaagcagtttattcaggaacctttcaacatgcaagcaggaatctctcctagcccccaatcacaatcccttatataacccctcaaccacgtcccatcagcccagtccgtgtaatctcagttcattggccttcgtcaaatggcctgatcttgcatcatggtgcacctgcgcagctctcatgatggatgtggcttattttcaggtgtatgaggaagtcaggtgcaagtcataagacttggctgctgtcctggcgccatcttggcactaccgccacacccgctccccacagtggcacatgtgtgtaacccgggacactgctttagcctgggcatactgagtagccgcagcactcagtacccatggagtatttgccctgggcagggctaagtctggctcagaatagaagcagagggcaggcatgacctcagagtgtccagcattagtgtgaagctgagtgaacccctttgcccctgacagtcctagctctgtacttgctttacatctggattcacgaataggcctaaagagtgagagactcactcaccagagcccagtgaggctgggctgttcccaggaagcccaccacagtccagcagaacgtgcggcactcactgcaatgtaggggcctccattagttaatagactacctgcaaaaagccggagacaatatttctgtgtcatcgggggattgattgctttcctgtgagcaaagatgatttttaaaatttgaaaagtacacacttgtagaaaaccttgataaatatgaacagagtgagagaatcctgacattaagaggtgagttgcaaggccaggcatggtggcacaggcctttaatcctagcacatgggaggcagagggggcaggggcaggggcaggggcaggggcaggtctccatgagtttgagggtaacctggtgtagtgtcctggtgtcccaggacagccaaggcaacacagaaatcctgtctcaaaaaacaaacagaaaagaagaaaacaaaaaagaaatagaaaaaaaaagagagaaaatgagttgataaagatatgcgtttaaaatactcttgaagtcagatgtcagaagttcactgtatttgaataaacacctagatattcttacctaggtttattagatggtgtaagtttgcacattagtgataaattagtaacctaactaaagtttttaagctccgactgtagtcacacctggagccactagatggcggtattggaacttggtaaaacctgtgattctacttaaaattgttattaaatgaggcttgagtgttattaaaagagctgaaatgttactaagtgataacatattctttcagtaaaactggtaagagggtggctgggagcatccagaaccagctttgacagttgtcttcctgtttctgaagctcctaggcccaagtgagagttacgaattactattatatacttgcatttattttttcctaaacagtacagtaaagcgtatttcaaaccataggaacactttttgtgtgtgaatccccacctcattcccttgtgacagagtctttcacagaacctgcatgtaaactggcagccatcaggacccagaggtcctcctgtctgttttgcacagtgctgggtgatgggtatgcagagccacccccagcttgtacgtgacggctggagatttgaattctggtcctgttgtttgtgcatctagcactgttacccactgagcctattcctgagctccaaacatcacatttaactgtgtagcaagttgtcatgcagggcagcctggctctaatacggaacttaaggaagaattcttaccgatatctgaaagttaaggaaaggggaaggcgggttgttctttttttgtaaggggatttagtgatcctgttgaataactgttttgtgtgagccacaaaccgtatttttatcagaattgttgggtaaatgttgataggaaagtagtcctactatgtagtggatatgaatgccactaccctacagcacacgctttagcagttgtcttcccatgtcgtgtctgtggctagtattgagtgcagataaggtggaagctcagtccttatcttgtcattccttcgacaaatggtgtagttgtcaacaataagtaaatattctcagagctcagaggaaggaagtaggaaactacgtgttgggggacttgatggctggcggtgcaaatgtgcacgtgagttctaaggaaggataaaaataaggaacaggaagttgattcatgaaagtgatttttattccactgcgtgctttaactgagaaaacaacctagaagatgtgctaatgttttatggtgaattggtctttgaaaagtgcattctaatcagtttttagaacagctccagggtgaggagggagcccatctccatgttctgttcattgcagttattcaagcacacgtgtggagtccagaagagggcatcatgtcctctggaactagagttgtagacagttgtgagccactgtgtggatactgagaacagaacccaggttctctgtaagagtagccagtggtcttaaccactgagccatctcttcagtccgtggatcacatctatgtaaaagaaaaaaaaaaaaaaaaccaatctatctatctatctatcaatcagtatatatggatatagagatatatagatacagatatctacacacacacacacacacacacacacacacattataatgctgtatttgttgtgtccatgttttaatttatatctccctaatccagtgctgtattgagctgctcccccgaccccaaccactagagagggtttccctgtgtagtctagctggctgtcctggacttgctttgtagactaggtacagaaatccacctgcctctgtcttctaggtgctgggattaaaggcgtgtgccatcaggcctggcattggctgctttttatgtgctcagctgctgttcgtgtattttcaagtctctccgtgcacctgtacttagatttgtgactttcttattattataagagttctttgagagttctttgtattctcataccagttctttaggtgtgcatttagcagatacttccccaagtttatctctgttgatttttataatagtgacctttgaagagtgtagttaaatactctaatgaaataaaatctaccagtttataaatagcctatgctgtgtactctttggaaaaatcttcctatgttgtgcgtatttgagaaatctctgacctatgtaggtttcttctagaaattttattttaggtttgccatttgggtttatgctctattttgaatttttaatatatggttcaaagtagagctgtcttcctcactcagcaccttctgtgtgacaaggtaaagcctcacctgcccctggaaagccccgtttttgctgcccccccagttgctacttcttcaacacgatcctgacttaataccccagtttagtttgtcagtttgagccacacatagtgaagcacaggctgtgtctggtttgtttctgtcctttgtttagctgtttccttggtgcccaatgtagctctagtcagtctcgtcgttagtagtgtagtattgtggcaagtcaagacaccacactcctccagtttctatggccccctgtacctcttgtgctgtggacagacacatgcttctgtttggtgatgtctggagttggaatctgagttgaagggtatcgtgcttagctgttgaagattgctgccatatcttttgttggtcaggaatttcagagcaaagtattgatcctgttcctgtcagcagggactagagttacctgaagactcattttccagagtgactcactcttgtggctgtgggtaggaagccttggttcctcttcttggagttgtaggagtatccttttgacagggtagctcacctccaagagtgtcagagtccttttcgttttactcattgtcgggctgaggaacacaccacgtaccataattgtagtccacatttttttactgaccaagagactgagctcttctgctgttggcttgttgtttatttaagtaaatattttggctgtctcagtgttaactgtaactagctctcttttaactacccaactgtacatttttcttggtgtcttgttttttgtttcatagccatggtgatttatcttcctgtaacactgaggaataacttccagttccccccaagatttcattgctttgtagagtttgtttcttctgaattctttctacttgctgttttctggttttgatattaggggttttgcataaccggagccttcggctgttcatatttcagatctagttagaaagtggagtgacagggatggagaaatgggtccactgggaaagtgcttgctttgtaagcgccacatgcaaatctgggtgaggatcatgcacctgtgatgcaggaggatccccagctcctcccaccccttcctggacatgggtggagggaagttcccaccctctactgtcttggtctttctggctccctctgaggctgtctagggttctgccctaaggaccctggcagcacaattcagaagctgggaaaggggcagactgtgtgggagaagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgcttattccaccacagtctgtcagtaggcagagtaggtgagagccatctcttgtttctggctgcctcttatggtcccagaagacactggtcctgcagggcctctgggtagtttgagtgttaatctaggagcttttccagctcagcaaaactggtctgctgttattctcacaggcttgagtctcagtcgtgaattgacactatggttactgtagttgttagtgtctaagccctaatacccagtatgccctctcctccttagcaattaaacaggtattggggaaaagctgcagagggagattagtccagtgtgctgctttagggggaggaataactaggaacaaggcagtctgggtattgcactgagctttaggcttaatccgaggcaggagactgatgtcagagagcagtcttgcacactgctgtcacacccagcaccactctctgggcttcaggctcctgcaaggacatgtggcaggttgtcagcaccgtgtaaccatcttcctggcagacaagttctttctctggctggcacggctgccttatcctcctggcatgaggttcctggggatttgtagttctttggggtacattatttcaatactctgatagctggagggaggtgtgcagttgtccacttgaactgttttcattgctgcaagaccagttactgatttccagtcaggaaaattttattattcgcggctctttgtcgttgtgtgtgcctttcgagaagccctctccatgtcattctcgagagttgggggaaacggacagataaggccgtgagtgcaaggcttcttcttacctggctgtattgttttccactgtggttaagaacactggcaattgtaaaatcagttttctctccattgacaagattacttccaaagtactcagaatttttattcaaggtcattttgtcagtgatgagaggacagaggttcagttccgtgctgctgccttcatcaggctcaggagcccccttggacttgtagagcctctgctcagaacaaaacaggattcatggcttggaggctgaaaagaatcccaggaccagtttacacagtgagttatggctgacatttttgttaaagatattttaatacaggcttccatgaggcttaagagagacgccctcagaagagggagagtagggaagtcagcgttaaagagaggaatgggcagagcgagcgctgtttggtgggaaggagcacacacttaagtagcccttcaggagtgagggttactaggagacagggcttgggaatcatggctggaccttcaggtgggaaagcatttcctcaagggaaagtgttttccctttgagtctggagcagaggtttgttgagggatgcaggtcacaggaagggtgaagagagaaagctgctgtgaggggtgcatgggggtctgggggaagagcgtctcgagagaatatccctccctctgcccccaccccccaaatggggaaggtctgacttttacacgttcttttgcatggtgtgatttagacaggtgtagcctgcttacgagaacaggagccagggactgcttaggaccatgaattagaactgtaaaaccgcagctcagaacagcttctcacagaggatccaaattaaaggggtaggctgtgatctaagcggagactacctgagtgggcaggtcttagctcctctagggagaggtataattgtctggttctcaggttgtgtctcaaagggtcgccaagaaacctttcctcttcctcttcctcttccagtaagaaagataaacaaggtggctgcagaggtgctgtggatagaactgctgctgcagtccagccagcagccgtccgcttgctcgctctggttcctagaaagtcaggagggaggagagcctgagacactgttgctgggatcctgccccagtgctggcaccgacactgtcttcctccacaaacctgtgtcctgggtcctttgtgcttcacacagcttccttcagcagcagtcctgcttagccacactggcatggagactcatgcctcatgtgcttctgtctgttttacacaacctggagtcactggggaagactgctcccatcaggtcggcctgtgagacactcacctcagcagtgttgcccctgggcaggtggtctggggctgaataaaacaagttgagcaagccttggagagcaagtcagtaagcagtgtacctccatgcaggctgcatcagttcccgccctggcttccctcacgtctgtgacatgacagcagaagccaaataaatcctttcctcctcagctgcctctggttatgttgtttagcaaacagagaagcaaatgaatatgccatatttctccacaaattgtgttctagtcatctccccttctctacactcagggaccgtgatgctaacttgtgaaagcacccagtttcagcaagatctgcctcaccaccagggtcacagctgggccttccctgttgtcttgagcaggtcaggtttctcacagtcctcacctcagcctgacgcacagttttaaagccagtgcttgaggacagagaacacagacggttaagaaatgaactcaccccatagaactgttttggaaaccagcctggtcaatcggacatatttaaaaggatcagtcatcaatatttcgtctatccctttcttaattttgtgactgtttacttgtgatgacagagttggtatcaagcggtggtgttaactgccttgaaagtgtcggggattaggctgtctcgacaggccacagagagctttgcttacctcatctgtggtcagtttgaatatcagccgttggaatacttttaagggaagtgggtattgtgggcacagttaacaaaaagcaacagttaactttctaaagtattgatctatctggtgtgaacttgacctagataatcatagcttgaagggtgatcatttacaagagagatttctcaagatagagtgaccatgacctccacatttgaaatgatcatcttagtttacttaaaatgttgcttagaccagctagaccctagtaggtccaatatgtgttgactcccctttaatttctattaagaagaatctttgttaatctgataagcctgggtgttttactggcaaaaaaccattcttggacccaaaaacaaaaaacaaaacaaaacaaaaagtataggaatctataacccagttgtcagagttggaattttaccccagaagagtggactttcaaatcacatggccttctagtcacagtaaagtgagaggagaggctggcctaaaggctcatcctgtctgtcactcagatgcagagcatggtctgagtatggggacaacagatgttcagggttttattcctagtcagttgttgaagatgagtgttctagcatagctaaggcctcggatttgatgctgttctgtttcctccttccctttacacacgcacatgcacgcacacctgcacactttggtagcctcctctgttgctgcccaccttgttttttcagacaggctctctctctgaatctggggctcactattgcagtagactaactagcaagcccccagactcctcctgtctccgcttcccacacccagttatggcgttacagactgccatgcctactcttacatgattgctggtagtctaactttaggtcttcacccagtaaaattagtgggattctgtggagggattttactccagcaacatggcaactctggctggaatgcagacacacacccttagtacccacgtttaatcccaaacagtgaaagtaaagctggtttgtagaaagaagcaactctgtttaaaagtcatgtccagttgagtggcagacaaagtgacgaatcagagaaagatttgacacaataggatatgtccaactctcataaaaacagagaggaaagagaggtgatttgagagagagagggagagagagaagtgagagagagcagttttactgggagagttttacagagagacaggttgaagagagaacaagctaggcacaggtgaagacggaaaaagccagagaatgaggagccagaagatcaaaatagattgctagacttagtttgaggccaagcagagtaattcagttagaagctgagaggagccagattgaatcagtcagcgtggagaggagtttgagcaggaacagctgagatgaactagccagccagagttcagaattagaaaagatgagcttattcagcagtaagtctcagaggttgaaaacattctaggcctagattagattgtacagaggttagaagcttccaggaccaggcctaggttatcggacagaaggcagtaagtctcagacaacaattgcatcaggtgaacaaaagtgacttttacagttgcctacatctgtctgcttccagtcctccccaccccctcctagagctgcctgttggtttggttaggctgttcagagagtttgtaaataaagatttgagtgtgattgcacaaaacaaaagtgacaaaaggaaattccttttctctgttttatttagaacgaaaggtatgagagataagtagccaccattcagcagagtcaggaggagcttccaggtcacatcctgagatgcttctccatctccaccgtcaccctcaactgggtcacaggcgcttgtgggttggtggtttgttttttcttttttttttctgacccctttattttcagtactgctaatgatttctatgaaatcgttatttcatgaagtaatatgggagaaattgtttgatacctgcctgttgagtagaatatatgctttgtgaaaatgagagaccatgccaatctcttttacctgtgatgcctcagtgccgtattctgctcaggctcctatatcaagatactgacatacaaattcatttcttaccatcaagcggctggaaaggtcaggatcaaggggccagcctatttggtgttcggtgtgaaggcctgtttcctgtctgtctctttgacctcccatggcaggcgagatgaagcatttatctaagtgccttttgtaaggacactgatttagtaagaccgaactctagacctaacctgccaaaagccccacctcctactgtcaccacactagatttcaaaagggctggagagatggctcagcagttaagagcatgtttgttgtccttctgaaggacctgtattcagttttaacgtacacaggacgggacacaactagttccagggggatctgatgccctcctttggtctcagcatgcaccaggggaatcttgttgtctctgctgtccctcggcgtgcagcagtgagaatgtccttaatacccaacgcacgcagctactgtggaactccccatctgctggttaccagttgttgcccggattcttttgcaggaatcattgcctaagagatactaggtataaaaggagtacaagaattgagttagatttctggcgtggagctcagaaggagagtgcacacatgttcctggactcacatgaaaagaaaattggggtcagtcatagctttaaaagatggaaatattttgtttgttttgtttttatttttaaatcatttgtccggccatacctagaagcacagaatccgttcatttgcattttcatagaatatctttctcatgcaaaaagttctcaaacttttgctttgatgcagagttttcgagtctggtaccttgtatctaacacttggccttgagtcagatgtgaactgttcccctcacacctgtcctggccattgggatgtacccagctatcctcagagtaaccccgggagggaggtggggcttcatggaggaaccaggctccgcagcacctcagagctgtttcctgtgagctgctgggagaagcagcacagtggtaggaggcaggaggggaagaggcttcaagtgggtcctgcttgtgcccttggcagtggagaatgttagggaaggaaggacagccagtcctggagatgctaacggtgccttcagagtcacagtgctctgccctcactcactaactctcccttggggcttggtttatgtggtaagacacttaaacttcatcttgccagggtatctaatgtatcctgtttaaaaggctctgtgagcgatcaccagaaggttatgggaaacatgattttgtactccaacacaaaggacagtgacatcgttaaataaaactatagtcacctcagtgttggcacttttgacatcgaggccttatctcttgctcttttggataatttctcgctgtgcagtccaggctagcctggaactctttataaactgtgaactcataattcctcctacctcagcctgagtggtgatattacagtcatgtgtacatcatcatactttgatgtccattgtagcacccctagcttccccgcacggtttccaggtgttaccaaatgatgcccaaggggactgctcagtggcaggtcatggtctgtgtagtatgaggtaaatagaaccttgggaagagttggttccaccctagaggagctcacggcctgtgaagcctgttgaagcctctgatcagacaggatattctaacagttgactgaaataggcttggtggaggctattagtaaaaacttgtttcagagaagtttaacatctgttttcatttctgctttttaaggcttggctcctcaattcctttgcttcagctgtcttcctcttggacttaaaatatttgagtatgtcacaatttccagtccgataggaaatagactttcttcaaacagaaataaaagtgtgaataacttcaggattggatgatggaaaatcttgtgcgagtcaagtcaaactcaggtgacagtaaagtagatcacctcgcgcaggggaagtggaagtgtagttgtagtcaagattcgcttcctgttcttgtttatcgttggaaagttgcaccttatgaaagattttagattcagatcattgtattgttctaagaaaaatttcaaaatcctaaccacgccttggtaaccatagcaagatacacaacaccaaaaataatctcatacctatttgaggatggagttgaatttttgtgtatgttgcacgttgagtactgaaatagctatgttctgttctctgaggtgagaggaggacaggcctgtggcacttctgaggggccaggcatggggcagacctgcatgactgtcagcaagtaacacagcattgtgagtgcatctggctgactgagcaggacaccctagatagcacaaagccagagtcaacttacgactcttctttctgatgaaatctcaccatggactccatatttaataccacttgcgacataatactgaggttccgagggtgacctatcatgacttctgtggctgatacttaaattacattaagttaagatacattaagtagacacttaaatatttaagaaataacaagaccaagtttcattttgtcaatcaatactaacaacaacatggagagaatatatggagctggagagatggctcagtggttaagagtatagattgctcttccagaggtcctgagttcaattccagcaaccacatggtggctcacaatgagaaagcaatggtgtattcatatacatatatattttttaaatctttaaaaaaaaaacaacaacaaaaccctggaagttgctacttgtgtaaaataaaaatatataggagaatacacaagtaaactacctccacatttctatcatggaagctttaaaatacactgctgataagctcccaaagtgtcttgtgtttaacagcattgaaaacggtctcagaagacaaggttgtcatcaccagcccctcacaccgtgcagtagaacagtatgggctgtgagatcagccagtacactcagactggcaaggtcagagacagtgggctctgtgtaggaggactgtggaggacttcttgagttcttatcaaaagaatgaatatttcccccaaatcaaattgcctaaaatactggagcaaccacatccagctccagaaggtaactgctagcttcatagatagacctaacatgatactcacctcaaaaatacttcttaaaaaaaagaaagaaagaaaatatatggagtaacattataaaatgaatattaagttaattctatttgagaaaaaattggtagaaatttactttttttcttaaaattttaaacttccttttttccccattttttattggatattttctttatttagatttcaaatgttatcccctttccctgtttccctccctcccggatacaccctatcacatcctcccttcctcccttgcttctatgatggtgttcctccacccacccacccactcccacctccccgcccttgattcccctacattggggcatctattatgtcttcataggaccaaggatctctcctcccattgatgactgacaaggccatcctctgctacatatgcagctggagccatgtgtactccttggttgatggcttagtccctgggagctctggggggtctggttagttgatattgttgttcttcctatgggattgcaaaccccttcaacttcttcagtcctttctcttaactcctctgttggaccccatgctcagtccaaaggttggcttcatgcatcagcctctgtatttgtaaggctctggcagggcattcaggagacagctatatcaggctcctgtcagcaggcacttcttggcaatccacaatagtgtttggtaactgtatatgggatgaatccccaggtgggacagtctctggatggcctttccttcagcctctgctctacatagctccatatttgttcctgtaggatttttgttttctttctaagaaggaccaaagcccccacactttggtcttccttcttgagcttcatgtggtctgtgaattgtatcttgaatatttggagcttttgcgctaatatccacttatcagtgagtatatactatgtgtgttcctttgtgattgagttacctcactcaggatgatattttttagttccatccatttgcctaagaatttcatgaatttattgcttttaatagctgactagtactccattgtgtaaatgtaccacattttctgtatccattcctctgttgagagacatctgggttctttccagcttctggctagtataaataagactgctatgaatatagtggaacatgtatccttattacaagttagaacatattctgggtatatcgcccaggagtggtattgctgggtcatcaggtagtactatgtccaattttctgaggaaccgccaaactgatttccagagtggttgtaccagtttgtaataccaccaacaatggtggagtgttcctctttctccacatccttgccagcatctgctgtcacctgagtttttgatcttagccattctgactagtgtgaggtggaatctcagggttgttttgatttgcatttccctgatgactaaagattttgaacatttctttaggtgcttctcgaccattcagtattgctcagttgagaattctttgtttagctgtttactccattttttaaaaatagggttatttgtttctctcgagtctaacttcttgagttctttgtatatatattggatattagtcctctatgggatgtaggattggtaaagatcctttcccaatctgttggttgctgtttggtcctattaacagtgtccgttgccttacagaagatttgcaattttatgaggttccatttgttattcttgatctcagagcacaagcccttggtgttctgttcaggaaaagttctcctgtgcccctgtgttcaaggctcttccccactttctcctttataagtttcagtgtctctggttttatatggaggtccttggtccacttggacttgagctttgtacaaggagatgagaatgggtcgatttgcatttttctacatgctgaccaccagttgaaccagcaccatttgtttaaaatgtggtctttttttccactggatggttatggctcctttgtcaaagatgaagtgaccataggtgtgtgggttcatttctgggtcttcaatactattccattgatcttcctgcctctctctataccaataccgtgcagtttttatcactattgctttgtaatacagcttgaggtcagggatggtgattcccccaggagttctgttattgttgagaatagtttttgctatcctgggtttttttgtttttccaaatgaatttgcaaattgctctttctaactcagtgaagaattgagttggaattttgatggggattgcattgaatctgtagattgcttttggcaggatagccatttttactatattaatcctgccaatccatgagcaagggagatctttccatcttttgagatcttcttcaatttctttcttcagagacttgaagttcttgtcatacagatctttcacttgcttggttagagtcacaccaaggtatgtaatattatttgtgactattgtgaagggtgttgtttctctaatttctttctcagcctgtttatcctttgagtagaggaaggctactgatttgtttgcattaattttatatccagccactttactgaagttgttaatcagctataaggagttctctggtgaaatttttggggtcacttaagtatatgatcttatcatctgcaaatagtgatattttgacttctttccaatttgtatccctttgacatccttttgttgtctaattgctctggctagatcttcaagttctatgttgaatagatagggagagagtgggcagccttgtctagtctctgattttagtgggattgcttcaagtttctctccatttagtttgatgttggctactggtttgctgcatattgcttttactatgtttaggtagggaccttgaattctgatctttccaagacttttatcatgaatgagtgttgaaatttgtcaaatggtttctcagcatctaatgaaataatcatgtggttttttttctttgagtttgtttatgtatttgattacattgatggatttccatatattgaaccatccctacatccgtgggatgaagcctacttgattgtgatgaatgatcactttgatgtgttcttggattcagttggcaaggattttattgagtatttttgcatcaatgttaataagagacattggtctgaagttctctttctttgtttggtctttgtgtgctttaggtatcagagtaactgtggcttcatagaacaaattgggtagtgttccttctgtttctattttgtggaatagtttgaagagtattggtattaggtcttcattaaaggagtgatagaattctccacttaacccatctggtcctgggctgttttggttgggagactattaatgattgtttctatttctttaggggttatgggactgtttaggtcattaatctaatcctgttttaactttggcacctgctatgtgtctagaaaattgtccatttcatccagattttaaaattttgctgagtatacacttttgtagtagaatctgatgattttttgaatttctatggtttttgttgttatgtctcccttttcatttctgattttattaatttggatactgtctctgtgccctccgattaatctcaggaagggtctgtcttcttgatttttttcaaagaaccagctcctggttttgttgattctttgtatagttctttttgtttctatttggttgatttcagccctgagtttgattatttcctgctgtctactcctcttgggtgaatttgctcctttttttctagagctttcaggtgtgctgtcaagctgttagtgtaatctctctccagtttcttttttgaggcacttacagctatgagttttcctctttccgctgctttcattgtgtctcataagttttggtatgatgagtcttcagtttcattaaattttaggaagtctttaatttctttattgcttccttgaccaagttatcattgaatagagtgctgttcagcttccatgtgtatgtgtgttttctttctttctttctttctttctttctttctttctttctttctttctttctttctttctttctttctttctttctttttttttggtttggtttttcgagacagggattgtctgtatagccctggctgtcctggaactcactctgtagacctggctggcctcgaactcagaaatccgcctgcctctgcctcccgagtgctgggattaaaggcatgcgccaccacgcctggcttgtatgtgtgttttctgttgtttttactggaatataagaccagccttaatccatggtgatttgatagggtgcatggggttatttcagtcttgtatctgttgaggcctgttttgtgatcaattatatggtcagttttagagaaggtaccatgaggtcctgagaagaaggtatattcttttgctttaggatgaaacgttctataaatatccattagatccatttggttcataacttgttagtttcactgtgtctctgtttagtttctgtttccatgatctgtccattgctgagagtggggtgttgaagtctcccactattattgtgtggggtgtgatgtgtgctttgagctttagtaaagtttcttttatgaatgtgagtgttcttccatttggagcatagatgttcggaattgagggttcttcttggtagatttttcctttgaccactatgaagtgtctttccttatcctttttgataacttttggttgatactcaattttattcgatattagaatggctactccagcttgtttcttgggaccatttgcttggaaaattgttttccagtcttttactctgaggtagtgactgtctttgtcactgaggtgtgtttcctgtattcagcaaaatgctgggtcctgttaatatatccaatctatatattttggggggaattgagtccattgatgttaagagagattaaggaaaagtgattgttgcttcctgttatttttgttgttagaggtggaactatgtttgtgtggctatcttcttttgtgtttgttgaaatattcctttctttgtttttctagggtgtaggtttcccttcttatgttggtattttccatctattatcctttgtagggctagatttgtgaaaagatattgtgtaaatttggttttgtcatggaatatcttagtttctccatctatggtaattgagagttttgctgggtatagtagcctgggctggcatttgtgttttcttagggtctgtatagcatctgcccaggatcttctggctttcagagtctctggtgagaagtctggtgtaattctgataggtctgtctttacttgacctttttctcttactgcttttaatattctttctttgtttaatgcatttggtgttttggttattatgtaacttttctagtccagtctatttgtagttctgtaggctgcttttatgttcatgggccatctctttctttaggttagggaagttttcttctaaaattttgttgaaaatatttactggccctttaatttgggaatcttagctctcttctatacctattatccttaggtttggtcttctcattgtgtcctggatttcctggatgttttgggtctgtagcttttttctttttgcattttctttgattgttgtgtcaactattttctatggtatcttctgcacgtaaggttctctgttctacctcttgtattctgttggtgatgcttgcatctatgactcctgatctctttcctaggttttctaactccacggttgtctccctttgtgatttctttattgtttctatttccatttttagatcttggatggttttgttcattttcttcacctgtttgattgtgtttacctgtaattctttaagggatttctgtgtttcctctttaagggcttctagctgtttacctatgttctcctgtatttctttaagggagttatttacgctcttcttaaagacctttatcatcattatgaaaagtgattttagatctgaatcttgcttttccagtgtaatggtgtatcccggacttgctatggtgggagaattgtgttctgatgatgccaagtaaccttggtttctgttgcttatgtttttatgcctccctcctgccatctggttatctccagtgttacctgccctggctgtatctgtccttcctgtgatcttggctggtcagaactcctcagagtccagctttctctgggattctgggattctgggatcctgggtgtgtcagagttcgtgggagtcaagctgggaccctgagatcctggtgtgaccaagcttctgggatcctgggattctgtgatcctgggcgtgttagaacacctgggagtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaggcagggggagagggaaggggggagagaactgagactgttcgtattcttatgtgaatttccggtataccctgttctttgctggtggctttgtcccccaccacccacctcttcctaggacttagtgaagatctgttgtgatttcagagtgaatgtgaccgctgtgtgtcctttctcacatgctttagtttgctgcagcggtgattcgagctttctttcccccgtctccatttgcttccctttctccttttctctcatttttcaactctctccgagtttcagcttccatcattgctgtcacaagaactgtgggagagtgtcagcgactatacttagaggagtttagaagtttattacagaaaatgttaaacatacaaagagagtagtgccttacgagcctttgttcactgtacaacttcaaataatttgataatgagaattactgtttacttcctaaatcctgcatgccaaggcctgcaatgcttcttaaccgtgagtctgcatcagatttacaagtctgggactctgcagatacccagtgcgtaaggactgaagcagccatgtgctgtttcagaggagtctgggacagactgaggactgctccagcttcttgacaggtgttaggtgtgtaggtttaactgagttttcatagctgagctttagacaagacagtttccagtccagtccacggtctttctaggagggaaatatgcagcatgtgccctaagtttgtggtaacacagatttcatctgccttcctggtgggcactccaggcctgaggggtggtgctcacgagaatgttactctttagaagacgattctggcttttgtagtctctactgagtttcactctgattgactgcccgccccctaaaaaacccttcatgggaaaagttattcttacacagtacagaacccagaaatggatcttctcacactctgagaaaacggaaagataaaaagccaatcaaaatttacgagtttttgttttgaattgactatagcagctccctcgtgggacaaaaagtaatgtggctcccagcctgggggtggcttgtaggttatttgtgtaagtaagactttgagattgtgttattaacaagaaaaggccaggacacctaaaaaagcaaaaatgatgaaaagcagcaggtaggtatgccagtgaagatagggacttaggtgttctgcggaaaataaacagttagaattgaactcaatggtgtcatgtgtcctgccacattgtctctagttcctgacaactgctgtctgtagagattctctgagtttgaatttgtgtgatcagaaataaatgtgtaaacagttaggtccccttggcatgcatggaagggagtgcaagagctagtgccgttcttacactgatgacaggaaatgaaaggaaactagcccatcactctgccttccaatctggtgtgttaggcatgattaatagttcactgagagcatgttttagttacctgttgttgcctaaggcgttgtgacatgcagtagtagcttcatatctgccaggttttgatactgcaaacctgtagcaccgtgtgatgacctatagtcagcatggttttgagcattatctgtgttcagtggcccattctcagaatctcccagaaccgagcagtaaaggtcagggtcttagctccagtaaggtttaatgttttagctgaaggtatgagagtgaactgatagttgctcatgcactggaagatgatggtcggaccgtcttacatgttaggcatcttgtagtcactgacaggagaaccgacgtccggaactgtgcagtagcgcagagttggatgataggtttgctagtagctggctagaaatgaagctttaggtctacacactagcgtgatcttttctttgttttaaaatactgtgcatcaaggtccagtgatgtgacatggactggaaaagttaatacacactgaataaaggaaggtgggtgatttggagcagccgaccaagaattaaaggaagggttgtcgtttggatgtaagaattaagcagtgtgtagaggaagcagagtaacacagccagtgagaaccaaggatgttttccctgcacactgcctcagaaggtgcatcctgagcagtgcagggggttaggtcagaaggactttgagagcaggagaggaactcggactttgatgttcttgaccatggggaacttcttgtcagtcttggagcatggaattatggcccagtggaccagcgctgaacagtgaccatgctttagtgtccttaccctttagtgctttttctttatgtcccaggaggttaaacactgacgtaatcaggctagactaacttgtgttgcagtaacaaatgcacctggaatcccaggtcttaagtgcacaggtgggtttcttgcaacacaggtagatagggcctaactgggaatcctgtccttactctgggccttctctgtggcaagatagaaatagctggatgaacaagtctcacttgtgtctcatacataagccagaagtgacaggtcactttccttgagctcatgggccagcagtagtcacacacatcatagggcacacatgcaagggcactggaggtgtctctttcaaggttctctgagggacatgtgactttctgtttatggagaaagtgtagtgtgggtgtaaggacccagagctcaagctggcttccaacttactgaggctctgggcaagttctctactcccttgggcaggtcaattttgtaatgaggaggccaggggtatttagtaagttaaaacttaggccgagggtgtaaaccaatggtagagcatttacccagtgtgcttgaggtcctagtttccatcccagtacctggcgcccaccccagcctcctccatggagcctgcaggagcaaaaagttcttagagcaatctgctatgcagtagttggtaggttaaatggctattggtgtagacatctggctttctagatggcatcctaaagaaagccagagtttctgactctagctagttggaagaggcagcagtaatgtaggtgggcagctgtcagcttgtgggggtgacgtggcactctgaaggatgagctgaggagaaaactcaactctgatgatcagaggaagggaattgggtgcatgtgatgaggacagcaaagatggggtttgtggagaaacgatggactgttcttggaagaggagtgaggttcagataaggtgatggaggaaggtccttagcactaaagccacaggaagtggaagcctggggctagtgagagacaggaactacagtggttcctggtgagcatgttcagtaggcagtggtggaaggttgaacctatgtcctggctccatcctccatgtggccttggtgtctggtctcagcacggtaaggagtgtagcatacatagtgactgtaggttgactggatgtgtggtaaggtggtgtgtggtaaaagatgaagcacgggcattcttagtggtgggctttgctccagaacacccattgctgtccgttgcggcactctcatggagcccgtgttcagaagcctggctgtcccttacttcttgttctcattcttcacctgaatactcaactagcagggcttttttttagctttgcggaaaaaaacaaaattacagcatgctgagaagttaccaaaatagatagttttaagggctaatttaaggtgggtgtgtcccttctcatagttgcatgctgcctttcctggctgttgaccatcacttttgcctcctaaaatgctagactatttccaagcagactggtcatacttctgtctctggttttgttgttgatttgttgtttgatgagctctggttctccacacagctattttaacctgaaggatcttctagtacacatatatgtatatcattggtcattcgagtcatttcttgtcattgagaaattaagaacacaagagatttcagtgggtattacagtattaataatcatgcaaagtatgtactgttcaattaagtgattgtttgaagtctttctttgtgctttcactgtgccaggttttgtgagcacaaagcgaaggtcttcgtgcatggcctgcaaacttcataacctcctgggagagagttgccctattgaagggttttgtagtttgctgacctaaaatggcagtaaaacctctcatgtctttatttatgtctacacgatcagtggttccatcgctactcagtggaattaaggctgtcctcccaatcttgcctctgattgaccagttgccttttctggctttggtgtgaacaagcctgcctgctcattatgttcacagaactgtggaaaccaagaatgacagtttactttagaagattctgagctcttcaaagtatagccagtgctggttttatctggtacttactgtcctgaaatagcactaaaatgttgatgcatttatatatatttgagttgcagacagttgtaagctgtcatgtatgtgctggggattgaacctgggtcatctagaagagcagccagtgcccttaaccactaattcatttctccagccccacatttaacagatcttaaactgagtagctttgagaaatttaaaattagctgaataatccttttagaaataaaaatgagattgtaaaagaggaattggattagctgaatagctatccattttcctagatgagtttttttactagctccctgttatgtcagtgttaaagcttatcatgtttatgtagcaaatactctgttttgatgttcaggtagagttaagtgcaaggccacttcctttgttgtcacagagtacacaagttaatcagcactgcctgtatgcactgaggtttcctgctggtgaagggaatctgccaggaagagaggcacctccctgaagcagaggtgaggagagcatgcccaggtcacatgggagcagttgcctgggaatggatgtgagcactaaaggtctgtgaatgggagagcagatagccagttggactggactgaaaacatttgatagttgaagataagctcactggtctcgactttgccagatgacaccctagagtcatttacctcttataagatggagggagaacacagaaagcttaacatgcaagtgtgttatactgttgtaaactgtaatagcacatactttctggtttgcaggatcacaggcttggcctgattagcatggtcatcagttgtgaggcatcaggttggtgtgtgtgatggtctgtgctccatcgtgtcatggagctatgaaactgtctgggatctgtttctggttttcactagtggtctcttgctagagatctcgcttaggtgactatgtgccgccctgacaaaatgtagtattttgttctttctgccctcgcttgggaagttcatagatggggcaaggaaaggcatcaagagctaaactttaccacctccatccgaccaaccacgtgctgctagtggctttaatgctgtggaattaacataaatcagatcttacttactcagtagagttacagtagtgagggtcaagctcacttgaagctgggtgtgatagcacacacctgtaacctcagcactcaggaggctaacacaggacattttatttttctttttgaagtaggagcttgctataatatgtatataaccctagtacaagctagcctccgactcagcaatttttctgccttagcctcccaggtgttggggttacaagtatgtgcctgaggaagatctttagtttaatatttgcctgggatacaaaatgagttgcagggtagccttgagctatataatgagactctgtctcaaaagaccaagcaggttaattttactcaaatgaaatatttcctgggcatacagctcaataaaaattgaaattatggctcatagtatagtgttttattccttccctattatataaattgatatcattgccaagtgagatactgtactggagaaattttagggctggaacatagcaaatttgagcaggcaaacagtgcttaggaacttaggaagaccatgctgcacacattaaagtatttgtataagcaggtgtgtaacattacagagaatcgcagcaggacatggtgcacacctgtggttccatcactaaggaggcaggaggttcatatgccagtctaaggctagtctgtctacatagagacttccaggcctgcaagactgacatagctagactctgtctcaaaagggggaaaaaacattttttagagaaggtacagtggttaaaagcactagctgctcttccggaggatccgtgtttgattttcagcacctccgtaatgacacacaatcatctgtaactctagtcccaggggatctgacaccctcttctggcttttgcaggcactgctcacatgtggtacactgacttgtatgcaggcaaacatacaaaaaggaaaaaattcctgaaaactactaatttacaaattgttcattaactgcctgagttacttacgcaagcatggcagttataattgtaatccccattgctccagttctcatagcctactctaccactgtgtagataccaggcactaccagctgaacagaagtcccaaagcatgtatgcatgttttctattccagaaaggaaggtagcacgtgcacatgttttcagtggatgctgtgtgggagcccctgtcgtgtttccgagcagtggtccaaaggcactatcctgggtgctcagggaagggcttgatgcttctgtcacctctgtcatcaccagcatttctaccgttgttcttcaaatataccttctattaattatacttagaagttctgctggtggttgacagttacatattaatactcttgttcgatcctgttctttatctcacaaaatgtttcttaaaacatttgtctcagaacaaaacaaacaaacaagcaaacaaacaaaaacatattactaaggagacaatatctaaaattgaaagaggtgtaaattaagaaatatattcatatattacagtattaacatttttacactggcaatatacagtgcaattagtcgtcttttgccaaactattgacaagaaatagtaatttcacaaagaatttctttttacattgagacttatgagagccttcctttatatacattatatttcatttatgaagttgaacttgcttttttgtctcctcgatctggtctggatctcagtgcattggccggtggggcggcagtggaaggcatcctggttgggagccgaccagtcggtgggcggggcccatcccgcagcttgctgtgctgtgaagtcccaagtgcctttaccttccattggaggccttggagtggatcatcatctgagactctgtcatttcccgcgaattctcttcaggggctgacctcactgcgctggagatcgacacactcacttgacgtttgagcatcttcatgacctttctcttataccctttgcatgcaaagaagtatatgaacgggtccatgcagcagttgaagttcatcaggcacaccgtgaagtgcagagagatctggaaggaatgtctcgccccacactccagggctccaggggagcagagcatctttatcatgtgctgaatgatggccacgtggtagggcgtgaagcacaggatgaacacgacaatgatgaggataattgtgttgagagcctttttgttcacaccagatttctcggtgagtgggttctgcttggcagtcctgaagagtttgcagcagatctgagagtaacacaggagaatgactgtgataggcagcacgtagcccagcagacaggctccgagcagaatccacggcagggacgctgtcccttcaaagtttggatactccatgcaagtggtcttgtctccctcctccttagacataggggtgaggagcagcggcagtgtttgagcaaagaccagaatccagacggacaggcagacaccctttgcgtattcgattcttttaatcttgttgtagcgcagagggtgcaccacagcgaagaagcggtctatgctcaagcaagtcatgaagttcacacctgcgtacgtgttgatgtagaacaccagagcagttacccggcacagggcatcacctatcctccaatcaaagcccagcgcatagtaggctatccgagtgggtaaagctgtggtaaacaggatgtcagaaatgaccaagttcattgaatagagagtggttgagttgattttttttctgttttgaacaatgacaaccaaggccagcaggtttcccaccagcccaatgatgaagaccaggctgtaatgcagaggcattaataccctggctgtgctgtggtgggcatagagatcacagttattgccatgagacgttgccagtggggtagtgaaattgttagccatttctgtatccagtggtcacagtcactaggaggaaagcaagtaaggactctttagctaagaccatttaactcagcagtgcagtcatttatacacctactttaaaattttcagtgtgcaaattccctcgggaataaactgagaataaaatttatgtgtttacttttacagttggtggctttggcagaactcgggcaaaggaaatggaaccctctaaataggtcaggttctgtaacccggggggcccactagcttcagagagaaacccccccttctgaatcatgatgtggttaagaataaaatcatgtaaagttccccacattctagacaggcgttagacttggcttttaaattgaatttaggttgaatttttttcttcttcttttcttccaaaatgcatatcactgccaggaaatgaaatcagtcaaacatgtagtggagtatgaacttaccacagaatctgatctgtgtcaacccagaaagtatgagaaataatcttaggtcatggtaggaactgaaagttaagctctcttacaaaaagaaatagtatttataactaaaatgaaaaagaggagagaaataaatgtaggtgtgtacctaacaccagctgctctgcgggctgaggcaggggcatcacaagtttgagggcagcttggctatctcactgataccctttctcaaaatagaaaaacaaaagtcaggttcaaagggactttgagtctacctcagcagtagcacacttctctttcacgtgtgagattgagtatatggtggagggactcaaactgcttcaaataaaaaattttaagttgggcaccagtgtgcgttgaacccagtacaagtagtgtaatgtggtgttttgtgtcttgccttagtagtaactacatctccttggcagtgtagtaaatgtctattactgtttggatgtattaggcgtctgatggatgctccagtgttccagagtgttgaatcagtatttggtgtgttaatgcatagtttatggagatagtccctgggtgcacatttggattatttgaagttttttcttggtcataaataattctaagactagtttcatatcctaaattggaaatctaaaaaatctgacagtaaaattccatataagaaagagagaatggcagtgaaagtggagaagccaagcaattaaaatctatgactatatcttaaagggggggaaaaaaggcacttctggagactgtacatttccatgtggctgtcactgatgttgagggagttctttcagtctgttgctgctgctgtatcttaaaggaagaggactctcaatgacaattgagagcactgactccagacctacctgtgcctggtgctagatgactgggtctccgttaacttctgatagagaagagggatagagaggagggatgctcactggcactgggctctctgcctgtggtgtgcgtgttaacagacgagtcctcacagtatccatataaaagttaaagcaagaccaaagaaagaggaaccgtcttgctgtctcagagacaatcagaaaggaaatggacaggcaaaaggacacgatgaggatgaagaacagaagatgcagaagaagaaggtagaaagcatgtccacacagatttaaatggattgagcttcctggttaatgggaagactaccagtttggagagttttggtttggtttttgtttttggtttttggtttttgaatttcttttttcctttttctttttttaaaaatccggttgcatgttgcttaaagaaaatgtaatccaaagcaattcagaaaggttcagaataaagctgtgggagatatataccacccaagtcctgatgacagggtgggccccagtcagaaaagaagaaagttaaggcaactttgatgccaataggaatctagccttcctgccaaaattaagaatagtcaccaggctgtgatgatacacgcctttgatctcagcactcgaggggcagaggcaggcagatctctgggttcaatgtcatcctggtctacacatgggttccaggacagcaaagctatacagagagaccctgtttcaaaaagcaatcctcaccccccaaaaatccacaacggacataaaaataattgtgagatatgtctgtgcggtcataatctgatatagtttataggagaaaatcgcaagtctataattgtaatgggcagtcatgtgtctttgaacatcctagataagaaaataaaaggcactgaagacttgctcaacatgattcaagagtcagtagactatgtcctgaagagataagcatgtctcaaactcagccatcacaagacatccagaaagtcagtattgagcagaccacacacagcccgaggaccgcacagctaaactacaaaccaatgtcaaagcaacaaagagtgaatttggaagtgaaaaatatatgtataagaaacctttgacttaaagaagataccacttcagagatgtttaagatgcttaaaataaaaagaaagattgaaaatagaagtttgctgtatcacttaagtcttggaggagcccatttgtcagctgtgaaattaatgaaataaaaaagcacaggaaagccgcccattcacgtaaggcctgccttctgccgctgtgttctggaggcagggtgtagccacggtgtgagtgcagcttgtagacaagccttggctctgaggagccggcaccaacaactctggcagagttgacagaagtttctaacttttgtgaggatttttcttcctgaaaatcttactttccacttttgaggagtttttcatagcaagttcatgagatgtgacctcaaacattggtgtgtgtgtgtgtgtgtgtgtgtgtgtgtgtctgtgtgtctgtgtgtctctttctgtgtatgtgtgtgtctatgtgtgtgtgtgtgtctatgtctgtgtgtgtgtttgtgtgtgtgtgtgtgtttgtggtggtggtggtggtggagttgcagcatctccatgttaaccgtactgtaaagatgaggagagccaccccaacataagagaggggagggcagctgttgtgtgtcagcctgcacatgatgcctgggtgagcctgtgaactgtgccttagcatctggtacagctaaaaatgggagtgatttcaaattgttcaggtatgggggtattctacccagtgttggctgtaacaggaagatgcaaaagtgtgaacagctcagattctctcagtagatgacttgcagacgttgagtggttcaaccgtgctgtggcatgtgaaagtggcaaagccagactgtttcttggctggaagtatgttaaggaaagctgattgcatgacttggtactctgagggagaatgcacacaagcacacagaaagatgcctgcttggatattatatgtgccaacaggtaatactgtatgagtgattggggacttgtatccatacagcctaaattcagaacagtgaacatagattgactgaagtaaggtaatgatcttgttaattggaggaagcaatgttattttgctcttcttgcaagagcatcatcacccagtgttcttcacagcttattccacatttgtgctctcacttactctgcctgcctacctttaagtcctgtctgatgaggacctcatatgggtctgaggagttaaatatcacgttgggtccttctatgtggtgctcccttcagtcctttgaggagcagctgtctcatgagcccttaaagaactgagagattgtggtttcagagtacagacagcatgacatatgtggttagctcccacagggtagatggggcaaccttccctaaagcagggcaagccagtcccacacaagactgggacagggatcttgagtgaccactgttggaccagagccagccaaaggcagcacttttagagtatggacatgtaagtaggataggtcagaacctggcctcagaaagcagatggagacggcttgaaaacaggctcctgttggatacttagcagcttctggggattgagtctacatttccctcagttcgtgtttctgtcttccctgtgttctcaatgctgtcatttcagtacactttattatctccacattaagaggaaagtcctttcacatccttggctgctgttacccaattcctaaggcaataaatctcaatttattatatgtcttcagagttagaatttgttctttcctttaatcatcttctggattactctcgtgaggcttaagatagcttcacacttttagcaaacagtacttttagtgcttttagtctacatgtgctggatcccgggaatgcagaacgagagggtttacaactgaagagagagagagacagtgtggggctggcgtgccgtgtggctcagccctgctgcttgtcttcctcctcgtgcacccagtgtccggtctggatctcagcttctcctttccatcactcagagtataacttacactttaatgcactttaattatttctcattttaattattcttaggcagtagcttctgataagtttagaatacgtatgtaaacacatatacaaaatatacctgtatacacatgtgtgcctgagttaaacctgaaagtactgtaatatgtcagtgaacacatagggggaagcccacagagtgtgtcttagatctgtttcccttagaacactaacatttataagaataatagtttcagtgcagtgcttttgatgacattgtacacttgactacattccacacactcagggaccgaaatcaagatgatgacatctttccccaggagcacagatagtaactgggctgcatgaaatggaattaattgttcttcagggttgaccttcctgaagagcggggcatttgtggcattgtgtatctatccttcagctctaaaccctcaaatattaaagaggtactgtttctatgttcccagatttagcatatgtagactaaaactactgaaactatgaacgtataaaatgggtgtggtctacccccaaacctccacttccctggaagccatcttgtcattctctgatttccctgctaagctgcacagtctgccctgtgtctgtaatgtaacatttgatccttcagctttcctgtcatcctaannnnnnnnnnnnnnnnnnnncttgccctgctttagggaaggttgccccatctaccctgtgggagctaaccacatatgtcatgctgtctgtactctgaaaccacaatctctcagttctttaagggctcatgagacagctgctcctcaaaggactgaagggagcaccacatagaaggacccaacgtgatatttaactcctcagacccatatgaggtcctcatcagacaggacttaaaggtaggcaggcagagtaagtgagagcacaaatgtggaataagctgtgaagaacactgggtgatgatgctcttgcaagaagagcaaaataacattgcttcctccaattaacaagatcattaccttacttcagtcaatctatgttcactgttctgaatttaggctgtatggatacaagtccccaatcactcatacagtattacctgttggcacatataatatccaagcaggcatctttctgtgtgcttgtgtgcattctgcctttcgcacacacactacatacatacacacgtttgtaaaatttatttccttgcccatagatttgctaaaatttcttgagatgttatcatttcatctttgcataaccagtcatgttgacacaaagtgacagtttttctctagtcacaaaaaggagaggaaaaaagtccccctaaaactcattgattagtatttaataaaattgcctaagctctgatatagtttatactcagaaagagcttagcaaagaaccaaagcaaaagtctttgggcttttaagatttttgaagtgtcaccattatctctgagatttattctgagaattgtcagtgccttaaagaagggagacactgttgtctacagggttaccagtgttttgagctggtcaggtgtgacctcaagatggggttgagatctgcgctaggcagaggggtgacttgccttgtgtgtgccaaagaggaagctgtgctttgaaggagagccagagcaacaactaagagcatggaagctcagagagaagtgctggtcgtgttgtccgttacaattaacccaagtctgccttttagctattgtcttaaggaaagataaggttgtggaaaatacttagaattaagggggggagggtggcgcacgcctttaattccagcacttgggaggcagaggcaggcggatttctgagttcgaggccagcctgatctacagagtgagttccaggacagccaggactacacagataaaacctgtctcagaaaaaaaaaaaattaggggggaataaaatgaatggaaaacaaagggaacagctcacgagggtgtgtgtgtgactgaataccgaggacattgagctctgagagagggggagtagctcagaggtggctgaggctaatgcccttgataacaaacctgagggaggagtcacccgtgctctttctctgcccatggttggccttttgggggaagctcactttctctggatgttggaatgtcgaggagctgcagagatgagcttcctggcactgctgccgagcccgtgacatagtccacctccagccatcattcaagaaatctgggaagaccccagacagcacagagagcccttcacacagcagtctgcagttcaccctgccctcagcacacagcagtctgcagttcaccctgccctcagaacctctcgaggcacccgactctgggtgctcagagaagaccagctgcattgggaagctaccttttggagctaatggaaagtgcgcggcgtctgggagggcgccggaagggtgaacattctctcacatttggaactggacatgttccagatacttttctgtcacttttcagtaattatttattcctcgtgtggttttatcaaaggtagtgatgtcgtgtgtaagttactgtaagagctaaagggaggcggatgtgtgggatcttacactcgggatcactagctgcatagcaaataaccttgtaatgaaggggtgtgtgcctgatattcttcctcttagggtgcttctagaaatagcccacactttgtacccttcagctgaagggactttcaggctttaagttaagcctctttattttgtggctgtgctgaattgagaaagagttgagtcattttctcaaaatgcttcaagattacatgggaagtcagggctctgtccttccccggccaatgggtcctaactctgccctgtgccctgcatcccaccccacagccacgtccttatctgcctgtgtgcccatctgtgacgctgctgtctgcagtccttcctctcttctctgtgcagtggcctgatggcctttccccttgagagcccctcagttggtgcccagagcaagggatgctgagcgctcagcagtgcttgtccattaggacaggtctcttctctcttcctctgggtcgttggccatcttcgttgacccagcccctggctccagccagaccaatgaccctctctgttgtgtgccgggtctttgatttagaaatctgtgactctcttcctcccctgcattgttagcatggcgttcagtaacacttctttgggaagcagctgccctgacctctactcccgccttcctctccactccacctcaggaaggcagagtattattgaggttgtggcttcgtgtctcactcctgtgaagttctgagagtgagggtgtgtgagggcagttcttacacccccaaagatcaaaaagaatggccagatctccactcacaagtccttgctctctgtcaggagacagcgagcatgacagatagtaatggctcctagtcagacctctgtcttggagcgttcactgaagccaaggtaggagcccctcagtggctaaagtcacagctgtagctgctaagtttaaactcggctctttgccaccagaaaaatcacattcaatacaggacgaattatccctggttcctgtttctaagacagagataaatggaagtgggtggaaggcaagtacaaacaagaaggtatttcagaactttcgacatatacgtactcgcttgtgtctgagaaagagaggaagataggtggacttaaatgaagcactcattaatgtatagcatgttttaaggtgaatccaggagagttgagtatttgggggtttgttttatttttaagatagggtctcctgtgctcttggctagcctcaaactcactccttatgggtggcggctggtcttgagctcctgatcttcctgcctctgcctcccaagtcctgggctgaaggagtgtaacaccatgttctctaagtgaagattttataaagggtttgctacttgaagggcgtgggggcgtattgagacagggtttctctgtatagccctggctgtcctggaactcactctgtagaccaggctggcctcggactcagaaatccgcctgcctctgcctcccagatactgggattaaaggcatgagccaccactgcctggctgagtttgctatttttaacagtatttcagcaacaaaatattttgactgctatttcaactgaaaagaattcgaagcccagcaaagctttatgctgctggtttaccttgtgctgtttttaggatatccgacaatatgctttgtacccttgctggactaccagaacaccgagtgagtctctgtacctccgcagcatgcagaaggttctgcatgtgtgatctagtcttgtaaccatggcgaagacagcacaagcagcccaggacagacagaaggacattgcccacctccaaaaccttagctcttactatgacaaagagaagggtatccctttaaatgctttcatttcttggtgactacaggtcaggattaggaactttgcatgaacatttcacatcacagaagtgctgtaggctgacctacagtagttctctagtaaaagtctgccatgcatgcttggaagtcctggagggagctcagttgtcacagagtttactctgctaggtgactgataacaacactaattaactctaggaagcccgccaaaagcttataaaaggacttattaccacagccacccacgtatcgtacaagcctgcaagcaaggctgctttgtggaaccgtgtgccctagcagttctaggttcacaaagcaccattaagccccagagacaaacactctgagatactagaaagcacacctcaagtctttacatacactgtaacagaaagcagacatcttcaggcaagctcaagaaaataatttgtacatttatctttctgtgggctgatgggcagggtgggaatggcatgcagtgtgccggcacctactcagagagtcagagaaggacttggcagaaacacttctccccactttctgaatgaagcgaccacagccagaaaccttcagcaacttgtatggggctgagcagttctaaatgatggagcctgggttttaggactgagtccaagccctcccttaacattatactctcctacactccgggtgacacccttacagagagtgccaccacatctacgacccccagccttctttaaaggaagtccctttatggcttatattttgttaggcatttctcttaacttctgctcttaccctggaaattgagtttttaaatctccacatataatctttgttttacaggtttttttttttttttccaaaatttttagaatataaatgtggaagctcatttagcattactggtcacctaataatagaaaccaaataacaaattttatttttcacttaaaatagttggtctttagaatggttttgcttctgaggcaggagagcccaggctgatcaaacatctttgctggtgggaggataaattgataaaatatttttgcaaactagaaaataccattctatatctgatgctttagaaaataagccccttaccccgggaagtctgctgctgatagtctatcatcaaaactactttcctgtacataaatgcacgccaggtagtcaaatgcaatgaatttttaaaaattaggttaaatggttatattgtatataaactacatccaaatttaggaatgctctgcctcagcaccattgttcctttctctttatagtaaagaatcctgaaataattgaattttgaaattcataaaatgtttcattcattgcttccatctcgggagctacattgagctgccagtgaccccaaggaaatctaaacagacagttattacagctggtatctagtacattattttactttgaaacttaggtttttaaagtattccttaacttaaagagaatcatgtcaggtacttacatatcagaaggtggctaggacctccgttgtggcagtccgtgtttgctcagaatggagttagctaagctgggcatgttgctttaagagtgatcgagcaggcgtccttttatggtggtgcctttttcctgtcatcctgtgactgagcatagccgtgatcagttaacctcacatatgctacgtgcttttttttcaaatgggatgggaagtgagattttttttctgatactgatttttaaaaactgttcaaaagccccttggactttgtgaaatgctcatatctatggaacttttaaatttttttcaataaggatttaagtcttaaaagtttttttttttttttttaagcaataagctttaaacagaaagagggaggagggagagagataggtatagttactggtgaccttatgttgatattttacataaagtttaggttaaggaaaaatgtcaagtgtaatagtgctgtctgcctggaggcgtggtggtatcaggagtgtagtgtagagtctgaacctgaacagctgtgtcaaagatgggtgtctgtggtgagggagaaaggccttccttgtgtgtaagttagttacattttcagtgtcgagaacaactgactgactcagtggcagtgggcacagaaagatctaggacagttggcagacacgttattgaagagttcagcctcaggtacatagtaccagagagacctgttctagtcccatgatgccttgagctcactccttgaacccagcaggtactgcgtagagtgctctgagcaagccagagaggtggcagtcacccatgcccacctgtgatctagcctgccatacgtgcgtgctgcttttggaagacaggcctcacttgtgctgcgcctgggtgttgggggacagggattccatgagcagagaggcttaagcctcccaggactacagccccaccttcctgcagagtggggctgtacactgcttctgtcacccatccttattcagggaaatagaagatgggtcaggggatgggggctgcagcagattttcaagccaaacctgcagacagctctcccttgtttaaaatggaatgtgctttaaaagaaaaaaaacaaaacaaaacaagaatgctttggtaaactggttgattttgagggatgctatagagagaattgagtcattttgataggaatctgtagctttatgcccccagaggccttagaagtttttcaaaatcacattttatttattttgcatgtatgtgttagtgtgcttacacatgtgctatatatgtttatagcatgtgtgccagggcatacatagatcagagaacaacttttagggacagattctcctcttctgccacctggattctagggattaaaggcttggtgacaagtgactatcttgcagcctaccagaggtgggtgtcctcttggcctaggcttctgtagaattgcctttcagttgtgctgttgaaggtctgcagaggaaaaccaaagagcaagcaccaagtcagtgggattcttgggcacccacttggttatgtataaaataaaggcaagtgagagccaaggtaagtcagccttatgatgtggattcgaagactttgtgacttgataggtaaacttggcataacctagaaccagttcaccttatacacccaccattgagggctcaggatgtggccgagtgcagagagcattagcatgtgccaggccctggcttatattcctagcactgcatataagcaagatggaattggcacatactaggaatttccagtttgttacaagaccatcctagtgggatactttttggaagacccagctacttaaagcaagttttatggcaagtaggatccatcatctttttttttttttttttttttttagatggctggcccaggattcatagagatccgcctgcctctccctcctgcataccaggactaaaggcctggtgggtccaccctttcaccctttcttttgtatgagaaataatctaagaagtgtatgaagaagcctgcagatgctgctgtagctgcatgggagaggaaacgctaggcctgttttgttgttgacagttgtttagcagtggtcatactataccagtgaacccagtgtcctagaagtgaggcagacatctgtgtgaagtgttttctttgtttgctctctgaagtatggtcggtcttgagtgtatagtaggtactctgtaactagtaaggatattaaaggaataagttatctactgactgattttcttgtgtgcttctagctctttgcttaagataaggaggctcccagaagttagctgttgactctgcgtaaaaggtcactgtgaatgattgttgccagtgtaaagaacagatgttgtcagaaaataaggaaaagggaaaaactggtcagtgactaataacattatggtattttgtgacgccttgcgtatatagaaatagcaacacaaaatttcagcaaaacaacccagagagtcctggtttaaaatgtgtgcctttgccctgttcccacctgtggtctcctgtttagtcatcattcgaaatgatgcagtgattagtgtctaaggactttttatacttcttctcttgctggataaaatacaagctgtgggcactgaaattattgccgtttattttctgggagggtggaggttatgttaaactgtgacctcaagcaagagctgtgcttctggctatttagtaaatggtgttttatgttgcatttgttgatagatgtgaagagaaaagctcctgtgagtcgagaagctgcagttgtgcttgggggaggggagagggcaaggggaccccagtgcaactgtctaacaaagcaggggtttcttttttttttaagatttattttaattgtgtgtgtgtgtgtgtgtgtgtgtgtgtgtgtgtgtgtgtgtgtgtgtgtgagtgaatgccatatatgtgctcgtgctcatagaatctaaaagagggtgtgtgattgtttggagttggagttacaagcagttgtgagacatctgatgttagtgctggggactgaactctggtcctgcagtgagcagcaagccctcttggcacagagtctgtccctagggtttggtatttcagagaataccgggccgttgtcttggtatgtgtgttggattgtttgtttgtttttgagacagggtcttaatatatagcccgggctggtttccatcttgcagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctggtcccacccacctcttgcctgctacccttgcaacctcccctatagtaaagtaaaggaataaagataaagcaaaacaaacaaacaaatctcgtcctaaacaaatctcgtcctgtcacagtatgtctcacagtacaccctttgtccaaacctctgtatttgcagacgtcgttcattgcctgagtccttggactggttcaaggcctctggcttctgctactctaacaatactgaatgacggtggggacctgaactcctcttggatagcctgttgttgccctgttgtcatggagatcccgcagctttgggggatgctccaacagttcatagatggagtaggtgttggggtggaccaactcaaagccctgggtctgggcctgggtggtagccaggttggttagcctgccagttctccagcacccatgccaccagggccaggcgaggtgcagggagtgctggagccatcgaggggtgggagacagggccacctctgtacagcccttggacatcaacatgttcccaggtggcagcccagaccaggggtgtccacgtggtctttggtggcgacatggaccgtggacacatacatggcctcattggcagcacaggctgggactccaccatggctgtatatgtcagctctggctactcagaacatgctgtttccctccacacacacacacacaccctcaagtctttggttccacctctcttcataatgctcaaaccattccacttctctttctgtcccacctctccaccacatacttgcacatggtgtggttcccctgtgagcagccactacatggcaggcttctgggtgtcagtctgcctgcccatgctacgtgacagcaggccactgttctagcgtaagggaagattcatttgctatacacatatgtgttgagaatgatcaactctgcaaagtgagaaaaaggcaccaacaaaacagccagagttaggcaggcagtgagctgtctcagcccagtaacctgacttcagtccctggaacccacagtggagagagctcccagagctgtcttctgacacccacgtgctctgtggcacacactctccctcctccacaatagcaatatttttctaaatatttaaaggccaacatccctgtcttgtctttgtgttctgactgggaagagaggtgctgtgtgagtggaccccacagattgggaggtatcaggggaaagctgggctggtagggaacatagaataggatggagttgtggtctgggagggcttctctgctctgcacaaattgctgctgtcggagttgaagaacagtgtggtgggaacgggcaccatggggccatgtttgaatttgggctttactgaggtacggtgcccttggagggtttaaggctacaggtgactaatttgttctcctgaatgaaaagaaagcacagctgcctaatcaactgtgtttagggcagggttaggcaaaatgtagttcttttgtatggcatttagaagttgctttgcttttaatccacccaagagtcatagatgcaggagatggaagtttgatgttcatccattggccctctgagaagatggctgcattgcagtacccagaatgatgttccttcagctgagtggacagctgttgtttgtcacttcttgcacctttatgcatattttcccatgcaagtaattcatggttcatagatattgcagctgggtagaactgtttaatttcccctccccctcccccaagcttggcagcttgcatagtattttctagaaccacagaggttagaccacaagaaagaggctttcaggtcagctccatcccaagtcacctgtcccagtgtgtcctgtggtgtcttccgcagtagaggctcagcctcagcctctgagagcagcccagggctatgcagataatccctgttgtcctgggactcacccagactgccctgaccgacccttctaaaggaggtttcttaggttttattagtctatggttcttgtggagagcgttgtcagcccaagtagcttaccttccttaaagataaatgtgcccctgtgcgtgcatgtgtgtatgtgtatatctataaatatacttgtatatacattgtatataatattaggtacatatgaagtattataattcctcaaggctttatcaaacagccttaattttatttgcctcttctgttctgccgtccctccctctcctgcagttagaggtctcccagcatcgttagtccacactcgagtcatggctcctgtgtccagtgtgtttgtttgttgttgttccaattgctctggctctctggggttttctggttccatacgaattttagattttttttttctatttctgtgaaaaatgttgtgggtattttgatggaaattacgttgagtctgtacattggtttaggtaagatggtcattttcataatattaattctgctgatccacaaacacacgatgtcttttcattctctagtgtttctctgaatctcttccgagatttgaggtgtttgtttaggtcctacaccttccgaggtgttttgtcgtcttagatgctcctgaatatgggagtatgtctgtgatatcgttttctgtgtatggttttggtgtatacaaaagctgttgggtttttttacgttgcttttgtaaccggccacttggatttcatgtatgatgtcatctacagattgagatgtcttgaccgtccttttcctgctgaccctttaattctctcctgacttatcgctgcagctagtgcttgtagcaccgcattgagaaggagtggggctggtgggcagcctcgtctatcgcttgatctcagtgggattgcttcaagttcttctctcaatttaggatgacactggctgtgggtttgtcattttcagcctttagtattttaactctctggggacttctaccgtgaaagcatatttggttttgtcaaaggctttttctgtgtctattgagatggtcatgtgatttttgtctttgtttaattatgatttattatatttataatatgctgaaccaactctgcatttcccagaaacagccaactttaccatgatggacgatcctgatttgtgctggtatttgtttttctagtattttattgaggatttttgcattttttattttgtgtgtgtatatgtgcatgtatatgtgagttccatttttgtcatacctgttaaagcagttttatgtttatgttctctgtctgtctgtctccccctgctccttgtttgtgtctgtagtggttttgttttcaatattataattgaaaagagagatttgtgtcatatagttgctatcagaatcagaaaatgtacaaaagaccaagagggatacagtgttatgggggcaggggtgtactgtgtgaatgtttccttatacaagtgaaaaatagttcttgtattttcctcattatcatgaaatagtttttgtataggtgctgcttctaaaatgagaaaatattgacctaccaagtgtttaatgaatatggttacaaggatatgcccaaaccattctactgttacacatacatgggggtgggggggagaaacagagaccacgacacagacagacagacggacacacagttcatgcatgtatgagcacatgcatacatacgtgtcaggagcatgagtctgtagtgttggaaggagctccttgagctgagggtctgcttcttgctcatggtgcagacggatcgcatcctgtgctgggtaccttccttaatatgctcagtgcccagctgattcattagttcaccaaacagccaaactggtgactctggggccaaagaggaaagctgctaaccaccaggagtagtcagagaaagccaggtagagctgagcagggccacgtgaggcagctctgggtgaaaggataactcgtgtccatgtgtaccacccagtggggcctgtgtccagcaagcagctgtcaggctgtgtaagtaacttagggagaggaggggaagagaaagggagacagcaagagcactcccaggtggcccagtgacttaacagacacctgtcctctagcatgggcctaggacctagtgggaagaactcttgttttcccatgggggttagttagcagtgtgaccctatgatgccagagaagcatgggtagagcacacgtgactaattcacatatcaaagggaaggtgtcgagttgtgttccacagcccagtgctgcctccattaggaccgacctcatttcccaagttggagccacagagagcactgagattgctcaggtagagacgagagcaagaagaaatgaaatgagagagtccccaagagagctgtggagggtagcgtggtccgaggagcgcttgagagccacttaaggaaaagagtttaagacagaaagaggaagaagtttgagggatggagagcagaagtagtgaagatgactggccagtgtctgacgtgacatgtgcttgtccgttcgtgggaattgaacagagcatccacttccagttccacagtgcattatatttaattaggaggtgctcagctacctacctgtgtcaaagtgaaagatgggatagttgctgccttaacgtgtcgtgcacacttgactgctgttttgcctatggtggatgtttgaaaaccaacgtgtgtatctcacactgaaatgaatatgtggcgttgctcaagtatctttctgacagtgtttgaatctaatcttacagtagtttttctctgtctgtttgcgtagcttggcgcccgtgttcgctctctttgttccatttcactgctccatcccaagagtccaggtggcgcagatcctgggcccgttgtccatcacaaacaagacattgatttatatattgggactacaggtacggtattcattttatgttcacatttctctgaccagatctgggtacttttgttttttgttttattttgttcttttctcttttgtctttttctcatttgatctccttaaaccattttcccccataagcttggcttcatgatctatatcaggtgttcagaggaagggttacagggtaagaacatcagagaatggaaggtactagaacacattcatagcctttagaaatctgataaaagctttcactgtaatttgtatcagtggaaagtatacattcatttaatcttgcagttgtaactacatttaagaatcatagtttgaaatggaaaaaaaatgagaatagtgaaaatggaaaatcagtgtcattgtcaattattatgtactgtgccaccagcccatccaagctatggcgtatgcaaggagcattagcaagctgagtctataaaaccagctccagagtctggggcaggaagattgtaggttcaagaccagactgggctagggaatacctcagagcaccctagacaactaagaccctgtctcagaattctaaaaagacagacagaactaggaactgaagaggtggctcagtggttcagagtgtgtgctgctcttaaccatgtgagggcccatggagttcccagcacagctcccagctcccatccacactcgccgggcagctcataactgcctttactccatccagctccagacccgacatcctcttctcacatctgtagatacccacacccacactcacacagagatgcacagacgcgtaatttaaaaggacacaaatcatgttttaagtgagagcagacctagggacacctctcagtggtagtgtgtttgcctagcatgtccaagaccccaggctcaatttccaacatgctcccccttctgcaaagaagagaaggcagaagcatcactcactctggtgcttttgtgtagtctgccttgctatgagggccactggagcctttgtctgacttagtcatctccctaatatccagcctgtgcccactgctccctcagcctgaggcctgtgttagaaggtacatgtgctctccagttttctgaaacgtttttctttgaattgaattctgtgtgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctctccctcctccccctctcccccttcctgtctcccctctcccctcttccctctggtgctggtgttacattcatacatcactatgttgaccttttctgtgtgctgtgggttctggactcaggacttcatgcttccatggcaggccgtcatgctttcatgcactgagccgtctatgcctgcccacccccaccctggttctttcatacatatttctctggctttctctctccccactgtggacagttgaaaccaggaatattagataggcggatggatggtgggtgggcaactaactttaatcgttgtaagagccagaatgcgtgtttggagacacatgtgcaggtcattggaggatgacttacagagtaagtgtgaggtgaacacttgcccgcacagaggcatactcatacccttccagagtgcaagcagaaacttggaactaagatgagcatcagaaaccaaagaaattattatttttttactgacaaaatgacaggttggtttacttgtgtatgagaggtgggtgggtggtaagcgcagagacatagggcaagacaccacagtcacacctcctgttactgcccgatcgggcgaagcactcagggtaccctcctcatgggccgatgagaaatctgagtcaatacatgagaagcttggagagcagtgctttgactagaatgtgacagctggttttgggttcccctcttacaggagagaattataaagtccttgtcatcttcgttctcacctgtgttgtcatgagagttgggtgtttgtaaaatgaattcataatcctagctagcctgtataaaaaacacataatccaggtattttacttataagccttatgccttgattaggcaggattggagctattctgactcctcagccataaggtccctgtcacttgcttgctgtttctcctggccacgtgctcatggtctatctcctctcatggtggcctcctccacctctgtctcctttcttcttcttctccctctacccgcaaacccctcactcaagtcccacctttctcccaccacagcccaatcacaagctctagccttttattgaccggttaaattggggagcaaggttcacatagcagcatcacttggtgtatgtgaggatctgcttgtctggggcaaccacatcttgagagccagtacttagcattaaaatacaagcagtgtcagaccaacccactatatttcccccttttgcctaaatgtccagtccatttatatttggcaacttagataaagtattctattatccatcctgtcttagtgagttcagagttctgtatctaagtcattttctatcctaacttgtattgccatcctaaaaacgtcttcttagacctagaccatcttaaatcctaaacaacttaagcttataataaggctatgagtatctagtcttcaaactctgtcatcagagacctaagaaggaataaatgttacctgagtaagtaggaagtgcagacaagcagcttctaagacagaattgacagacagctgtctgcctggacagctacccagtaatctctgtaaagttggagcatccctcttcagccttctggcccagtatgtttgacagaccttttgtaaagcaggaattatgaaggactttcttaccctgtcttggcagagcttggcacttgactttcctgcatcgtttgtcctttctggacagcattttgtctgtagttgaagcaagggcatttcctttgcccagtgcctagcttgccacaattgaagcaattccatatggaggttctttgatgtgtttcatcttacaagttgaatggggtgctacaaggagctgatatgtctcaatgtcaaaaaagccttaagttaataaaagcatcgttaagtgccatattctgtgagtctctgccacttttgaagaccatctctctattcatagcatatttgaacaaacaaatgttgccagctacctatcatctgttcaacctaggatgtatatttctgtgatgatctagattagtatctgacatcatcatcagtttgactattaacttatatttcttaaccatctctaatagtttgtaatggcagctgctagaaggactggagctttacattgtatctttaaagatgatagaggaacaatagctcatattaaaaactgaaaatatatgtacattatgaatatcaaaaccttaaatttgtatccatatacaataatctaaaccagtgtaacctttaaatttgtatcagtatacaaaattctgtaccagtataacaaaacctcaattttgcatcaaaatacaaagatctataccaatgttagattatggttataaaatgttttttgtttgtttgtttgagagtagattcaataatatactccccctttttattatttttagaatattactatattcccccattttcttctcagcccactctcccttatctaaggaagaaaagatagagaaaaggaaagggaagagaaaagaaatccctgagtctaacctccccattttgtttcccccttgtccaagaccataactgtttgtaaccattcccttaaatgacgagacacatcccccatccaatgaatggccaaaattcctctaccccacctcatgggaaacaggcagagttttctttcttaaaattgcttcctgctgatttggggcatagttttcttttggggacctaatgaaaatgagacaactgttaagtcttaagaaagccagcaatagcgtttgttgtccagtctctgtatgctgagaaagttcagatttaagtgaagtcctgactggatcagccttcaaggctggacctaaagagctagctgtttgggagttgccctggaggcaggtttttagatgaaacagcattgatcagtctgaggtaggatcaggtaggacacttgtcagcatctcagcatccctgagggtggatctgattggtgttgtttttttttttttctttttctttttctttttttcctgtgaacataaagctttcagagatagaacatattactgtattaacataatgtgtggaatgtacagtgtgtgtagatcagtgtgtgtcgatcagttaaagacggttttctcctctttgagcatatgaaaggatggcaggatgaatcccgaggacgtttgtagccaaagatttattgactatgcatagcgaagttatggctggagacatttttatgacccaggcagtttcagacttgcttcatttaaagggatcagcatatacattatctatgttggtccttttgatttttttttttcttgtctgtagccgagttcttcaggaggtctcctcatctcgtatctggtttttatcaatttgtaggcacccaaagcttttcttttcctgtggaaataaatacaagcataacctctccaccagtgcaacacattttctgttttccattctgagggtagggcatctttaaagtatacaggctggtttagttcagcagtcttttccataatccagtatctctagcagctatcagtatcagcagttatcattagcattcaaaaaatttaaagttaataaagtactatgtaatctctctctgcaggcctttattaccctttttatttgtacttttaaagtacagttggatctctccaccattgattttacctgcagtatgttttacatcataatatgtaaaaacaaaatcacttcatgttactaaagacatatgctggagcattgtcagtcctaatttgtcttggtgttcttataatggccataacttctaataaatgaataaaaacagaatcagccttttcagaagctaaagtagacgctcattcacaaagcctgaatctgtgtctataatacactgtacatatttagtttgcaaaactctagaatgaaacacatccatttgctgatttttattcctttgggtactcttagggttacttcctgcaggtaatggagtttgggtatataatgagcaagtaggatatgtctttacaatcttcttggcttcttgccaggtgataaagaagtctttctttaaatttttgctgttgataatggtatttttaaagtgaaattctgagcccctaatgcacttcctattaatagctgatcaatttgactattaacttgtgccagagggcctggcagacctgtatgggatctgatgtgtgttatatacaatggataattcctatttctgatcacttgttgtaattgaataaacattgaatcaaattcagaatcatcctgaataagttgagcagtttctatatgcaagacaactctttttgcatattgagagtcaattactatgtaaagagattcttgagaatccaatagcaccataaggattgcatttaatcctgatttgttagtcaggacactgagccaccttacttacacttgtctgagatgcaccctgccttttcttgtttgtgggcatcagtatggaatgttaggggctccagaaattggggttcctttttttatacgagggagaatccaattaactctttttgtgaactgaagttgcttgcttttagggtatttgttgttaaatctcttcctaaaaaaaaatcactgcaagctctttgccagtgttcatctcgcacccataacgaagccctcggtaagtaatgaagccttggtaaaaggtgccacagtctcagctggatttgtgtcacctagtgacgaagtctcatttttttcctttagtatctattcagaaacctatataagtttttaatttcttcctctgtttatgtgttaaaaatatccattctaagatataaccttccctttgcttgagaattcctgtaggggaatgagtagaaggcaaggtaactaaagtgcaggccatctttggatcaatatgatctagatgtgtaccctgtaattttctttctgtcagagccaactccttttcagcctcagctgataattttcccagtgtatttaaatctatatttttaaaaaaagatttatttctttctttcatgtatatgagtacaccattgctctcttcagacacaccagaagagggcatcagatcccattacagatggttgtgagccaccatgtagttgctgggaactgaactcaggacctctggaagagcagtccgtgctcttaaccactgagccatctctccagcccaaatctttatcttcttgtaagaattgaaataaattgcttagctctagaatagccaaagcaattataggctgcagctggttagtacctcctcttagtttttggaattattaagagtccttgattggtctctcctgatttgtatcttttgtggtctaaccttttgtagacttatttttatgtccttgataattaatagaatcttctcttttgtattttctcaggggcaatttgtaatccccaacaaggcaaggttttctttatttcatcaaacagtctttccaaggtatctgtatctaaatcagccaataagataacttccatataatgacaaattactgattaaggaaattgattatgaattatctacagtggctgttgtaggtacaacaaaaaattggcactaggtagaactgtttcacattccctgtggtaggactttccaatggtatttctttattagaaaacttctagtaaaagagaaagcaaacctttccctatcatgttcatgtagaggaattgtgaaaaagcaatctttcagatcaatcactatgataggccattccttaggcaacaaggaaggcaatgggattgcaggctgctaggaacccattggctgaataatcttattaattgctctgagatatgtcagcatcctctatttgccagacttctttttaatgacaaatattgaagaattctaagggctgtatggtgagcctccaactgctcctggatgagctgttctagtagtcttcttttgtcagagaccattgttcagtccaaaagtggtcagtcaagcacctcagtggtaaggctgttggcgttctatcagcgtcggctcccagtgtaaagttgacgtgtcggcctctgctctgtcttgtttatgggcagtctgcaactgactttgataacatttcttaattaattaaatttcttattaggagcatcaactactttgtgtcttgcctctaaagttggagtgatgttaatctgttttccattgttgtagcggatctcttcctcataagtttatagctatattggccacacatggccttaattttcctgaccttcaggcccagtacatttcagccatctggtactttgttttatcccagataacgttccaactccttgcaattgaatatctacctcttgaagtgaccaatctggaggccaagattttggggagagaatgatgtctgctctgtgtcaaccattctttcaatttcaatattagcaccaaatgtaaaatgaatttataattttagctaactgatataaaagacactcaatccaggtattttatatataagccataagtctaaattgggcaggtttggagctattctgactgattccccagctataaggtcccttgtcacttgcttgctgcttctcctggccatggtccatctcctctcacgatggcctcttccacctccctctcctttcttcttctccctctatctcccctcactcgatcctcaagtcccatctttctccccccacaacccaatcacaagctctagccttttattgaccagttaaattgggagcaaggttcacatagcagcatcacttggtgtatgtgaggatctgcttgtgtggggcaaccacatcttgagagccagtacttagcattagaatataagcatcgtcagcctaacccagtacaggtgtgcactgacctagcttccatgccagaccaaaggttaagtgacagcagcagccacagcttcttccctttgtgtcaacactggagcaaagtctgcagcttccttccctccatgtctgtgtgtgttttgtgtgtctggattacatatacagaaccatgaggtttctatctagcacattgttagcagtgaatctgagctttgctatttcagtcttctgtgtctttctctatgatcctgaaactcccaacctaaccttccaaactaagcaagaagccacaggacatttcaatcatatggggacacttggagtgccttgtgatttttgttttgttgttgttcttggtttgtttgtttttttttttaagaaccttgagcacacatctctcagataaaaatgtgtcaatcaaaagaagaaattgtagaagttgggttcagtttttcctcctcaccccatgctcccagaaataagactcagactcaaaatatatttacaaatactttagccatatagctaggctcttttactagatcataactaaaataacccatttattttaacctacattctgccgtgtggctggttacctgtgctcaggtaccatgtgtctatctcctcagatattccccaggtggatcttttccacatttggctctatcccagaatcctttctgcctcctgaacatcccaccttccatttcctgactagcttataggccatgggctttttaattgacaggtgatgcatccatacaacacacaagatactctctatacaagaaatttcatgaagtctaattccaatgcccttcatacctctgcatcagttaaaactgttcccagtagcatactctttttttccccaattttaataagtttaattttttttagcaaaacatattaaataaaacaaaaccaccacaacgaagcaacagagggaaaagagccccaagagaagtcataagaattagtcctattcattcacacactcagagtcccataaaagtactaaactggcagccataatatatacacagaggacctggtgttgccacttactcttgtcttgggtgaactagaatgagggttctcaccactgaagaagggtacttactgttgggtgtggacttagatgctggcaagttctcccgtctaagtgtagacaaagcaatgatgagaaattaaaatgaggttatctgaagagctatggtggatcattacctagcactgagaatggacaatgactattctgcattagtagtgcatttatctgtgatgttttcagtaagtcagctacggtgataaataagaataagcctgagatccaggtactttcctttgcacagcaggggccaggtcccacacctgtgtcatcagctacagaaagtctggagtgtttaatgaacagagtcctgtcttattttcttttaaataaaaagagttgccttcacttttaaattgcctccctgaattatggtgtgcatggttaatatctaactgtggggtcacatggcgtgtgtgcagtgagtgctgtggctggcggtgcacttcattcatttcggttgcctttgttttcttttgtagcttttcacctctgggtcctacatctggattgtagccatgagtggacttgtaagtgtcattttttttaaacttccttcccctgatttcctctctttattttttgaaaggaagaaaaatagaaaaaaaaatgtcatgcttatagattgtgggtaatacacacccgtcttcctccttcctttgcccgggtcaggcatagctccacacttcttccctggtgactaaaatagcacaactacacagaaaatcaaagtcaagtcaaaggaggccgggttgtctcagtttccaaaagttactttgatgaaggtttttagatgaggttttttccagagttggttttaaagggcattagtagcctaactcatagtaagagggagatgacagaggaggaggaggctgggtgggctaagcaggggagctgctctgcgatctccactgtgtaagctgcactgttggggagggaagcaggggaagatgaggagacttgcaggtcaggtatgtgtgtggccagagagggaggaagggagcatgccagagcgcttatctgtgcaggatttcccttctcactcctatgtccacagcagttccttatactttaggagacattttgaaagaaatttagagcatgtggccaagttggatgcttcatgacttgaatgtaaaccataaatttatgaaaattaatttgtgactagtgtgtatagaaaatagtttcaatctctttcttgaaaaaaggtctaagaaaattacagaatagatttataggactatgcccgacgtcaaaggggaactcagaagtaactatgccacactctgcagactctggcaccagccgcctttgttttctgagggagtgattaggccaccttgagttgtcctgagccctctcgtggctcttttcaaaccccgagttaaagacattttagagagaacacagtcattcatttccctcagccccagattttgattctgtggatcaagaacaaagactgtcttctccttattccattgtttccctggagccccataacaaggtgcagagctctgagacagctgggtcttcctaccctcctcatccccccacccctcactgtctcctctctcctctcctctgttcctctcccctccctcctttcctctcctctctcttcccccttcctctcttccttctctcctcccctgccttcctctcccctccctccacccttgatactgggttttattctgacccctgtttctcctggagctcatagctgccccatgctgccatctgttactcttgagacccatggtactttccagtcattctgggaccagttttgcctccaggccacgagccctcctcttcctagtgtggctcatccccactgaccgcctggcagtgagctctgcacttaggcagtgttatccatccgaggcctactccaccctaagtggtgatgttctaaagcatgcaggaacacgagaaccaccttttaatcaagcaaggtttgcttttcttttatttaataacacattgtgatgcatttgtgtaagatgtcctatttatgttcactattctgctgttagacttctggtggtaaattacgtgctcgctgtcacctcagagtttcgctgtgtgaccgaccgccaatgctctagagttggaggctatgtctctcaactgttggtctttctggactctaaagtgtttgttctgaagtcactgtcctttccagtctgaattttatcagagggtataggtaccaaagaatttctaaaataaaattattttttttccagaggaataaaaaagcccacactgtgttcaaaatagaatttcaaaatgactgggcattttaaggaatgcactatcattagtcattcgtgagccaattgaattttctttcacagtaattatctcaaaattatatatatatatattttttccccagcttatagataatacactgtttatttctgatgactgactatgagctaactatgtatggttgagctcatatctggcatttgcaaaatccctcacaccaattagttaattaacataaaataactgatatgggtactgattgtagctagttttcttcatgctataccagacacggtggtgctcgtttccgacttactgtgttctctttggctttatccagaaagcccacactcttatgatatatgtcatatataatatggtgaaaagtaaagatgattatacaggggtatttaatttataagcagaatgtggtgattcacacatatcatcccagcactcaagaagtagagacaggaagattgtgagttcaaagcaagtctaggctacagagtatggtcccatctccagcaaacaaaacaaagcactagcttgtgtgaatgtctggcttgtcagacactatctgtgaggtccatgtcagtcacaaagccaccatccgtccagatgcctcttactcaatgtgacttcctttttccctacagatcagctaacttcctttttctttttccttttggttttaatgctaactaaaatacttcaaaagacaaatttcatgctaccaggaagaaatgtgtacatagtattcgttgttgtgaatttataatacaaaacctatgactggggtcaccgcagtggcttggtagataaggtactcgctgccaagcccagtgatctgaggtctcacattatggaaagaaaagggagaacaggccttacgagttggtcacacacacatacaccaagttattagctgtattgtagatatatttttagacttttaccattggaagctatcatgtatcaaaaacactgtgtttgggaaatgattttatttagctctggcaattagtatgtggtttgttttattttgagggcaagtgagcagggctgaggatgtagctcagtgacagagtgcttgcctgacgtgcatgaggtccggctttggtcctgtctttagtcttagcaccaggaaggaaaatgtgtggaaacatcggttcttctcagcctgtgggtcacaaccctgtttgagggtcacagaccagatatcctgcatatcccgtaattacaattaccattcataacacagcagtggaatggttttacggttggaggtccctgcagcatgaagaactatattgaggactgcagcattagaaaggtcgagaagtgctggtgtaaaatgtaaatgtgtttgttacttgcagtcctagaaaccagaaaccacttgtactttccaggaaagctgctaactttgctttgagtttagttcattataaattgattttttattttattattttttttttttttagtgttaacagttttatctcttttgtgttgtttgttcttacatgagtacccatgtttctgaatacatagtcctagaatatccagtgattagaaggacaggttgacaccaggatgctctcttaccacctgagcaccaccctctgtcggctggtcacagtgatgggtgtggatggagggaaaggcattgctagcttaccaggagccaaggggagctgagaagaactgttgtttgggtccattcagtaggccatgaggagaatgcctgcacccagaggggtttggctgggcctcctgctttgagattactcctgttccattgggttttgtttgtttttgtttttctgggttttgttgttgtttggtgttggttctttcctcctttcatagttctgtttaaataagagttgctatgaaggatgcaagtgaggcttagcatacgtggggtatttcagttgtctttggtatttaaaattgtcacgtgtgtacacatcttcgtgtttttaatttgtttatgcttacttgtcagggtacacatgtgtgtggaggaccaagcttctgctggacgtcttcctagattgctctcatcacaaatggaggcagggtctctcagttacatctaggtcttgccactttggctactctggccagctagcttgcgctgcggatcatttccaccatcctgtgctccagctccatgggcttggagatttttagtgaactcctctggctgtagatcttctgaattacttttgtggaagactgaaaaattgaggccattgtgtatattcataattctcccagtctccttacacattaatattttattctcctaaagcaaatgctgcttacacattggccttgaagttcttcttggggttctgctgagagctttgtggctgtctctgtcccagcacttctgcatttcctgcagtttcatgaatcacagtaatgagtcatccacactaggatgagctgtggttcccaaaaccctgctccaactcagccatggttcaaatctttatcattagttcttttccaagctatttaagagcaaattacccagtgcctccactcgctctgtgtgtgtgtgtgtgtgtgtgtgagagagagagagagagagagagagagagagagagagagagagaggcagtgtgctcctcactgtatctgttttctgcctttgttacttgctgtctacaacacagcagactttatcttgcaatcaaacaatcttagtgtgaaaaagaatctgtcttacccactgtaggctagaaatgtacatggaagccagattatatcgaactatgaatgtggttcgagtttgggttgttttctgtggacagttaggctcttcaaagcttttcaaactaacacttcagatggtacaagattgtagctctcagttggtgtacttaacaaaggagaggaaacaagagaagaggagctgcctcaaaggagtcaggtgtcgtctttgcaggctctgattttcctgtctcttcttcacgcaatttacctttgaggaccaaaaccaataataaattattgtcttaaaaccacagggtggaagtgggagtgaattctgggactgacccacgacctgtggcgataatgtcctgtttgacgataactggcgctgtgtaggtctcctgcatgggtgtgccttcttctgctcttcgagtttccctctttttcctgtgtaatcttttccacaaatatctcctatagactgaccaaatgggtgcagggtcgcagggcaaataactcatggcttgctcaaggcctttagttaaactttgggaatttagactcccatatttaattgcttctcggccttttggctaagatcaagtgtagacttccgtatttaacaggtctttggaggccctaagagaaatcaagactggctaaatctgtaaggttgcttagccttcaaaggtccacatggagaatcaggaccaccaaaggctctgaggaaacccccacagggggctttctgtaccctgatcctgctgatcccagctgaccccagatgcctgaacctacatagagaaaccacctaatctgtttggtagtggcagcaggttcaggtcacatagggaggcaggtcacacagggaggcaggtcatggggaggctggggcaagtggacacatgctgctactgctttgatcttagagatttttttttattttttggaaacaggatctcactatgttacccagactagcctgaaacacatgcttagcacaggctacccttaaacatgctctcctccatgtgtctactaccatcgacccgtgcagatcttgtctgctggacctggaatctgagaacctgaaagacagtgacatgactgtgtgtgtcatgaaaacagtgatcttttttaacttagtcacatgacagataactctgaggatccctgatttacaaacacattcttggggtgctcaacgaacctctcattgacttcacagtctcactggctctcattggcttcatagcatgcagggactaggaggctccatcagggcaggggcagttttctgcagtcctccgtaccatgctctagtatctagagtccagatactagtatctggttcataagagtagttgggacatattttggatgaaggaatgagtcttcagtgggtctgctgtctcggagcttttgtgctgcagctcagatgcagggacacgtgtgttcctaggcttgttgtgtcgtgtagatgctcttctgtagatgctcttccgttctcctgggaaagcagcctctgtaactgttgttcttgttgaacagtaaggttcctgaatgtaggactgtagtccacagggaccctgggatgctgctttcctgggtctcttacagtctctgttggctggagagagggctcagcacctgggtgtcattgccaggtcagggttccttgcctttgcttgtcaaggtttgaggcccgatgtaagcaggaccagtgggcaggtgaggttaacttttaaccaagaagagccaaagggcaggtgaggttaactctcaccaagattgaccagtggataggtgaggttaactctaaccaagagtgaccagtggggaggtgaggttaactctcaccaagagtgacccgcgggcaggtgaggttaactctaacccagagtactgatgtttcccagccagtaaattaaattctttatttgcccttgagccttactttttgactcccttcctaaaagggttaatggtatgaaaaacctgtaagtgtgcagttgatagtcatgtttttagtggccttaaaggaaacaatttcctgttttatgttctcagacttttgaagagataccttccattgtgaccatatgggggcttccagctataatgtagggccataccctgggttcttggcctagatattccacagatgtggacccaagtgtatctggttgtttgctcccatgtcctgtttcctaaacaggactcctggcctcctagctgagtgctccatcctagatctgcctgcccctgcagtgtggggtgtgtgctcccttctgccttatctagtcatctgctatctaagccgtgatctgtgctgctggacctcaccttgatgtttggacttcctacctcagaagacctcattgaccctggttagttctggtctgtagcgatgcagatcctaggatgtggccttgattctaagattgtgtgtgtgcgtgtttgggtgcatgagtgttccggtgcatgcacatgtgagcacaattgcccgcagagacctgatgagggtgtcaacctttggagtggggctgccaggtggctttgagcagccctgtgacagtgctgggagttgaactcaggtccttaggaagacaactcttacccaaagccacccagtgctttgtggatgtcagctggtgctctagaacccaactcttttccctgctcatactctaattttaaaatattttttccaacaaaacatggcattcaagaaaaacctgtctcaggctgaggatgaaactcagttgacagtgttgctagcatgcatgaagcacatagaaactgggcttggtagtgcacatctgtagtgttagcactatggtagagacagaggcagggtgatcggaacttcgaggtcattttatagtgagttcaaaccaccttggcctagtgaacccctgactccaaaacactgggagtattaatacagcataagtaatactgtggagacctgggtaacaactgggcaaagttttaatgtatttactggtatcatatctttccatggaatgagctgctgtgattatcaagtataggatactcacagcttgatcgattctaatgcattgtgaactgaaacattgccagcctgtgtggtatgtttaactcagggtcatacagaggatctagagacatgtgaactcttctttcccatgcaagctcctgcccacatgcccctcaactgtgggatggctttgccagctcaccactgggttgatcagacaagggtgacgtcataaagcatgtcctcactcttgcccagcagcattttcccaccacagtgttattagacgcgttctcacgaccggccaggaagaacaccacagaccagaatcttctgcggcaaagctttatttcttacatcttcaggagcaagcgtgtaagaagcaagagagcaagaagcaagagagagaagcaagagagagagaagcaagagcgagagaaaagcaagagagagagaaaacgaaaccccgtccctcttaaggagcattctccttcgcctcggacgtgtcactccctgattggctgcagcccatcggccgagttgacgtcacggggaaggcagagcacaagtagtcataagatacccttggcacatgcgcagattatttgtttaccacttagaacacagctgtcagcgccatcttgtaacggcgaatgtgggcgcggctcccaacatctccccgtgtcttaaaaaatgtaacccttggatagtcccgaggactctgaggactggcagacaccctgttatttgtttatttttattttgcagggctggagacgatgggttcatggttaagaacacctgttggtcttgcagtggacctaggtttgattccttgattcccagtacccacgtggggtggttcacagccatccataactccagtctcaggacctcaggatgtactagacacacacatggggtacatacatacatgcaacaagatactcacacatgtaaactgtgtgcctgtgcgtgcgcgtgtggcccttacactgcttttcattttccctctcagggttcctgttttaactgggtttattcctaatggtttattccaagcatgtgctcatagtatgtcaagttctctttcaggctgcctgatgcctttaggaatttccctcttgtgcacttcagtgcatctacaagtagattgacgtcctcttatttcttgcaaactagtataatcaagttttcaccatttgtttattgtgggggtggggatggggtaatgggtgctcaagttggggttccttccttcctcgagtgagttctcagacccacagtcaagttatcagtcttaggggcaggcacctttacctgctaaccctttgacctaactttggattatattttaagttcatgttatttatattatattttgatcaccctgaagaactctcaactgctgtttctttgtctgtaatcccactgtccccacacccttgcctcttcctctggttctatgatgtgtggctatggtgttgtccaggctccctgtatgttcgctctccatctcaggatcttccttcacctcatgggagatggggcactgggggcatggggttcagacctgggtcatcagccacctcactgctgcctcctacagccctggctctgggctctgagctgagtctcaggagcacatctgcagatgtgtgcacatcctgctgtcactccactgtgtgaggttcaggttcacacaggctctctggtttcactgcacctggaaatctctgtttcattttctcccttattttgtactattttgatagtggagccacaggaatgactcgaaaccacaagttcaagttcctcactgtgccctctggagcctgcttcattctatcctttgctcctgactctgctccaagttgccctggggtcagaggcctccatgggccccatccatggatgtttcctcactgcttctcagctgctgcatttgccgttgctgcctgctcctctctggcattctccttaaggctccactgacaccagattgcctgggctcaccttcaccccaaagcccttggcttccttcatgtgcctccctgtgctacctactctctcagcctaaatcgtgcacactggtctatgtgctctctctccctaactgttcccttggaccccgaactggtgttccacccactcactgtctgtccatcctccatggcaccttctctccagctggaatgttttgtcttcagtcttccctggcaccctgtcatcctgaaatagggtccttactggctcgagtaggtcttcatctaagtcactgtgacttccttcacagagcgtgcctgacggtcgcatggtctcatgtgttcaccgtctttcctgtgcactaagtactaatcttgctgtgtgtgcagtttccttcctttgttctctacagtgttctcagagcaggttcttgagatactcttgcctgagtcactgaagctcagcatggaagttgatgtgttagtacagccggtcaccaaggagcacactaggccaaagcagttcctcatgaagaggttttattgagagggagagacaagggagtggcagagagagaagaggagagaagagagcgagagggatgtgttctccctgtttatatggagaatgctgtaacacaagtaagggtgggaggtgagccaagtgggttctgggatatggtggtcgttggcttggcaactggtctgcaggtcacaggttgcactgttaactcctaggtttggaatgtcccggtgccaacagtagtgcgtatgtaatcccaggactcagcaggctgaggcaggaatattgcaagctccaggccagcctggactacttataacatgaccccgtctcagtataacagcaagaacaaacaaataaatattatggaatacttttctggttctactaaaaaggtcattaaactcttttgtctagtgtgaatactcccatcctaaaagttagagtcaaagtcttttttaaatgtatttagaagaatattcatggtcatttttatccagaaagcaatattgaggggttttttttatccatataaatggctttaaagataaaaaaattagatttgtttgtaaaaagaaaaatatttttacagatgtattaattgcttactaatagtaacacacagctaaacatctagggaaatgtccgtacttgagcactgtgtgagtaaagccagagtttgaggctgttcttctcgggtcaggtgtctctcttgtggccatcagacagtgatggtgccacagagttggcacagtgtgagactgtttagaaaatcaatctgtttgtggatctgatttttttaactttaggggtgtgtgtatgtaagcttgaaggtcaaaagccttcctcggggtgtgtcatccacctggttccttcagatggctcgcacctgcacctggtcccagctgtctcagcccccagcgctggggttacaagcacatgcagccatgcctggctttcacctgagtactgggttgttgaactcaggttcacaagcagcccagaaagcaccagagtacaggctatctcccagcctctggatgtcttttaaaatcgaaacattgatccttaaatactgtacttgtagttgtagagtaaaatggtcaggattttgcaaactccagatgaatacgtttgttttaccaagtaggttgaattgtttgtactgtttgatgtctgctacttgataagacttagtgatactgctcaaactagaagaatgccctctgagatgattgattccttgttaatactccatgacattcttgcttgcatttgaataaccagttggatgtttccttgtagatctctggcatgtgctatgaccgcaaagtgctccaggtccaccaggtgctccgcatccctggcagaatggccgagttcttctcctgggcccttgagcccatcttctcatcttcagaacccaccagcgaggccagggttgggatgggagccaccgtggacatccagagacagcagaggatggagcagctggaccggcagctgatgctctctcagtttgcacaagtgaggcgtcaaaggcagcagcaggtaaggcccgcgtgaccggaggtgtgcgcttcctcccgctgtgacgagtgagaacgtgtggtggcctcggcttcagtcctgtccttcacactgatcttttgatgtgttttctggagaaggagaaggtctgtcaggtcgcttttgttagtgtctggggtttctgttgttttgtttttaaggtaacaaaattacagccgaacagttggtcagattggacattcatatctctttagcattatttctaagagaaacaccgacctagttaatgagataggatatttatcagtgtttgtaatcttgtcaaagccacaatgtcttcctgttgaaagtgctagtcatgtgccttggaaggggaacaggggaaagttgtatgattttccttggctaaagtgaataccaagatcagaaaaccttaagggaacagccagtgactacatcatataaatgctgtgttttcatagatgagcccgcagtaacccggagccattgcacaattacctacaaatactactttagccaaaattctgacatgacacttgtctttcaagggagacagggaaaggggaagttgctccatgtccagctaagacctcctgatctgctcttcctcgcacactgtgaccagcacattggacccctcacttcccgcttcctccttcatcttttggggtggtgagagatgcaggattctcctgacatccttctatcttgccttccctaggtaaaagaggtggggcttcaggactcatggtggcctcgagtattaaagtccagtctgccgtctttggaatgtggggtccagggtttgtctttagggggagtaagtgatagaagacagagacctaagttgttccttatagccctgttggacttggaagcaactggagcacgtgacacagatacccatgacatgttccatgatggctggcatgtgctcttgtgaagagaccagaggtgggggtggaggtggcttacagactcactcgtaggtgtgagaaccaagagtagggagctgtgtgggaaggattctggctacagtcaacagaactgaagtgaagccttgtgattgacaggagggaagcagtagatcctacaagacccctgagaagagtgaaaggatgggtgtggtgtggtagcatagagaacccagcagagcctgtttgtgcagacttcttggcctctctgtagcttcctcccctcctgggtacctgataggaccatctgagataagagtcttcagaaagaggaaagaacgcctctgttggttctgtggtgtgctctgggtgagtgggtttctagtctctgtgacttgccccaggatgagatggtaggaaaaggctagagaggtcttgcttttgaggcttccagggtccttcagttcaaattacacagcgtgccagggtgcccgactttgaggtactttgttctgagccctaatcctccttttataaggaaactgttccttttggattagggtccacctaatgaccttactttgccataattaacccttaaaggccctatgtatcatcaatacagttatgctgaggcaagtcttcagcatacagagccatgactccaggttatcagtgcccagtgttggcactaagtagccatttcttctcgaaggtgatagtgtatccagttcattgctgtctgctcatagcagactagatattccatgatggcagtagctagatcatcctgggtacacagggcccatttgtaacctccatccatgtcatcatggctactcttcctgtgctggtactgagatagacaataataatgttgccgtcattctgtctatctcctgcgtgttgccttttctatgatggacgtctgtggtaggaattagcctgagataacagccaccacacttccaacatgttcctctatctgtgtacacttgccttccctcaggtttccttgggccctaccttccagtctcctggatgaccagccaagtcattggctatcccagtaaatccgaatgctgcattttattacccacaagccacttctctttacagctaagtagatgattgagggcgttaacctgctctgcccatggaagactttaacctaagcactggaggggcagaggtagctggatctctgtgagtttgtgtgtacagcctggactacaggtgagttccaggatagccagagctacatacacagtgatatcctggtctcaaaaatccaaaacaaaaataaaaacaaacatacaaatccccacaaagcccatgagcctatgaaatgtcagatactggccctggtagcaacaagccagacccaatagcaaagtgactatgatccactggagacacaaggctgggggagcagttaccgtgtctgacccgctgccctcaacgctgccctgactgaatgtacagatgacaggcacatgccacagaaggacacattgagtactaaagccagttttcaagtcagccaacccgagtcaagcacgcaagcatttctgggtcataactacttgaagaagacttgtgaaaggccaaagcacatctggcactctgccacttgtctggcctcatgaagttcctcatagactgactctgtccagatgagtgaagccccaagaggcatcacacaggctaccgctctccaggctgcaaagcatgcaagagcttcccagctaacgcagaccctctcagaatcctgccagaggggccgccttggcctccatctattgaagcgccttcaccagtagccccatgacaggaggaggctccactgctcctcataagcatctgctcttcctgcaacagctcctttcctggctaccctgttcctgaacttcctgctttcttcctagctgcttcaatttctttttatcctttttgtcagcctaatcacagactttttctgtctgtcctgacttgtttacagcttgaccttgcaggacatctgtgtgtctttttatttatttatttatttatttatttatttatttatttggttttccgagacagggtttctttgtgtagccctctgtagaccaggctggccttgaactcagaaatccgcctgtctctgcctcccaagtgctgggattaaaggtgtgcgccatcactgcctggccaaggcatgagctcttgaaaggacagaactatgggaacttcactcacttgtgcccttttggacactaatacagcatactgccctgtgtgtgtgcaagaagctgcctgagctacttccagaaggtaaagcagtggtggggtggtgtccctgctagaccctgtgcagcgctggggcatggcacctctgcacagtgtagtgtgtggaggaatctagacaaggccatcaggtgggattgcaaagcccaggggaggggaggaagactagagtccccaaacaactgtgggacatcaggggattgcatttgcttaagaactgagagctataaggagtgatagtgacagatgaggtgtggccacccatgctggtaatccagacacaggacagccgtaagtcataggccatggagtggcctgggctcctgaaagcttacccctgggctatgagtagagaacctgtttgaaacaaaaatagaaagaaaagaaaaaacacactccctggtgatcatagcctcccagccaggggaaccagctttgagatgagagaccagaactttccgttaacccctaatatttccatgggcaaaaaggctgaagggtgggctaaataccagtggtgttgatttcatcagttgcctttataacgtttcctccctaagaactcacaaggacaagattgtcatagtgtctacataactgaacacgtgaaggctcctggaggctggggctcagagagggctaggcctcccattgctgtgctcttcagtggggaagtgtgtgtgcagagtgccctgaggacgtttgctgggcagacagttggaagtgcaggtaaaactgggcaggtgggagcagcctgtgtaactgctgggtttgtgtttagttttgttgtttttccagacagggtttctctatgaggtcctggcatttgctctgtagaccaggctggcctcaaactcagatcacctgcctctgcctcctgagtgcctagattaaaggcgtgctccaccactgccctggctgagggtttttgttgttgttgttattgttgttttgtttgttatctaattctgtgaataatatttgaattaagtttcaagactttgagtgctgtctcctggagaatggctttgtgtgttaggaagttccctctcccaacccatccccaatgcattaaaagtgttgtgttgactggtgtgtgaacatgttaaggccaaaacagttttagtttttcttagttacacccacatgctcacagtatgaagcataatcaaaatgaaatttgcttttagggagacagctgtgagttacaggtgatctacacacaatccagtggttgtcatgggaacaaaaaagataggctaagagttgtataccaggagatctctggagctttactatcgtcatgccatgggcagcaagagtttgcctcttagaaagtaggggcatagtccagattgggagctagcctcttagtcagtactcctaaaacctccaacttctagaacaaagctcaccaccatctgacttgttggccacccacccgtcttctgaacagtccagagttttgtgttgtttttttttttaattaatcttactattatgtccttacatgatagcctcagtttccccacccacttctcagagccttaaatacttattacatggcctttaccatttaaaatgtgtaatgcctgccctagaggtacgtagccagcactttccagctcagtgttttataggaaacctgaattctctgctctgcacactcactcgtatggactcgcttgttctctgttcactatggatcccttgtaccagcacacgcactggagagtaagccttaccctcagctactctgtcttaggatcaggagtaagtgttttgtataagcctgctgggagacttgccaacacaacagaggagttgttggtgtcaacgtgctccatgctccgtgtactgggcctcccggtacttcctggttgcctgccacctgttttggtaataagtagtcgttatccaaacaaggacaggtgttaatgctaccacaagtgcataaccatcgttcacacgtgcagttcagtgatttcctctgaaagaggttgatcttcattagctacattctctcccccacccttaggaaaattctgtggctgtgaaaattgtttctctcctcatctcccctcagcaagcgttgtcaggtaccatgcaccctgcacagtgactcatacctgccttgctcggtgtgacagttattttcattactcagtatttgttacttaatagatatttctagtggatccaaagtagtctgttgagtattttcccacttgatgtatacaggtcactaattcttagtcacagaattttgcgccattaccataatcatgtagaacattgttagtatccaattaaaaactgtgtccagagcagtgaatacatgtgatgagaaaacaaaaggagatagcagttgtggggaagaaggaagccagagatgggtggcagaggatgggggaggggcaaataagaaccaactgtggtggtacatgtagatgaagaaatccatatgaaaccattattttgtatgccaactttaaaagttaatttaaatgtttttttaaaaaagaagtttggtttctgttgacaaacactcctgagccttcccatcttcccggcccactctgtctctgtaaatttgcctcatgagatggtctaggtgagtggagcctgcaccagccattgttggactggcttcttccacttgccttcacgttttcagagttcccgtgtattgcagcgtgtgtgtgagttttgcgtgttttagagagcaaggccactgagtacagctgtatgttggcaggtgccatccttgttctttctgccacgtggctacttacttgttatcagaagcttctgtcagctcttggcctctctggcacagctgttttcattggcatcttttccacacaacatgcagaaccattctctgaggagagctgtgaaccaggcagtgtgtcacctcctgaccttgatgtggcaggagaaagaggcagtcacagtaaagtgtcaggatcaggcagaggtgacagtgattcctttacctgtgtggacatctcaaggtaaccctgggacctgatgggaacaggcccacacaggtctgagttcaggtgccgccatgtgggacagcgtgcacgcattgctcttttactttttgatgtgatttgattcgagaccaattctcattaaattgctgtgcttctttgtcaacaaggcccaaccagctagagccggttcctttatgactcttctcccttgagcaggtaagtgtgcagtgtcagatgtgggtcgataaaaatctgcagtgaaatgaaaacgagatgcaggtctctgttttcaagtgaagccaaagctaaaagctgctgatgtggatccgcgcctcctgtagaggcggctgccggcctcgcgggcttgtcagtgttcttactggcctttttgatgaaattcagcccagaatgataggatcaatcaaaattctaacacttttccaagcctgactcattaggtgacattcatgaaaaccatttctattttccattctgttttggtgtcttcatgagaaagaagagcactgtagagtctcatgaatttaagaagacaggtaaatgacaacacttctctttgaagctataaaagtgacaagcaactctaattctctgctgcgttttctccttgactcattttctagttacttttagaccataagtgagtttgtaggtgagacacaaagcatctagtctactctctctgtaggctagagagaccatcccttctcttcgtgccaaagcccatctccatcagttctcagagacagagcatacttgtaactcccctcaattgagaaacctgggatttcatggacctccactattaccccagcattcagagccctctagtatgcagagggtatcagatagccagaagcccagaatttccagagtggtaagccatgaccactcttcagagtgtaaaacaggttttccaagcaaggtatgctgcagtcttcctgatgaagtgatgcgctacgtgtgcacacatcacgctgcttccagattgtgtgcccatgctttgtgcttcagctcatcactgagacgagagagaccacttgcttctctatgtgccttccttgagtggacactacccattgctctgatctcataggatagtcacccaaggagttcatgtctccttgcagactgtcctgggttctgtaatgctcacaaaggagcttgagagagggagacataggggacatgtcctctgtgtgcctgggagcccaatccacagctactatgcaaggctgtgaggctcctgctctaacagaaaaggctctttcagaaagaaaactgctctgcttccaagatgctcacggtgcctaatgaagaaacgcccaatcagcttaagaaccaactagtttggtttgctgtcgtccacatgtggaaacccagaccccaggttttattctgtatggaatcagctccttgactccatagaacctggccagagatggggaggaaggaggactttgatgagtgaaactgatatggatgtgaaagaagaattgggcctgcacagaagaaggggaaagcccccaggaaatgtgggagcacaatgcaaggagtcagaccatttgagtaaactcatgtctgcttacggggtactcagtaaggaaagctctgggaagaggggagacatggtttaggatgggaaccgtgaacctctaaagcaggacagacatctcagacactgtactgccagctttccgttgtggtggtgttactgtgggaggcttgagtgcaggccgcccacactggtgtgcagattagattggagaaagtgtgaatagcatccgtgtcatcaagaagccaccagcataatctcagagtgggacaacaaagatgccagtagtggcaggcccacaaaagaggagcagatcatccctgagagcttgggggggggggggcggagactacaaggtatcttgcatttatcaggggatttatcaggtattttgtctctgaatcagaggggagggggaggggagaattacaaggtatcttgcatttatcaggggatttatcaggtattttgtctctgaatcagagacaaaatgtttatgactgagtttgcagagacattgaagctgatataatccattgttaacccatggtgaaagtggttccatatctcaggagagagagccatgatgggtatcgcagccctttcagaagaaaggtatcagtgaaaacaagcggacctgggtacctgtctacaggtgcagtgctggttaacgagtccttggcaagggctgccgagctccattctgcactctataacatagcttccccatacctctgtaccctcctcggtgtactcttgttcctagttcagtgtctgaaacactgccgtggccccaacacaaccaatgcaaagaaacaggcaaggcctgtgaccgagcaagagaagccagaggcatggttaaggatagtgatgttgccagaactgcttccccctgagccagactccaagtctgagcagcaggacatggagttcctacccagccaccacagggcttgctgggaacattgggcagtttgaagaccctcagcccaaagctagtgagcaagataaaccataccaaacctgaagctgagagccatcacagctgtgcgggcttcctcctaggtcaccctaacacctgccaagccttgttccctcccacctacttttcaaataatacatgaattgctagtttgtgtgtgtggtgatagaggtggacctttggtttcttctttttttccctaccttttccagggaacgcctgttgaagccttggacagtgcttctcttgtcagttcagggttgggtgggctaccctgcaccacctcagtgtcagttggtggtgtgcgtttgtcagctcagctaagctctttggggaaatagttggctctctcagtgcaaccctgcttacctggcccctcctaggatagtcagcatgctgcataccaagaaaggaagctgagcatgccaaactgcacttcccccagaggtaaggaagcagcaggcagtgaccattaacccctagcctgaggagctgacctgaggagctagcctgtggcttcacatcacctccacaacctcctacctcggttcttaggttcttcatgagaggataggttcctctgtccttctctgtttcagcctctgtctgctctgtgagcctccttccaatccagccctctcaacccttccaccacacctgctttattaacctaccacctaattttactggttagtaaacctagatctttgtcaagacagctccatgtaccatagctcagcagagcactttactgtgtgtttgtccatttgtttatctgtgcagtgggtgtttcccaagtatctaactgtgccaggtctacacagaacagagtggagtctcagccctggtggagtgtgagagtcaggccagtcactgtgcagctgaaatgtgcagagtgctgacttagtacagtgagaccctagccccacttaggggatcacaggctcctactgtgagccattgggaaacatgttgattgtcctgagagtgctgtggacctgctgactgtcagagtgtggtttgtagtatctgggaagactttgtgtgtgccgccctttaattcttcatttgttttaaaaccagatagaacaggagcgatgcccaagcagatgcaagagtgcagttcccttcttctatcagtcagggctttagagttagcagccagggcctgtgaggagctcagcaggggcaggcactgccgctaagccaggaaaccaatcctatgtgctctctgacctcc

SEQ ID NO: 1346 - DNA, 661 bp, Mus musculus
cctagataaggcacctctgtcgaagagtcttctgctggtccccagtgccctgtccctcctgctgactctcctgctgcctcactgtcagaagttcttcgtgtatgacctccatgctgtcaagcacgacttgcagtccttcttgctgggttcctgggtcttgtcagccttgtttgattttatcctcgtggaagccgtgcagtattcgcttggtgtcacagtggccagcaacttaccttctggattcttggcgcccgtgttcgctctctttgttccatttcactgctccatcccaagagtccaggtggcgcagatcctgggcccgttgtccatcacaaacaagacattgatttatatattgggactacagcttttcacctctgggtcctacatctggattgtagccatgagtggacttatctctggcatgtgctatgaccgcaaagtgctccaggtccaccaggtgctccgcatccctggcagaatggccgagttcttctcctgggcccttgagcccatcttctcatcttcagaacccaccagcgaggccagggttgggatgggagccaccgtggacatccagagacagcagaggatggagcagctggaccggcagctgatgctctctcagtttgcacaagtgaggcgtcaaaggcagcagcag

SEQ ID NO: 1347 - protein, 220 aa, Mus musculus
LDKAPLSKSLLLVPSALSLLLTLLLPHCQKFFVYDLHAVKHDLQSFLLGSWVLSALFDFILVEAVQYSLGVTVASNLPSGFLAPVFALFVPFHCSIPRVQVAQILGPLSITNKTLIYILGLQLFTSGSYIWIVAMSGLISGMCYDRKVLQVHQVLRIPGRMAEFFSWALEPIFSSSEPTSEARVGMGATVDIQRQQRMEQLDRQLMLSQFAQVRRQRQQQ

SEQ ID NO: 1348 - DNA, 92117 bp, Homo sapiens
  misc_feature (1)...(92117): n = A,T,C or G
aggcatgcaaaattacttagaacctttggatatcccacgttccctcacaactctgtgcccggtaacattcttccctctgtttgatgtcctctggcccctatcctgtatccttagctcttactttccttcaagccttagttctaagtatcccaggagcattcctgttctccatcctctgaaaggcagtgtgggtgtatttgtgagagtgctgtgctctgtcatagtgtctgcatcattgattttcttccctgtctcccatgagcctgtgaagtactgtgagtggggaccctatggtgttaatttcttgtatctctaggtgatgtatgatcgatattcaataaatacccattagttaaagaatagcaacattgcagctttcttaatccttaatgaaaggttctttattacaccccagtaagcccttgatgaataataatcaattaaaattactaagcagagactgtgttccaggcactgccctgggcactctatgtgtgtttactcattgaatcctctcagaactttcacaagtccattgacagaaggtgaaacggaggcaccagggcacttaagtgaccaaagacctagctgttaaatgttaggattcagacccaggcagtttggcttcagaagtcacattcagtacaatacattttatctcctatttccgacgtgatctgctattatgggtagaaaacaagtaaaataggaaggcatctcaaaaccttaacgtacactaactcatacctatctgaacaagagagactaggagaactgggggaagggaatgggagcagggaggaagagatgttgattcaaatgaaggagtttattagtttatttgtagcatattttaaagtaagtaaaggttttataaatggatttagagtactgttttaacagtattttaataataaaacaatttagactgaaatttcgattgaaaaaagatggtgaatatctagaataggcttttatgctgttaattgatttttaaactactttttagatatttgcagagatttaacaaaatatttttattcttctctttgggcttccaaaacaccacagccatctgtgttactgtcacagctttcagaggattctcacatgtgttatctcattttatacaatgcccagacttcttgagaaggtgataaaccccccagactggagaacaccacgcgtcctctacacaggccacgtccagggctgcctaacaactccagcaggtcttaaccatagcagagagaaaagtatccctgtaaacggctttattaggtgcgaagctcttttaaatgtaagcttcttgaggatgatgacttgatctcatccaacattttatcctatagaatgctacagaaccaacctacaatagatatctagtaaatatctatagaataaataaatgaattaaagtcatatagaaacctgagttaatatttattccattaactgactggtcatggtactaattagctctaggaagccagatgaaagtaatttatgcaagggatcattaccattgtcactaacgcgatacataaacatgtgagtgaacattttgtggagtagcatattctttgtggttttatgtccaaaaagtgcagtgaacccgcagagagaaaacatgctaaaatataagaagtgtgcagtcctaccagtaagcacagttagatgtgtgatcatccatagactcagggccatttatttatttatttatttatctatcgagacagagtctcgcatggtcgcccaggctagagtgcagtggcgcaatctcggctcactgcaacctccgcctcccaggttcaagggattctcctgcctcaccctcttgagtagctgggattataggtgagtgccaccgtgcctggctaacttttatatttttagtagagatggggtttcaccatgttggccaggctggtctcgaactcctgatctcaggtgatccgcctgcctcggcctcccaaagtgctgggattacaggagtgagccaccacacccagcctgattcagggtctttatgtaaaatatccataacatatctgttggattcaccctctggtacgtcagtggccagagagatgggagaagaatgatgggagacagttttttagcacttataatgagaggcaatgttgtaaggacttggcagtagtaatactccccattttacaggtaaagcagctgaagccagatattaggtaacttgtgtgtgggggggccacacagcttgtaaatttcatttgatcctgatttcagagcccttgctcttattacactatattgtactcagagtgacaccaaaaaaacaaaataccacgcccccctcccccaacacacacacaaacacacatatataaaaccctcactgccctttaaaggaagtctcttcacagcttctattttgccaagtttctgttaccaccattcccaacctggacataaatgttgccaaagcactgcatagaattcattgtgattttttcccctcaggcacatagaaaagatacgtttagtctaagtaaacacaagtataaaccacacaacagacttttttttcacttatctaattagtagtatttagcatttaaaaagcaaagattggtactctttgctggcgggagggtaaattggtaaaatgtttttgtagaccaaaaagtaccgttttatatctaaagctttagaaaatataccctttgccctaggaattctacccctgagattctatcctgagaaataatcttatatttctaataattcctatagcataggaatattctatattaaaataactttgttccttttccttcatactaagttatcctgaaatattggcattatttgcatagttttgcttgatactgtcttttgtcattgtgagtttatacagtagtacatgaagtgagccctattttttgacaaagatatttctggtggacccatcgctttcagtcaactttataagaactaactagacctaccagtcagcagagagagtaaacttacattattaatataatttttgttagaagtgatggtagcttgttcttaaatagattgttttcctttttaccttttaccttaaaacttaggcttttaaagtttttctttaaaaagtttgttgaaaaagcaaaagatcttgtacttacatatcagtgactcgttcgggtctctgtgtagtagctgtgagtagttgtccaaactgaagtaagttttaactgtggcatgttgttttaagagaggctgtgcagacctccttttatggtggtgactttttttttctctgtcaccctgtgactgagcatgtaatgagcagttagcctcgtgtacgtgtgtgcactttgtgtttttttttgttttaaatgggaagtgaaattttttatagtgattaaaaaaaactatccaaaagccccttggaatttatgaattgttgatatctgtggaactttataaatttttctgtaaaggtttaagtatcaaaaaattctttgaaagagactgaagcaataaaccttaaccaaaaaaaagaccaagttactgatgattttatattgattttgcatgtaaaagtatgggtttttaaatgttttaaggaaaatagtgtcaactttgacagtgctttttacctggaaacttggtatcagggagtagtttacacattccaccttatccacagcttatgagaaagaaacaggtttctgtggcgtgggggtgagtgacagtccaggatgtggagtggactggattagtcgccgttttcagtcgagaggctgcctgagtcagaggctgtgtgagtacttgaataacagggaaacagttgaagggaggcccattatagataaaatccagcctcttcagcacagggtgaaagagactcatgccattcacctcatagttgtagttgactcagtttaaaccaactaacgtgtctgtcagaatgcagtttatttgtaggctaaattaccagatatgtagcactcagatcaggagaggtgatgtttacacttagtcaggactgatctggccattcccagccacttctgggtgctgctttttacgaagacatagataacacctgtggcagtgaggggcctggatagcaggtcttaggagaactgattaaataagctggggatgtgtatgctttgtaggcatagggtcattatccttatgcttgtggaaactctcatagaaaagtgtttacattgcttgtgtcagtcttcctaactccagagactagcgggagggtcagtaagaagttactggacatagcttttggatcaaaagatgagagtcattcccaaaagttgtgattattttgaaaaatggaatatgctgtttcttatttagatgcttgagtaaacttgatgattttgagggatgatgtaaacagaattgaatcatttggtaggaatttgtaactctgtgatctcagaagcctttctgctccaggattctgtaaaaatagtcgagtagcttttgcctcccacagatgtcattaggttcttctaacgtctaaagtgctgtgagtatggaggaacattgtcagacacaagaaagagcatcaagcaagtcagctgaattctttgggccgccacctcactgtgtataaaataaaggtattgaactaaatgatctccaaggtaattcctagtacaaaaattctatgagggggtaatacagagattttatgacttggtggataaacatgacatcatattctagaactagttcatttaaaacttaggctgcagagtacttgaagaagacactgttgataaatttttcagtttgttgaaagaccattctggtggggttttgcctgttaattttgaaatagttatattaagtaaaacatttttatatagtgaaggactcagctagttcaagtaattcctctgacaaactggatctgtcctcccaaccttcttttttttttttgagacagagtctcgctctcaccaggctggagtgcaggggtgtgctgtcggctcactgcaacctccacctcccggcttcaagcaattctcctgcctcagcctcccgagtagctgggactacaggcatatgccaccatgcccagctaatttttgtatttttagtagagacaaggtttcaccatgttggccaggatggtctcaatctcttgacctcatgatctgcctgcattggcctcccaaagtgctgggattacaggtgtgagccaccgtgcccagccccttttttttgatatcagagtagtcaggcagatgaagaagaggtgatggggtcattatcctgtaagaggccgctgaagctgtatattagatcatttcatgagctcacaaaccttgtttttattgctgttgaaagttaccagggtttcttgagttgtgattgtactgtaaaagtagagttggcctttacagtttttttgtttgtttgtttggagacagggtctcactctgttgcccaggctggagtgcagtggcacgatcttggctcactgcaacctctgcctcctgggctcaagtgatcctcccacctcagcttcctaagtagctggggctacaggcacatgccaccacgcccagctaatttttgtatttttttgtgtgtgtgtgtggagacaaggtctcattatgttgcccaggctggtctcaaactcctgacctcaagccatctgcccaccttggcttcccaaagtgctgggattacaggtatgagccaccacatccagtgaccttttctatagaagaagtgaaatggacatttgcaaccttaacaaggtgtctctgttattttatgttttctatcgagtgcgatcatgaatatatagcagtagatgctcagtaaatattagtgattttaaaggatgaattagcaatggctcacgcctgtaatctcagcaattcagaaggctgaggcaggaggattgcctgatgccaggagtctgagatcactgtggggaacacagcgagaccctgtttctaaaaaaagtttaaaaattagccaggtgtggtggcacacaccagtagtccctgttactctggaggctgaggcgagaagattgcttgagcctaggaattagaggctacagtgagccgtgattatgccactgcactctactccagcctgggtgactgacagataccggtgtctcaagaaaaaaagaaaggatggatgaaatgtttataacctgctttctcttttctgtgctaccagcctcatctgcttaagccagaaagggcttccagaaggtagttcttcacagtatgaaaaaggtcaaactgaattactgttgacagtatagagaacagatgttgtcataaaataaggaaaagaaaaagactggtcagtgactaataacattatggtattttgtgaagtctgtgtgtgtagaaatagcaacggaaaatttctgcagaacagcccatataattttggtctgaaatgtgtatgtgtggcctagtatttagtcatcatttaaaattatacagtgattaatatttttaaaggagtttttaaacttctattggtatgtgaaatgtaaactgtggtcattaaaatttctaccagtattttttttagtttacgttgaaatgtaacctcaaaaaagaactctgctttaggttatttagttataacatcactatttgtactttattactaaatgtaaacagaagaacttctatgaattaagcgcctccaagggcatgttctgtggtaagagacctctggtgcgattggctccccaaatagggttctataatcaccaagagagcaggccatattttgagctacatatgaaaccatgtgttttaatcccattaaaaatgataaaaaggaagggggctttttaaaacaaaaggcaagttctgctgtatggttttactgttttaaaggaaaattcatttcttctgcaaatatttattgaaaccttactctatgccaggcacaattctagacagtgggaataaaacaaaacagaccaaaatccccatctatgtgaagcttccattctacttttaagatagataggcagtgatgagaaggctgtaagtgctgtgggggaggacagtcaggaagagagtagagaatgcagagggggaaggctgtgagggcgggaggtgcggtttgaaatggggcagtcagggaggacctctctgagaaggtgctgtcctgcggagcacaggatcagaatggggatggagattcagggcctgggacgtctttgtcatgactgtaggtggggaggcattggaagatttatgcccaggagtgactaactcatacttttccatgaaaagaaggcccagctgttttaatcagttgtgcttgggtttataattggacaaaagcagttcttctgtgtagtatttaaaaactgctttgttaattttaaaaaatccaaccaatattgaatatggatcatgtataagaatctgcatttggcaaacctagataaaatatgatgctttctctcagaattaataatctaatgggaggtttttgagaactctgtatagtcaattcaaatgtgagtcatacagttgttctagaataaggattattttgtggccctaaatgtagtgagctcctaaactgtgccaagcattgtgccaggtgctaggagaaccaggactgcctcttcttccctgtcctggggtgctcagcctgggaagaaggactgatacgtgaggaattctagactgggcaagtgggggtaggaacccgctgtgccgtgcacctccgtctgccacccagtccctgccatccttctcactggatggctagccaggtgtatctcacatctctgtgtccccagtcctgacacagtgcctgcacttaggccttactggctggagttttccctgttctagcatttgctgcgtttgtgttgatagcagttgatgcggctgccatttatcacatttgttttgtgtgtgttatattttggtttggttttgtttttaacagtagaattgagaggacagtgcattttttaaaataacgtagtctctatcaaggatgagaaattgcgcaagaggccaggagggtcctgtgtttccacaaaaatggcaccaaggacagttctttgtagaagtgaaacatatgttttgcatttttctcgtgataatgaaataattcttttttttctggtgccattttcccaaaagtgggaaaataaaacacagactgagtaattaagccaagtgtttaatggaaaacaggtgcaagcttgtgcccaaaccactctactcattcatattacctgcctagcacttgtaggaatgtaagatttccgtcctgtgatgagttccttgaggtcaaggactgcttctttctcttggacgtagttgtagctcctgtgctgggcatcttaccgtgacatccttggcacgcatttgattcactgattcattgcagtggtgaaactgacatagcttgggggccacgaggagagccaccagctgccaggaggagtcagagaagtcttgtgggaagagctgagcagtgttgcacaagctgagtttcctaggcaggaaagtggaaagcagaacctgcgtcagtggagagtcaaagcagccagcgtgttcagggagcagctgtgtggatttttgagagggccttgtgtgtgttgggccagatgaggggaagcagagaggaggacagtggtggcagactccagtgatgaaagcgaactggggagctttgccatcacatctttatgaagcattttatctttggatactggagcctatggaaggaagggtttttttgttttgttttttatttttttttgtttttgtttgtttgtttgttttttgagacggagtctcgctctgtcgcccaggctggagtgcagtggcgcgatcttggctcactgcaagctctgcctcctggattcacgccattctcctgcctcagcctcccgagtagtagctgggactacaggtgcccaccaccaagcccggctaattttatgtatttttagtagagacggggtttcaccgtgttagccaggatggtctcgatctcctgacctcatgatccgcccgcctcggcctcccaaagtgctgggattacaggcgtgagacactacgcccggccggaaggaagggtttttaagcaagggagtgttgtgatcagagttgtattttaggaagagagtactgccaacaatgttaagaaatggattagagagaagcaagactgtaagtagaaagacacataagacttttgaatctgtcaaggtgaaggtgtcaaattgacattcagaaccaggtgaggggtgggcaggcagttttaggtctcacttcattttcttagcccaagctatagaaagggttgagattgtatgaggagatgagagagcaagaagaaaaggctataatggaaccatggagaagccagaagagtggtgtaagaaatcactgggcaaccactgagaagcagggtttcagacaaagggaggaaggaatgtgaggaagggagggccagaggtgaaccgtgccagtgccatggcgacagatcactggacagggcttgagatgaggcttttggatttgactgaagaattctaatgtttgctgctttcgatttgtctagtttctctcattagattttagtaatacctgggaagaaaacatagcctccacttttctcacacttagtaggtgctgaaccacttctttgcagtggtttcaggagggtcaataaggatagaatgattagagttttcataaagtgttctataagtacaaattattttggacatgaatcatatttgaaaatcaatatgtatatctaagaccatgctttcagactgaaataaaattataagcagtgttacttcaaagatacatctgccatttgtgtttaaaattcactattatagtgatttttttttatttgtttgcatagcctggcacctgtgtttgctctgtttgtaccattttactgctccataccaagagtccaagtggcacaaattctgggtccgttgtccatcacaaacaagacattgatttatatattgggactgcaggtacagtatgcatttttatgttcacttttctttaaccagatcttttttttttttttttttggtctttttctcatttgatctccttgaaaacaatggtttttttccccccataatcttggcttcatgatctatatcaaatgtttaaaggaagtgttacagaacaagaacatcaaggtatagaagatactagaatactttcatagtctttagaaatctgataagagctttcactgtaatttgtatctgtggaaaatattttcatttcattgtacaattgcatgtgcgtactttttaacaatcatagtatgaagtggaaacaaatgagaacaatcaaaaagtagaaagtagaaaatcagtgtcaaaattaatttattgaatacagtgtcgcaaataaagctctgaagaagaaacccggtgtgctctaccaacccgagctttggggttttcaagaagcattgtcagcttgattatttccttgtttgtgaagctgtgatggtagcgtcaccatttgctaaatggtttgctgtgaagactactagagtactactgtccaggttacatttgaaaagcttctttgccaatcctcagcgaatgtcaattgctccctgctgggctccaggtctgtggtaggagaatgattttcagttttctatctgtactacctgtcacttttcttttactctcacggcttttgatgtagttttattctacagcttcctgtgtcaccatgtgtcgcttggccttttgatccactgattaatactcataacattccttatcccacgcactctaaccggatactggcgtcacttcagaatgccttcctccctccccttttaacctttagcatttcctctcacttctccagtctgctgtcatgtgttatcaatggctcatctggggcgttttcttaccacttttacaaccgtttctcatgaaatctttttattctccatctctcaacccccgtaccgttacacgccccctgatcctacctgatatccatgtaaccaaatagcccgtttctgcatttgattcttatgagtaggatttgctatagcagatttaatatttttaaagttgttgtgacagaggccatgtggaattcgaagagcactccagacctccctcaggagacccaagttctagtcctagcatggctgtctccagccatgagacttgggttgagtcatggaaaccctctgagcctcacattcactgtatagttcttccaactctaaagctatgtagaatctttgagaatgaaaacactgttttattaattgtggagtaggagttcagtgtggcattgtggaaagtctttggagccaggttgttgaatttcggtttaatgacttggtctggtaatgatttgctttgtcacttactttttctgagcccccatttccccatctatcaaatggggatgataatatctaccttacagaggtattttaaagatagcatgaagtgtttagtgtaatctgaacagataataagagttaagtcaattggttactattaattaataatttatatctctatagctaccactattcatttttctgagattgtaaatgtatttcttgttttgtttttggcataaagcaagtagtatgtttcatctctcggggaaagggggtcttagttggatgaagaggcacagcatggccttcatcacggggccattgtagtaggttggtgcaaaagtaattgcggtttttgccattaaagtaaggcaaaaactgcagttacttttccaccaacctaatatctagtgccgtttccacagtgttacacagctcaccatgagggatcccccttagccctgccgaaagcagaaaggtagatgcaactaccacggatagtttttcaaaataatataaatttccaatatttttgtaatatttccggtaactttgagagggagaagttgagatcagaaaatagaggtggagatgcctcattgcctccttgataaaatctaggtccttagcatgaatggcatgcagggttcttcttgactgtctggtgtcaactccccctgtgcccaccttgaaggagtgtaactgaactcctttgtgctaaaatgtctgtcctccacctgcctccctcccctccaagcctttgcatgtgtttctgtgcctttgtctctccccactacaaccagggacattgttgaatgaatgaatgaatggatgaatgaatgaatgaatgaatgaagacttgaatcataatcggaagagccaaaatgcttaaggctcatttaagtatccaatgacttgagagcccataacatcatgccctgtgcaatgggctatgacgttgtgggctctcaagccatccaatacttaaatcagtatcacccactgggtgagatgtagcccctgtcctcaaggagcccagccatgagaaaacacacagatactgtgaagacataggcagacataatggggaccacacaggcaatgagaggcttcagaacccagaggaaattactttttcaatgacaaaatgatacgctctttttacttgcgtatgagacctggaagagtggagagcatggctgtagagccagtcctggatacactccagcccaccacctgctagctgttgacctgtggcaaattgcttaaccactcggttttactgaagtgccttgagagcaatgcctgacacatagaaagtgttagctagtctgttattctttctatttttagaagaaaattacagcaaaatatttgtctacatggttccatccttattattatcagagtcatttccactgaacaaacgtccgtgctacatcaaaggttcagatttaaagttgcagcctgtgctcatttctaactgagcctatcactagagcaaagcttgccagcctctttatctgagtgtgtcaactcttaccttttgtgtctgtcttctttctgtgtgtccttggtaagtgtgcagaactttgaggttttcatctagcacaatgccagcgatgaacctgggctgtcctgcctgagtatcctgcctcttcttctacaatcagaagtaaacccccaatctgaagttctaaaaattaaccaacaataacccacaaatcatttctttgttgcaggaacactttcagagtccttatgatttttttttaattaccctgagcacaactctaagatataaacgatttggaaaacaaagggaagaatttcatgagatctaattctaattacttttgccattaattaactttgttctgttatttagtttgctcttccttgggtgaactagaatgagaatatcaacacttgagaaagttaccattggacatagacctaagtaggctggcagggttcttcccatctaaatttagggtgacaatgttaagaaattaaaatgagaaagttatttacataaatatcacatcattgccaagcatgggatggtgattacctgttttgtatgttgttaattctaataatttctttatatgtagtattttactttaagtcagttgaaatttgtaaataacatcatacttgggtttcatttatttttctttgcatggggtgtgggccaggttcaacttgttttaggctatacaaagtctgatgtctgaataaaaaaaattaatatataattttcttttaagtaacagttgatatttactaattttccatttgcttctctgtattatggcatatataattaatactttatataaatggtcatgactatagttatgtaaaaataagtgtgctgtgactggcagttgaattttatttttagttgccttttttttttcttttatagcttttcacctctggttcctacatctggattgtagccataagtggacttgtaagtgtgactacccttttacacccaattctctctctctcctgtaaaaacattaggaaaattgtcctatttagattgtgcgtcatattcaactgtctcaccattctttttttttgagacagaatttcactcttgttgcccaggctggagtgcaatggctcgatctcagctcaccacaacctctgcctcccggattcgagtgattctcctgccttagcctccagagtagctgggattacaggtgtgtgccaccacgcctggataattttgtattttttcacgtagaagatggcggttacctcacatcgttgagacaggctggactcaaaagctcctgacctcagagtgttctgccgcctcagctcccaaagtgctgggattacaggcatgagccactgcacccggctctcaacattcttttaacccatggcaggtctggctcaatgttacttctgtggtgattaaaaagggccagtcacggccaggcgcagtgactcacgcctgtaatcccagcactctgggaggctgaggcgggcagatcatgaggtcaggagatcgagaccatcctggctgacatgatgaaaccccatctctgctaaaaatacagaaaaatttgctgggcgtggtggcaggcgcctgtagtcccagctactcaggaggctgaggcaggagaatggcgtggaacccgagaggtggagcttgcagtgagccgaggtggcgccattgctctccagcctgggcgacagagtgagactccatctcaaaaaaaaaaaaaaaaaaaaggccagtcacagggaaaattgagacaaaggaggccagtttgtgctttcaaggtaattttgatgaaagttttagctgggcttgtcagtgttgtttttaaatcatagaaaaaaaaaaagcctgaaaatgaagaagttggacttactaaaaataaggagagatagtctgctcattttgtaaaaagacattgtcacacgagggaaaaaaataatgccaactggaaagtcaggtgggttggacctgaccaaagtctcatcatggaagaagggaatgaaccaagcaacctcagtatgtttgctggaattttttcatcttgtctatgctattgtattttaataataagcgtttgtcctaaattctctgtgaggtattaaaaaaaattagagcatgaagtggagttttattcttcatccatgacttaaatttaaacctccagatttataaaaataaattttaactagcggttatagagcatagattttatttctttcttagaaaagacttaaatgacagaatggattcataataatacacatttcactgcaatcactgtacacatttcaaataaattatcactatccttgtttcttgggtgaatgactggtatttggggctagtgtgtcatcctgtacgcctgcttacccctcttcttcctttaagctctctgtattattccttttctgtgttcattctttgcttaaaattcacgcctttgttccccacagctgatatgcttgcagccaatattctggggctccaagtcactttgttttctcctccctaaaaattttcacatctacccagatacctgatttggcttcaggaccacagagctaaaccctattgtgaagtcttcaaaacacctaagctatccgtctggtattcttgagacttgtggtggcttagggccatcctggggttagactgattctctgggacacaggtgccagactcccccaagtctaggctcacccagttagaactgttgcgtgactgaggaagacttaaccagcctgagaacagcaaagaaggagctcattgctttgatcatgagagatgcctgaggatgtactgtttgttccatggcatatttgtttcacttagcagtaatggttttgagttctgttttaaatattttccaaaagcattcaaatattgaagtaccttattgtatacgatttcattgtgttagttactattaattcttttactctccatatttgtccccttccttagtaactcttatgtgactcagttttttaaaacacattccattttctttctttattctttttttagactcctagctttaagtgcctgctgtctcctcagaaagttgcattgtgtgacattcagtgcactaaaattggaggttgcatttttcatctctttatagtctttttaaaatctaaaattatatgttatgattatagtcttttccggtacacatgtttaacaggtagtggggtacctgttttaactttttaaaaggaatcagacgtttaaaataaaattcttgaccaaaaaaaatcccttgtttcagaagggtgaatagaattacagtgtgtttggaatataattcaaagataatgtagcattttaaagaaccctactaataataaacatttctgagccttttacagtcattgattcagccaaagttaccggccttctactatgacaaaaaatctgataaatcttcatattaaccttgttctttattactattttaccataattagatgactgtttatttaaaataattaatattcatgaatcatggccagttttcctatgttcctataccataaatgttggtgcttgttttgaacctaaggaacattttctttctttgtctagaaaattctcatttttattatgaaatatttactgtgatgtggcatactttagataaggaagattgtaaaagacaatatcagtattatttgtgagtgtttgatttacacaccactgactataggatccaagcctgagattcacaaagccacagtctgcctattccagatgtctcttgctcaacatgacttcccctcttcctttatagatcaagtgacttccctttttggggagatatttatgctaaataaaatactaacaaaataaaattcttactatgcaaaagaaatgcacagataattataattatagatgatattcagtgttttggggaatgttacaaaacctgttgatgagatttcacattttagtattgaaaccagtaattcacttaaccatgtgtgttaagcaatgattttatttcattctggcaattaatgtggtttttaagaaaaagagtattttttaaacaaagatatttgtatgaaacatgagtaatttgttatttgctgtcatagaaaccaaaaactttactcatgcttttctggaaagctgccaactttggattgagcttattttatttagctaggtactggttgatttattttgtttaggctagcttttttgttttggagacaggctcgctgtgtcactcaggctggagtgtagtggcatgatcttggctcactgcaaccactgcctcccgggttcaagtgattctcgtgcctcagcctcccaagtagctggaattgcaggtgcacgccaccaagcccggctactttttttgtatttttagtagagacgaggtttcaccatgttggccaggctggtctcgaactcctgacgtcaggggatccatctgcctcaaagtgctgggattataggcgtgagccaccgtgtctggcctaggctagtttttaatctctcctcggtgtcccttattcttgcataattatagatgtctttgaatatataactttaaaatattccactgattaaaatagaaggttgataaattatgtcagtacagtattttactaggtaagttgaccactttttatcttcagtgatatcacagaaaataactaaatcatttttctgagttgagggaagacagtttttagcttacaggagcaatagtaagttagtttgcccaggatggctgtcagacctcagtcctattttgttatccagtagagactccagctgctgcccaggaaaggtgagggggattctcttgtacttaaagatgactgtaagattattcacatgtatcattgataaatgtttttgtgttacctttttcctcatttgacagttctgatttttaatgcaaacatttagtatttaaaataggacttttcatgaaatgttgcaaaattgtaattggaaagcttggctattacagccaagtgacatatatcagtttaaacaaatacttcaacatttcagtgaccgtatcaactgttcttctagatgtctggtgagagaccttcaaaaattgaagtcagtctttacatattcataattccactaattttcttacacattaatacttttccttaaagcattgcttacttactgaacttcatttaaattcttcttgtggttctgcagagagcttttgagccatctacatctcagaacttcttcattttctacagttttatgaatcatagtactgagtcattaccacagggatgcaccctaattctcaaaagccgaggtctcaggactgatctgattctggcatgattaaaatagaaagagccttcttttgccaattttctttttacagttcacacatttatctttacttgaccctcttttaagctgtttgagagtgaattaacaggcctatattcctcagacttctcccttcaacgcagcccttcactgtacccatttcctgcattcgttacttgtcatgtacagtatatcagactttgattatctctgatccagcagccttagtgtggaaaaaaaacaatctgttacacccaaaagtaagatttgggacttcaaatgtggtctgagtttggattgttttctgtaaggagtggggatctttaaagcacttcaagaagaaacactttacgatggtgcaagattacagaagccttatcagggttcgtagatcataggacaggggtagggaaaatgagccatctggagggagtcaagacagcgcatttgcgggctgtgatttgcctttctctcttccctctgtagtacttttaaagacaaacaaaaaaacccaaaccactgtcttaaagtaactgtgaacaaatggaaacagcataacctgctgtggaagcataagcatctttagagtatgttttgaggccctggcctgcttctgggcgagggatggtaggtgtgggttcctctgcgccgcctttgcttgtgcccagctctctcttctctccatgcttccttttctcctatttaaccttttttcccttagattgcttctccattgaccaaagagtggtataggtagcagctcagataactcctctgatgcacaagcctcccagttaaacttactttagagatttggattattttctagtagttcattgaaaatgaggacaggaactgcaaagaaaaatcaaggctaaccagatacagtggctcatgcctggaatcccagcactttgggagactgaggcaggtggatcgcttgagcccaagagttcaacaccagactggccaacatggcaaaaccctgtttctacaaaaaacaaacaaacaaacaaacaaaaatttcaaggctgaccaaagccatgagggtgatgggacttgtgaaaggaccacatgtagaagttgaagacaagtagcaggttcttaagaagcatccaaatttggagggtgccttataattaaaatagcaagtgtgatgtcagtgcttgtccaatgtacaccccacacacactcacattcacgttgactcatccatatacactcccttttctcctttttcctccctccctctctatgctacctttcccactcctgaccacagggagccaggactaactggaagaagccttctattaatatattcttccttgtggcaattgcaactcaggcccaggatgacaaatggtgtcttaggccattgttaacacagggaggtagcgaccagttgacgtgtgatttttaaatgctcagtgcagaataaatgaaatgatgccattgtcttaataaagctggcagatagaattgccttataaaatttataaaaatagctataaaattttattattgcaacttatgttctacctgtaggcaaaaatctagcctcctttcaaaatgcgacctcctcacctacccctgtcacttctgtgaaccatacactccaactacacacaatccattcccaaacatccactttcaggattctgtatgattgtgcaaacaagtatttttctttaacaaacacacagcacttagtatgtaccagacacttgtggtagattttttactctagtatttttgtttgttcaaatatatttggtcaaaatatgttctgcccctctctactgaagccctccctatagggcctctgcatgccctgttgacatcaggttttgttgtttgacttacactagccactaaaatatgaacagcagtgacaaatgcttcatccaagcagaagcttgaagagccactgcctggttccaccattgctctgtcccctttgccatgagaaaagcagggcccggagaggggcagctcctcagactccagaatgaagaagtcaaatggagcagggctgtaccaacatgtagcatgaacaggaaagaaatctttgttataagctactgaaatttgataatttgttaccacagtataacttagaaaaagctgactaatagtactcttttctaagcactttacaaacattattttaattagccctcataaaaacctgaggaactacggaatattctccctattatagatgaagaaactgaggcacagggaaattaactacagtcatgcactgcgtaacaacgttttgatcaacaacagagtgcgtattcagtggtggccctgtggattctaatggagcataggtagaaacctggtgtatggcactcagtgttggcactgcagatcaagtaggggaaatgactgatattcagtcatggtgccagaacacttgattttctgtatgaaaaaatatatataaatgaaaatatatatcccatctaggtttgtgtaagtacactctgtaatgttcacacgatgaccagatcacataacacatttctcagaatgtgtccttatcattaagcaacacatgactgtaatttgccaagaacaccaggtagctgaaaagtagtggagacaggattcaaatgtaggtagcataactttagtgtctatgctcttttttttttttttttttttttgatacggagtctctcactgtcacccaggctggagtgctgtggcgcgatcttggttcaccgcaagctccacctcccgggttcacaccattctcctgcctcagcctcccaagtagctgggactacaggcgcctgtcaccatgcccagctaatttttttgtgttttttgtagagacggggtttcaccgtgttaggcaggatggtcttgatctcctgacctcgtgatccacccgcctcggcctcccaaattgctgggattacagacatgagccacagtgcccggcctatgtctatgctcttaaaagatagctttgcataaccacatgcagtttcttccaactatatcccctatttcactcacatatcccttcttctaggaaatcttactcatttaagtcctggcccaacccttttcctgagtcagtcctgactttatttatgagagctctcctcttaaatttttaagtgacagtttataattgttgactataggtatggggttgtgcagcgaatctctggagcttatcgctcttgcttaactgaaactttatgcctgttgatttttaactctccttttccctctgcccccagcccctagcaaccaccattttactctctgattctgtgaaattgactatcttatatacctcatataagtggaatcatgcagtatttgtctttccgtgactggcttgtttcacttagcatataggtcctcatgtttcatccatgttgttgcatattacaaaatgcccttctttttgaagggctgaatagtattgcattgtatgcatggaccacattttcttcatccctttgtctgttgatgggcacttaggttgtttccccatgttggctattgcaaataacatggtgatgacatgagagtgccgagacctctttgagatcctgattcatttcttttggatgtatacccaatagtgggattgctggatcatattagttctatttttaattttttgaggaacctccatactgttttccatagttgcatcatttgcatttctgccaactgtgcacaggggttccagttttccccacatcctaaccaacacttgtcttttggtgttttttgtttttttataatagccatcccagcaggtgtgaggtgataccacattgtggttttgatttgcatttccctgatgattagtgacattgagcattttttcatgtacctattggccatttgtatgtcttctttggagaaatgtctgtttaggtccttagcccatttttaaaactaggttattagttttttggtattgaattgtaggagagtccttttagtttataggaattctatgttattcttcataatcttcagtgcctagcacaatgtctacttgatacacattctaaaaataattttttagtttaaaaacttaatattatcaaaaaataatttctgtactataaaacattatactacatgattgtcaggatgcttacaatgtgtactgccttactaggttcttgatgtgttctctatagtggtagaatacctggactgcctattttaaagatagggaggctgagtttcaggttgcatgaatgatgggtggtagaaccaggacaaaggccaggtgttctgctccaggcccagtgagtccagcaccttacactgcacatctcaaggctctcatccatgtctcttccagccacgagatgcacagacagagttattcttaaagtttcccttagccacaccactaggatgaggccccattcatcagcaatggagacatgattctggagggcaatcttgggtatgaagaggttttcaaagtccccagaggccctgaaaaacacaatcgacaactttttgcagccttctgtgtgctgaccaatagccaaggaaaattttttctcattagcagactctattttcttcgtaatatgaagaatgtggcctatagctatgctttctcttctaaaatcatcaagatatttaactggtcctctctccatgcttggttaaaaactcagcttaaacctcaccttcagcaaactcactgtcttgtatttcttgcattgtcatactcaatctgaagtaaagaaacattcagagaaaacttaaaggataatttaaagtatattaggctggtatagtagtgttactgaataaaggaaaaagaagtagagataaggaagaggttgccaagaaacacccgtacttttacattgtagagattactggtagattatcatgtccgttgcaggacagaacattttcccatgggtcttcacattgtctttttatcaggaaattaaaattttttcatcagttttgattatctctttaaactatatgtagttttggtttttggtttttctctctctctctgtgtgtgtgtgtgtgtgtttaagtgtccagtgtttgtcttcggggactgactgtgttgatattttccttctgtcttgatgatagcctctgggaagggactatggtaaaattaacatgtcgttttgaatttatttattatttataaacaacagcataggatgttatcaaaggtcttccatgttagcttatattgatagctgagaacattttcaaagcagcagaagttttttgttgttaaaagcttgtttttgttctgctaaaatcctacctcttataaaatttaaaagatttatgtatctatttgagatctttctagatcttcacattcttttttattaaaagattctttttccctttttttgtttattaagatgttatttacatacaatagaactcaccaattttaagtgtatagttcgttgaactttggtagttatatacagtcatgtactcaccaccataatcaatatggaaagcagtctcctgaccatgaatggtggcttcatgccccatgctctttccccacatccagctgccagccgcaggtaaccactgatcttcatgtaattatagttttgcctttgctggaatttcatatacttagtattgtataatatgaagtattttgtgttttacttctttcacttgaacatgaaaatttcaccaatttttaaaattaatttttcatttattattgtattaagtaacaattaatagattaagtattaatctatagtatggatgcaccatactttgtttatccattcaccaattggtggacatttgagttgcttccaggtttggattattatgaataatgctgctgtgaacatctgtgtacacatttgtgtgtggacatatgttttccttctttaggaacggaattgctgggtcatatggtaagtgtatatttgacattaggaaatactaccatgttattttacaaagtggctctaccattttgcatttccaccatcgatgtttgaaacttccaaattctctacacccttgtcaacacttggtattgtcagttgttttagctttagccgctctattgggtgtgtagtggtatcttgtggttttaatttgcatttctctaatgattagtgatgttgagcattttttttcatgtgcttagtggtcattttcatatcttttgtgaaatatctgttcaaatcttttatccattttgttcattgggctatttatcttctaactgacttaaaataattctttatatattctagatataagctctttgttggacatgttttatgaaaattgtattctaatttgtggcttgtctgttaccaaaaagcaaaattttaaaatcttgattaattcattgttaactggtttttaaaatagtttgtgcttttgatgttctatttaagaaatctttgctaatccaatgtcacaaagattttctcctatatgttcttcaagaatttaatagtttctgctattacatttaggtctgtgatccagtttgagtataattcttttgaggtaaagggtaagatttattcttttccacacagatactcatttgttccattaccagttattgaaaagacccttttctcattgcatgaccttggcaccaaaactcagttgaccagtataggtttatttcttgactcttttctttcccagttatctatatgtctgtccttacgccaataccacactgcactgatgactacagctttatggtaagtcttgcaatcaggcaatataagtcctcccaccttgtttttcttttttaaaactggtttgcttattttaggacactgacttttaatatacactctacaatcagcctgtaatttcttcaaaaaaaggggaaaagagttaagattttgcttgtaattgcgttgaaactttagatcaacttgggaaggattgccatggtgatggtttttaaatgtttccacagattcttttacacatcaagaggtggagcttatttttcctctgctagcatttgagctgtacttggtgatacttataatgaatagaatgtggcaaaaatgatggaatgtgactcccaagagcagatcataaaagacacagctagtcctgtgtctttactctctcctggatctcttgcccttggggagcccatctaccatgccatgaggactcttaagcagacctgtggagaggtccacatggccaacaatcgtggcctcctgccaacagtcagcactaacttgctaggtgtgtttttgagccaccttggaaggttatcctccagtgccagtcaggtcttgagatgagtgcagataggctgacaccttgactgactacagcctcatgagagaccttgagccataaccactcagctaagttactcccacattcctgcccccacagaaattggataatagatgcttattgtttcaagccactgagtcttaggtaatttgttgctcagtaatcaacagctactacaacaatcttaacagtattgagttctccaatgcacgaacgtgataagtctctacgtttatttagctcttctttaattcccctttgcaatttttaaattttcaatgtacaggtcttgcacatctttcattagatgtatttctaagtaattctggtatgttgatgctattataagtggaattggttttataaatgttttcccaattgtttgtcactagtgtgtagaaatacagctgattggctgggtgtggtggctcacagctgtaatcccagcactttgggaggccaaggtgggctgatcatgaggtcaggagttcgagaccagcctgaccaacatggtgaaaccccatctctactaaaaatacaaaaattagccaggcttggtggcggatgcctgtaatcccagctattcaggaggctgaggcaggagaatcgcttgaacctgggacgccgaggttgtagtgagctgagatcatgccactgcactccagcctgggtgacagagtgagacgtcatctcaaaaaaaaaaaaaaaaaagaaatacagttgatttctgtatttcgttcttgtgtcctgcaacttttctaaatgtgtttattatttctggtagcttttctgtggattccttagagttttcaacataggtggtctgtgtcatccagaaataagttttatgtgtttatatgcttcttctttcccaatttgtaccttttatttttctttattatactagctaggacctctaatagaatattaaataaaagtggtgaatggatatccttgcttcttcctggtcttagatggaaaacgttgagtttttcaccattgaggctgtatctataaatccacaaatcttttagagcttcacattcacttttagtttgttatttttcatcaaaggtaagaaatgagtttcaactgaaataagcccatatttttattaatttttcattttttgaatccatttaagaaagtgcatgtaacttttaaaggaggatggtccgcttgttaaaatggatattagaaggtgtttgtttacatataagaacctgatgatggttttctccatgtgctagagactctagttgccttccagtatattttttccttcataagggaaggttcgttttatttgagccagcaatgcctccagctgagatcacatatctcttatccttcgcctctcagtctgaccactggtctaagtcctggcgtcctggccattgagctgtaaacacacatatttgtgtgacttctgagaaggctccttaaagtcgccttttgtcctttcttattttttttcttctggctgctttgactacagttaagatgtttggagctttttaaatatgaaggtgaaataaacttctcttgtatttaagccactgttgtttgaagttttctacttagcatagttgacctaatcctcctgatgcatgatttcccaaaaggaaaagcctagagcaggtttctaagacagtatgtgagaaacgaataatctgtgattagtgttattacttctgtctctattccaatttggttttccaagaatcagaaggatatccagcattttaattgggtacctcaaaatcttttaatttagtatcatttctattccctcatatgagatagaaaagctatagaaagttcaatctgaatcacttttgcacttaaagaatagcaagtctcagagtaactgccaaaggcacatggttctgtctgtcatgaaaagaataatcttttcaaaatgtatgacaaatggcagaaataactttgggaatccctaatttgcattcacattcttggggtaataaattagggaatgtacaaagttcccttatgctttctctaacattttcattggagaagaaggaataggaaaatgtaagatgcatcagggcagggatttttctgttttgctccttactatgtttcagtgtttagaacataggctggcacgtattagcattgagtaaatatttgtggaatgaataaatgaggtctcggtgggtctggttaccacaggccttgagggcacatgaagtctatgtgctggggctcagttgcaaggggacatttattcctttggctgttccttgtcatgcagaggcaatatcatgcccctgggaaagcagcccctaggtttgtcctgttgtcccagtagatggtcggtttcttgaatgtgggaccggtggttggcacagcttgccttgtgggtttttgttcagccacagttggccaaagaaagcaatcgacacctgtgtgtcattgcaaagtcatagtttctaacctttgcctgttgtggtttcaggctagtactaaacaggaccagaggacagttgaagtttactctctataatcaagagtgttttgcatgttttctacccagcaaattaaattatttgcctgatgagcattatttcatgattcccttcctaaaaggatgaagcatctggaaaatctgaagaaccgtgtaattgacgtccatgtttattagtggactaagagaaaatcatttcctcttgccttacattctcagacttacagggtcacagcttctgctgttggcatatggggggctgctccctctgacctggagccagcgtgggtctttggcctagactctcagctggacgtgggccaggggttctctggttgcgtgaccatgtgtcccctttcctagccagggttcctgcttcctgttgcccaagtgctcaaactccaactcgagcttgtcttcccgggcatatgctctttgttcctttttgctttatctgatcgtcctgcactgaccccttgcctgccggagactgcgccactgctgccttctttttcagtggcccctccgtttgctctttggcttacccaggtctgagggcctgcaagacctccttggtagagttcccccagccccctgacacacaaatccaacatatggtctttttctaaagcctgcttttcagagggtctatggatttcaagaaaactcgctcaattcagaagacctagtgtaaaaaaggtttatgagatcatgaaaattaggtcaggcatggtggctcacacctgtaaccccagcacttggggaagccaagatgggaagatcacttgaagccaggagtttgagaccagcctgagcaacatggtgaaaccccgtctctggggggggaagaaagagagagataatgaaaattaaaattaaaaataatgtgtgaatgtaacatagtattataataactgatgctctctaaaagcttttggcagtaattaagtgaaatctaatgtaattatttttgtcccatctttccatagactagggttttaagcactttatattttaatcctttgtgaaaatctaaaacattgtgcagtagcactttatttgacaacttgaggtcatgctggcgtgccagtgacatggacaagtgaactctttatcttttatcatatgggaaagtataaacttgggaccaaaaagaatgcataactttccaatttcctttaaaaggatctaagataatgtatttatttttgtggagcatttgttaattcaccattcacccaggaaatacttacagtactatgtgccagacactgttctaagtgcagaggccaagtagtgatcaaaagcaacccaaatcttccccattcagagtttacatttagatagatgggatagaaatgtaagcagatgaacacaaaagccctacttccctgccagaatttgcagtcctatttttgtttattactgggtggggtatccatattcttcacagaatggtcctgctgaaattgaatacatagttttgtgagtgtatactcacgtctgattgtcattgtgggggcagggaaggcatggacaggagagtgaagatctttaaccttcctcagtttcttaagggagtctgtggcctcccccccataaattaagagcttctaccaaattgtgaactccttaaatactggcaaaaactatgcattttcattatatttttcttaatttatttaaaaacctgatttaaaaaaaattagcaacaagatcttgctccgtcacccaggctggatgcattggtgcaatcatagctcactacaacctcgaattcttgggtcaagtgatcctcccacatcagccttccaagtatctgggactacaggcatgcaccaccatgcccagctaattctttttatttattcttattttttttttagagatgggggtcttgctctgttgcccaggctggtcttgaactcctggcctctagtgatcctcctgcttcagcctcctaacatgctgggattacaggcgtgagcacagaaaaaccaacattgtattgttgagcttttaaggtatataggtgtaaaatatgacagaagtaacgcagtggatgggaagacattacatggaactgtagtaagtcttaaccttgtcagtaggttcttggaaattccaactttaagcaaaacatcattcaaataatgtcatttcattcaacgtcttttcattacagcattgaggagacaaaattatactttgtttcagttaaagttggagtttccaagaacctatcagtgagttaagtgaggacttactgtagggtcttgcaagcttctcctgttttacatgaagtaattcagtattaactccaaatatattatgctcaattttgaatgcatattataacctctagggcaaatatgagggggaaaatacagtgatatatagctgaaaaaaaccaaaatactaaataatatttgatagcacaaaagaacgtaggaaagggggagtaaagagtaagaaacagatgagacagacagaaaccaaattgcaaaatccagctattcaagcaaatacattaagtatgaataatagctaaacactccaatcaaaaggtagagattgtcagactaatttaaaagaaaaaaaattgctatatggtatctacaagacacactttaaatacaaagacacaaaaaaagcctgaaattaaaaggatgaagatatattatggagacagtaaccataagaaagctgaaatggctgttttaagattagacaaagtagacttctctatgagtattactaaaaacacagcagaatgctttgttatgacgaaagggtcagttgtgtttgtgtgcctaataacagcgtccacaaacaggaacagcttctagatatatgaagttaaaatagctaatgggagcaatgaacaaatcaacaatcacagttgaatactttgagaccgaaaaataaaaatgtttaattttgtacttcattcaaatctcacagctctaatttgtactacatttttaatattttgttatgtttataacattttgctatcttctgctgaatcagcgtaatgctgatatacaccctattttctgttttatatcagatcttcagaaaaggcatttctacttccttgcctccaattcattactgtttttttttttccatattgacttcatatgtctctcttcattaaaaatatatatttgttacagagaatgcctctgcctaccccctaccctgtcccccatcacccctctacagcaaagactgctttctgtgattctgtagttaccgcagacagatgtgtgcacaaacggcatagactattattttgttgtctgaaattttgcaggaagatgagcgcaacatgtgataccttctatgtgtatttttcattccactttaaacacatcagtacacgcacatggagttcatctggatggctgtatagtactgtgttgtatgaataacccactctgcagctgttcccctcttggggatgatttgtttctgcttcctctctctctcatgcagggctgcagtggaatgagcctcaaagctctacttggtgttgccacattgctccccagaggcgccatagcttcaccttccctcgggactgtgtgagagttctcagttccctccatccttaccaaaacctcacacctggaatcccagcacttagggaggcagaggcaggaggatcgcttgagcccaggagttcaagacctgcctggcaacatggcaacacctcattctccacaaaatggaaaaaaaaaaaaaagagataaaactggatgttagaggagctttacatttttgccagttgctgtatttaagattgctcattttagatttcagagtcctaaaaacaagtgaggataaacatcttttcatgagtttgtcagccatttgagttttctcttctgaaattaccttttcatatgcttttaaaactgggctctttcttacacattcctagggtttcttgatatgttctgaatgctgccttggttggctgtatgaattctgaatactttcttcaggcctcttgtgttttcatttcatttatggtagcttttggcatactacagcttttaaattgtaaagtagaccagtgtgtgttttcttttctagtttgtaccttatgtttcttaatttaaaatattttgccaccccagtgccaaaaaggtattccttctgtattttgtgcagaaagatttacaatttcatgaattctatttgagttcttattccattgcaagtttacgtttggtgtcaggaaggggccctgttctgtctcttccttgtgtatagcccatgtgccccttccctcccaatttacccatgtctgctgaataccaggtgcccttacactgaggatcctatttctaggctcttgttctcttggtctatttaagtaaccctagataaagaccacactgttttaggtagccaaactttatagtatgtcttgaaatctgataggacttacgtttctttaaaattgccttgccttttctgggttttttatttctttgtcttttaactcttaattgtgatatacaacacaaactaactgtcacaaagccttgcaaatcactataaagcaaatatacccataatccaccatgcaggtacagaccatgcctggccagccccgcagcccatggtgccccccttccttcccacctctcttcctccttcccacctccctcctgtgaccccttccccttctttctccctcccttctgtgacccctcctagcacacatagtcatcatctttgcgctttcctgtctcgttttactgcttagtgtgtggtttaggttcattcattcacagaagtggaatcgtgttttcaggctttgggtctggcttctttctcccaacatggtgtttttaaaatgcaaaccttaaatattccgcatgaatttgaggcttggcatttacattccaacaaaacaccctgttaagattttattttgaatgatatttaatttatgtattaatttgatgaaaattggtatcttaaaagttttgcatcttcctattcgtggaactggtatctttattatcactagggttggttttgaaaaaatatcccttattatctttttcttttttttctgtcaaggccttatatatatattatttatttattcccaattatcttacagtttttcttgctgttatttgctaacagtttattttttctttctaaacagtctgtattttatccctggttgcttttaaggatttctttcttttgtttcaccacagtggatctagatgtaaatttcgttttagcattcttttagggactcttgccctttcatcctaaggatttatattctttctttattctagaaaactctcagctgtttatctctttaaatataatatcctttcccccatattccctctgttgtcttcttctggaacccctatgctgacagccgcatgagatgcacataatctgcctgtgcagaggccttggccttcccaacccacatggaccctccttggttcatgccctacacagcttttcccttctctctgtggaggggagaaagggtacatggagcatgaggaggaactggggtgcctcttacccagacttaagtaaccctctacttctctcctccttccacagggcctagaccctctagtccaggggtatctagtcttttgaactcttctgtgacacattggaagaagaattgtcttgggccacacataatatacactaacactgaagatagctgatgagctttaaaaaaattgcaaaaaaatctcctaactttttttcttttttttttttttttttttttttttttttttttgagacagagtctcactgtgtcgcccaggctggagtgcagcggcacaatctcgacttactgtaacctccaccacccaggttcaagcgattcttgtgcttcagcctcctgagtagctgggaccacaggtgtgtgccaccacgcccggctaatttttgtatttttagtagagacgggtttttaccatgttggccaggctggtctcaaactcctgacctcttgtgatccgcccgccttggcctcccaaagtgcagggatgacaggtgtgagccactgcgcccaaccttgtaatgttttaagaaagtttatgaatttgtgttggaccacattgaaagctgtcctgggccacatgtggcccacaggcctcaggttgaacaagcttgctctagtccctgtgcttttctgagtcccacaggactctctgcaggcatttggacttatatgctgcttatatgcagagtggtttataatcacttgataagctttctattttgttagcatggttcaggattagtttctggtttcatggaccttggagtttgtttctgttttcattttctttgtcttgtactatttttgagtaaaggggcacagaaattatttgaaaccagaagttgtccaccattcactcttcagcctactacagtctgtctttggtaccaaaactgttcttgtaaacaccttgtttatcaaacacctccatttgcaacatccagtggctagttctgtcttacttatcagctgcattagatatagctgaccatccctattttaaaacacttcttagcttcagtgataactaaactctatttcccttctcttcactggcagccctgtctcagatttccttactggcgtttcctactctgtctgtccatagaatatttgtgcactcctggattcagtccttagtcctgttctctcttctgctgtgtctcctcctcccccccattttatctcctctagtcctgttaccctaaatgtcatatcatatccagtgactctgaaatccttatctcgaccttttccttgagttctagaattacatagccacctgcccactcagtagccccccaagatatctaatagacactcccaagctcgggctgcgcagcatctgctgctttctctgcccaaaatgttatttccccagttcatcaagtcacgggcaccgcatcatccttaagatcttcgctcaagtatcactttctctgagggctctcctgatgtcccccgctgcccccagagtaggttcgtgccccatgtcactttatttccttcccagaacttgccagaaatagttttatgtgttgacttgattactgcctgttctccacattgactgctataagccctgtgagagtggggccttgcttatcttgttctttgctgtattctaagttcccagaacagtgcctggtgtgtagcacagtctcaaagaattcttgccaattcatcaatttaaattttatttttaaacattgaagtatacttttctcatattagaaagttgtcaaatatgttctaatctgatcttctaatcctaagaatcaaattcacatcaagattttttttttttttacaaaggaatagccatagtcatttttaactagaaaatcataggaagccttgagacttctgtaaccatacattataaatgaccttcaagatgaagacaaggttggtttataaatggaactaatattggtgaggattttaaatgtctagaaaaatcagtagttgaaaaactgattaaaacactatgtaaataaaaaccaagattttagattgtgtttattctctgataaattgatcgtgtgactgggtcagctgagacatggcagttgttttctgctggtgtctctgtgatggccatctgccaacaaaggtaaccgcagagtcagtacagtgtgaaagtgtttcaataatcagatcttttacggctttttaaaaaatgaagacagtgtcttgacaatcttttaccagaactttgaatactaaatgattagaattttgctagctcttctaattcaataaaaaacaattttgttttactaagttcaattttgtgttgatttgcactgcttagtgttctgcagtgtggtagaggattttgcttattgcctaacactgctatgactaagaaaaataccgtgtgcagtgtctggaggctgctgatttttgagtcgtgtacattttttaaaataatactacatttaaacaatcacattggacgtttttcttctagatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcaggtaaaagtgataataatcactaaaaatttagaaattctcagtggcccaagcaaatctttcctctgtgattgcatgtgagatagagactacattttattccagtgccttgcaagtggattttgacatttccaaagagattgtaggtctctgttagtggccattcttagttttttaaaaaggtaaaaaataaattgcagctgaaagattggtcaaactggacattcttgttccacctatattagataagcatgacttcttagagaaacaccaacctagttaacaagatgtgctatttatctgtttttataatcttgtaaaagccacagtgtcttcctgttaaaatgctaatcatatgctatggagtgaagaacaaatgtaaaatttcttgattttccttggttgaaatgaagagaatatgaaggcaagaagattttcagtggaacaaccaaggagtagataaaaaaaaatgctgtgttttctcaaccttgctatcaataatcagaaattattgcacatttgtctacaaattctgcatccaaacaatctgatactacatttgtcttccatgggcagtgagagaaggagggttagtgcacatcaggctaaaacctcaggcctgatctttcttggacacttctgtgagccagcccacagggctccccatttttcgcctccaccttctttacccctggggtagttgtaaaccgtacagttacctctgccatctctctgtcttccactagcattggatgcaagaagtaggtctgcagatctcacgatggtttggagaagtgaaatcaggtttgaggtccttagagtcccattggagatgcaggtcccagagtttatatcaggggggggaggaagggggcagcttattaggggcagagtctacaagagaaatagagaagcaaaagttgtttcttaaagatgtgcttgaatttgagtgactctggaacatgccataaagatgcccatggtgtatttaaagctggaggatggacatctctgtcttggaaatgtggaagctacatatatatataggtgatggagtcacctctgtagggatgagagctgagagccgaaagcaaagaagtagtaagttctgtaagagaagagctacatccaagatgaacacaggctacagatgaagcctcgtatttagcaggaggtaaatccttcaaggaaactgagagaagagcgaaaggtatgagaaatcagaatgatcaaggtcagaaaaactgagtagtgattgagtataaaggtagaggcacagagcttatgagggagagaaagaagtaggggatggttctgatgtttctggcctagataatcttagatagatgactgatagttccatttcaccaatatcaaaagagcagatttgggggaaatatgttgtctgagatacctttggaatcctgggaggagattctccattggagagctttgaatttgtcctcataagcaaaccagagaagttgcatttctcagattggcctccccaggaagatttttatacaaagagtttatgagagaacaccgtcagcatcagtatctatgggggcgggctggcgaaggcagcaagatgggacagagggagcagctgcagttccagcaaaagcctcgctggtcttatggagcacagtgaagctgggagagcccttctgagttgtcccaaaatggggaccagtcctgttgggtaagtcccatgcgtacgacctctttgaaccttaattacctccttaaagtccctacctttaaatacagtcacatcgtagggttagggcttcagcgtgtgaatttggggcaggggcaaggggtgggagacagtgtgttccataacactgcagagtggaaagggcccagcatagtctcggcgctgagtgactgttctgcttgcagacggtagttatcaggcacacacagtctctgtggatgccaggttggatgctccatagtggcaggagataggtcggcctaggtgagggggacccacacattcctctgtgctaccaccatggccatccattcgtgtgccagcgctgggttatctggtgatggagccacagtcattctgtccaccttccatttggtgccttttctgtggtggatgcccgtggtgggcacgacctgcaagacacttgatgctgttcctttagctggatcctccttgttccctcccttccagtcccctgaccgaccaaccaggtgatctgccatgcccagcagatccacacgtgtaattgcctcaggccacttctcttcacacagagttgatgaccaaatgtgctgcccaggctctgcccatagggggttcccctgatcgctgtctttcaagattgagccatcatgcagccgtttctttcagctgccactcatgtcctgagccagcctgtccatttggctgttttcccctctgtcacttggtcatgaggggcccaccagctgtggtagtcggtgttagctgggaagaggctgtggtgcagcagaggtggctgccagggtggtctggcatgcctgcttctgcagctcacccatgccctgcagccccacctatgctgagcccagatgcccgtgtccatctgatgatgggtttctgtcggcccacctggcttggtaacttggtgggtctccactgctgaccacatgctcactttgtggcctacagacaggcacttcatggtgcagcagcagtttatgcaagtgggattcttggctgtttgcgcacgccctcgctccaggattctacggacccccattgtggttctcctttcctgccttgctgtaaactccgcacggtgtctttccccccagatacttggaacatcacgggatctgccaggttgtacccaggcctcagggaatgagacagacccaaacccctgccctgctggagcgtgcattcccaccaggcgcctgtgaagtggcacaggcctttatggctgtctacactgctgtcagactcctccactttcataggatggtctcactaacagatctgaagtccagagcaggacaccagcccctgggctcttgctgggcttttacgttgagtggtctgctgggcagcacagaccagactcttgattttttcctaagcttcctaagttctcttctagggtccgcacatgggtacacccaaacctgagcacttagcctcctgctgaacttcttcactcagctgtgtctcagttttcttcacataagtatgataaatcaccacgtagagaactcttttgttaaaccaccactggaaattatctgccgtatttgtgtgcatgcacgagtaccgtacagggtgcagttgtattggaatgtaataccaggagaaaagtttattttcatttacttttcaacaaataagtacttagtgcttattatatggtaggcctagagctggacattgaggacacaggtgtaaaaaagatagcccccagtcctttttcttatggagcttaggtcctgtctctcttgcagaattagcatgtttcactctttatcagtaagaagaccaccaccatttattttgccagtcctatagtaagtactcagtatatgttatctcatttatgcccggtgtacgcctagagagatgcaggtattccctcatgaccccggaggctcaggggagtgcttgcttgtccaggggcatgcagctgttgatggggatctgggagtgagacccagctgtgtctgactctgaggtctctgtttctgatccctaactcatatacctcccaatatgagagctccttggtgatttgttttcccccttttcactttggctggcaggaaactcagtgccaggcttcaggtttaattagggttaagttagaacttttgcttccatcttcttctttatgtttcaaatacatgtttttgttgtttgctcctgtatcttttattgtaggcaatctcatgctgtgtatttcatttaaaatacaactgttatttatttaaaaacttgatttttagatgcttttcatagaatctgagtttatttagtcagaaagtcattttttttcagttactaactgctgtatgttacacatgatctgtctgcagtttttcatttcaggtattccaaaataacactcaagtcttgattcagtgttgtatttctttagatttctcttgcctgcttatgccagagttcatcctgccatctggcaggtgctcgctgccaccccctgccacgtgctcctcgtgtggctctgggggcacagttagacagttagactgcttgggaagctctctgaccaatactggtggcttcgctgtgggcacaaaataaatgaagaacatgtcctttccctccgtgagtttgtggccaacttcagggagctcaggcagttgtagttgaaatagatgagcatccaagaaacaaggaaatatttactgaagcacccatgcagtgaaaatctgaggagagagccactggtgtggactgatgctgccaaaaaagatttcaggaagtagaaggacgggtggaatttggatgggtggagagggtaaggcacatcattccagaggagaggaccagcaagagtgaggcatggaggtgctaatgagaccttaaaaaggagagacctccaggagccctgtgattgacatgtgggcagatatgtagtgagaaatgggaaatgatatagtaactgataatggagggaggtagtttaagcctgacaatagatttcggcttggacattggctgtgaaaaattgtttattcagtaacaaagataggacagttatctcagaaaaatgtcattttattgcacagtgtaagatggacgggggaaaggagaaaccacagaggaggagacaaatagaaggaggtttctaaagcccggctctcagaggagtgccttggctgggctgatgctgtactctggatcgagctctccttcctctgttcactccctaaataggttgtttcccaagactcagttctctgcctactgagcttttcacgttagacacccaaggggacccacccagcccctgtcctcaccactttattgagctcatggctcccatgagtccctcaagatctagagactggacctccctctctcctggggctccagaccgaaatatcctactgcctatagtacatctccacttcactgtcccatcagctcttgacaggtactgtttctttttttctttctttttttttttttttttttgagacagagtcttgctctgttgcccaggctggagtgcagtggcgtgatcttggctcactgcaacctctgtctcctggcttcaagcaattctcctgcctcagcctcccgagtagctgggattacaggcgctcaccaccacatccggctaatttttgtatttttagtaaagacggggtttcaccatgttggccaggctggtcttgaacccctgacctcatgatccacttgccttggcctcccaaagtgctgggattacaggcgtgagccaccgcacacagccgacatgtactgtttctttgctaaatttgtttccctttctcactccctacctgatgaaaagcacccattgtttacccgaaagtccaaacctagggtttcaccccagacatttcccacttatacatccatgtccttcctgccttccccaccagttcagccccaaagagtctccctccttgatgtaagtccgtcattcatctccagtgctgtagttcaggccaccggcgccatttgcctggatttcttccctcccatctccatcaccgactgcctccctcctgagcctgccccacagcctccaccagtgatctctgtgaaaacagaaatctgcttgtttcactccagctatcatccttcagggcctctccatagctttcagggtggttccaacacaaggctcctgcctgctatgtggccgcatctcctttctgctgccgtgtgcaagcccttaggccagccatgcctcaccgggttactcacagttaactgctgctcatattgtttcacgcagtctcacctttacatcttccctttcctctctgcccagaatgaacttccctgtaccaaccccttcaccccacccctcccacatacacatcattttcacttgtctagctgctatttactcggcattcctgacaaatatcgcctcctcagggaggccttccccagcttcctggggggctcccagggctctctctgcccctgtagacactgcctgtctctcgtggcaccgcaaacccgatgttcactggtgatttactgccctttctccaccagtgtgtctccggatggagcagacttgttttctgtatatctccagtgtgtgaataatgcctggcagatgttaggaactgtgggaattaatgagcataataaatagatacagaaagactttaagcaagctgaacacagatgaataatcagggctggaaacatctacagaggttgagtgcagtggttcacgcctgtaatcccagcactttgggaagcccaggcgggcagattgcttgagcccaggagtttgagaccagcttgggccacatggtgagacccccatctctatttaaagaaaaaaaaagatctacggatactcttgagagaacagtagaaagcaagacccatgtctagagagtgcaaagagggaaaaaaaagaacccccagggaccaaggagaaaaccagttcagtggccagggagcctgcggagtagaatgtttcaggaagagtaggtgtttcaggaacagattcagacgttactatccccgggcgcccccccccccccccaggaaaaaaaaggcaagtgaagatgatactggaagaccaccactggattcagcagaatgagttcacttttgaaaggggcttcggtggagagatggggatgagaagcgctgcatgagctggaagtgggggaaggtcaatatcactctgttctgactggctgccctcattctgggacatcactgtggtcacgctggtccccgttcaagttactttcactctgtgagaaagtcaatatgatcttatgctcctgaagcatttttagtccactgtgtggcatattcccattccacagctctgatgaacagtgaccagggtgatggctctatagatctcacttcaactgagacatgagacctaggtgctgacaggggcagggtacagtggtcccatgctcatcattaagcacaggcatgtgataacgtcatctagtgtgctttgacctcctacagatctttctggacatttcccgccagcactgactatccagaggcctttggaggcttgtctcatgggcctgtggcagtgaagatggagtgggctgcagagtattagctgcagcctgtggtgcccacttcttatctccctccacatccacagctgtcccattcttttgtaaactcgggacactatgctggacacacataagctgctctcagtagttccttgcccgctgactcactcttgtctcccagcagagctgccttctccaaagcaggtggcatctcagagtcattttgctacttgcagctgtgatcatctttacactgccagggccattacataacttttcatgggtttgtgttttgttcatccccagtagaatatgagctcttggaggacaggagctgttgtacttctttgtcttttggctctaatgcagtgtactgccctgagggattaaataagacgccgcctgcgccttcaagaagtttgcagccagcgaggggaagacatgaggctgtactaggcactaggtttctacaggagtctgtgcaaagagaagaaaaaagaaccctgagcctaaacagtgggtgtggccagttctccctaagggatacagcgagggtaatcttgaggccagcattggggcaggtgtttcagtcacggggggccttatgaaaaaacgcacaggggctcaaaacagctgtggggacagcaaggaattgcattcgcctgagattgaggttcctataagaaagaggcaatgaaagacatggttgggaagagagcagaggccaggacgggtcttctaccaaactaagaattgctgttgtgttcatcctgccagaagtggtggatcagtgaggccttttaaacaggagagtaagttagatttatttttaagaaagctcactttagtcataatatgaacgttgtctgaagggatgacggtaggctggccacagtggctcatgcctgtaatcccagcgctttgggaggccaaggcaggaggatagcatgagcctaggagtttgagaccagcctgggcaacatagtgagacctcttctctacaaaaaaattttttaaatcagctgggcgtggtggcctgtgcctgtagtcccagctactcaggaggctgagatggaacgatcacttgatccctggaggtcaaggtgcaatcacggctcaaaaagaaaaagaaaagaaaaggtgacactagaggaagaagaccaggtgggagacagtgaaaattctgtgtgctcaggatattgttggtgatgagctagagcatgcttagctcatcacagtgaaggacgagggcaggctttgcagagcctccttgtcttcagacctccagatcaattactggagtctcctgtagtaatgatcatccgaatggtgcctgtgcaacctgagtctccacagcttcacggtgcatgtctccctccctttgctcgctgtagcaaagaagctctgtgtgctgtgatgagaaagatgtatctgttctctaccactggcccctgacacacagcacctaaagcccttggaatctccacagtgagcatagggtccagccctacagggcttagcaggtgttctccccatgtgcggagatgagattgtaataaataaagacacaagacaaagagataaagagaaaacagctgggcccgagggaccactgccatcaagatgcggagaccagtagtggccctgaacggctgggtgcgctgatatttattgcatacaagaccgggggtcagggtaaggagggtgaatcttctaagtgattgacaaggtgaagcaagtcacgtaatcacaggacaggggggcccttccctcttaggtagccgaagctgagagagagaaggcaccatacgtcagcgttttcttctatgcacttataagaaagatcaaagactttaagacttttactatttcttctactgctatctactacgaacttcaaagaggaaccaggagtacgggaggaacatgaaagtggacaaggagcgtgaccgttgaagcacagcatcacagggaggggtttaggacttcggatgactgcgggcagactgggataatatccagcctcccacaagaaggtggtggagcagagtgttccctgactcctccaacgaaaggagactccctttcgcggtctgctaagtaatgggtgtcttcgcagacactggcattaccgcttgaccaaggagccctcatgccggcgtgacagagggctcacctcttgccttctaggtcacttctcacaatgtcccttcagcacctgaccctatgcccgccggttattcctaggttatattagtaatgcaacaaagagtaatattaaaagctaatgattcataatgtttataatgattgataatgtccatgatcatctctatatctaatttgtattatgactactcttactctattttcttttttatactgaaacagttgtgccttcagtttcttacctcggcacctaggtaatccttcgcccacagtgagaagtgtcttttcacatggatgactgatgtccaggctctcctggatagcctcagatgggggctggttaccaggggaactaataagtgattagagggttgagactttcagccccacccccaacctctgtgattagggagaggggttgagttgatcaccaatggccagtgatataatcaattatatctacataatgaagcttccataaaacccccaaaggacagggtttagagaacttccagattgctgaatatgtgctggagcagggtgcagggggtgccagagaggggcaggggccatgccccatgccttgccctgtgcatctcttccatctgactgttcatctgtatcccttgcaatatcctttctaataaatgggtagatgtcagtgtttccctgagttctgtgagccatcctagcaaattaactgaacccaaggagtggaccacgggaaccctcatttatagcacgttggttagaaccgcaggttaggtctggcgattgccatctgaagtaggggagcagtcttgtgggagtgggcccttaacctgtgggctctgatgttatctcctgggagacagtgtggggattgagttaaattataggacaccctgctggtgtccactggagcactgcttggggtatgaagccccccagcacatctggtgtcagaatattgtgttgagtcgtgtgtgagtgtagaaaggaagaaaacagtgttgtttttcttcagagccatgctcacaatagaaagcagcgtaatataatgaaaagaacaagaatgggcagttagggactcaatcctgggttgacagggacatctatacacaatctgtagaatactgttgtcattggggataaaaaaaattatacaaaattaccttaggtaccagaggctctatcagatattagttattatcatagtattgggcatctgtttttgtggctctcaggaagtttgagagagtcctaatttaggagccaaccttgatagttattactcgtaaaagcttgtaacctctagagcaacagtcagcaggtgatggcctgtgggccaaactacctgtttttgtacaatctgaagctaggaacaggttttacattttaaatggttatataggtaactacatagtatctttgatctcttgcctctttatcttccaaacctaaaatgtttaccacctggccctttacagaaaaatatttgccagtccctgctgtagaaggttatatagccagcagctttcaaagtaaccttttacctggaaatgtgaattctctcttagttctggtcatctgttatttgtgggagccaatcctctctctgttggctgatgatgagaattctgttatataccacaacacaaacttggggataaaactttccattaggcatttctgtaaaatttccatctattttagaagcagaactaaggtgaagcccagtgtgaatgaatcctgcttgttggtacaagccaagtgggacatttggcagcaaagcccaggagtccttggtgctcttcttttaactgcctcctcatctcattgggctgcccggtgttaactggttgattatcacctctgtgttttgcctgcaaggaaagaagctactgacacccagagtggctcagcgatactcacacgtgctttcagttactttcgcagcatttggttaaagtgagtttagctgcacatcctcacttggtaacattctgtggctgtgaaaattgtttctctctttatcctcccccagcaacagccatttggtatcatctgagatgtgcaccaggaggcagatctgccctgtcaatcatgagagttcctatcattaatcaagtattttgaattcaataactttttttagtgttttaaaagtatttactggtccttgatgtattttttagcagctgatggaattcacataccatataactcaccccctcgaagtgtacagttcggtggtttttagtattttttaattgcacaaataccgtaatttgagaacatttttcatcaccccaaaagaaactgcgccccattagcagtcattcccatccgccctgtcctaggcagccacttaatctactttctgtctctgtagacttgcttattctggacattttatagaaatggaagcatatgtagctgatctttatgactggcttctttcgctgagcttcacgtttctgaggttgacgcatgttgcagcatggttgattttccctctgtggtttagatagcaagatctgcctagtagagctttatgtgtgcaagtgccactccaccagaccagtttctgtcactgccccttcatcaggccagcttccttaggaagcttcctgttgcctcttggcctcaccagtgctaccattttcattaccgtctattccgcagaatacacgcagtgccaggctctggtgagtcccacagtgaccaaggcagcacgatccctcctctccctgagcttagagtagaaagcgtcagttacagtgaaatgtgatggtcactcttctgggagaaatgtgtagtgcagtcaggaagagtcaagaaattgtgtctggaggcagcaccgtcggaaactctctacctccgtctccacccctgtgtccggggtaggggcagtgcacgtgtgttgcaaaggagtccaccaggaatccaaagggagcgaattctcatgtgtcccgagcatcctcagagacagcaagctggcacgtggcaccctcctcagcacttttcctttttggctatgctctttcactttttggtgcaatttgatttgaaaacgattcttttcaagttgctatgcttccttgtcaacaaagcagtctaatcagttaaagctagttcttttatgactttcttctttcaagagtttataagtatatagcatcagatgtggaataagttactagtgcttagttgataaaaatctgcaaattaaatgaaaattacttgcaagaactctattttcagtgaagttacagctacgctgtttatctcaatctgtacctccttgcagaagctactgctgtgtttccagtgcttttgtagttgatcatactgatctttttgacaaaattcagaacagaaagataggatcaatctaaagtgtgatccttttccaagactgactcattaagtgaccttgagaaaatcatttctattttccatcctgccttggtgtcttcatgagaaaaaagagcgaggtacagtctcatgatacctcagaaaacaagcaaatgatgatgatgtacttggctttttgaagatgtaaaagttatcagtaatcctaattcttttcctgggttttccttttgtcacttattaatcagtttttgaaaggacgaatgaatttagagatgtactctggagcagtatcatgttaaaccaggggtatattagaaaaatcatcctcataatcattctgggaagtttttcctccccaaaaaaaagccatcctgatgggttttcaaaaccagaaaaaagctcttaatgaggaacagaccactggagtacccatgagcatctcaggaaaactgagaccctcgagaagccttgatttcgtgcaacccccaaggtttcagagccagcagcccagtgctgtggttgacagacgtggttttgtggagaaagcagccagaggccaggaattttcagagtcgtgagtcacgatctcccacccaagattagagcacagattagccatactgagatttggtaaaatcattctgtctaagcaatggaggtgtgtgcacacgtgcagtgcctgttcacaggggatgcaggcagatcgtgggtttaggatgggggaggccaccgcaccccccttcactgctctgcacctgctccctcacgtggacactgtccacaactgtggctctcacaggacagttgcccaaggagctcatatcttattggagatagggggtcgtacaggtgacattcatgagcagtgtgagccgggtgacatgggggtgtcaacccagcatctgtccaggagctcctcctgcagcggctctggcaggtggcctgaggctcctttttgagagagaactgtttggccttccagatgttctttaatataatgattgggaagagacagctcataactagcttaaggctatctagtccagctttccattttacagctggggaaacccagactcagggttttattctctgttcacttggcggcttggctgagttctgtggaagttcagcagagcaggggaacaggagggtttgggttgcagagaaagaagccacttacagatgggaaacaggagttgggccctatgcaaatggaagggaccagggagggcactttaggtggcagggacagtttgagccgacatagtaatttaggatgtaatttagagaagtaatttacgatggggctggtttgggcagacctgcaaaacaggacagactcagacaggatgcccgagggtttttggttgaggcagtgtcattgtgaaagggcttcttgtgcacactcactgaccgtggcatgcagattggattggggaaatcttactggcagtcatgtcatccaagaagttgttggcataatctcggagtgcaacagcaaggacctaaacgggcagatcctctcccaggggaaaatcagtagtccttcagcgttggctgggtttgatggacagaggagagctgagtccagacatgagctgggaagtggacatccgcctgccacggtgaacgcagataggcaagtgcgggaatgagactcaggtggtcactgaagacatgaaaatggatgaactctccacggaggaaatgtaagaagaggggaaaccttgagtaatccccagtctcatttttaattaggagtttcacctctgtttctgtcaaaacatttactgtaacaagtaccaaaactaattttaattttgacttttactttataatttgtgtgtagagccaatgctgggaaggaaaaaatgaccccaaatttggcagacaaaagaatgaaggaagggaaaacagaatatacgatgcagaaatggataatccacactctgagagatgcacttccattcttatgtcttcaaggccactgtctcagtcctcgctgtgtggcccttaccgtcaccagcgttcagtgcttacaggtgtgtcactcagtcgagggagtgaggaagctgcaagacaaggccttggcatgctcttcctgcgctgatgtccctgacctgcagctgggctgtgggctgtggaaccctgtggtccccccacgccaccctctcaccaccacctcctcctcacagagcagccttagcattctcattctctaccaaaaccaaaaccaaaccaaaacacaggaaaaggttgggacacctctggtcctgacggtccctggaggaaaagttccccatgaggagtgatgggtcagtcacgttttcaaaacaaacgagagccaggacgcaggcctgtggctcagcccgcagcgtgcttggtgccacaagcccccccgcagctgcccagagtctcaccccactctgtgcagggggcctggagggcagcggcggcacagacccactggacgccctggtgcatggctgagccatgtgcatcccatggctctctccagagtcccttccctgcacctccagggcctccccagatggaactggctgggagccgtgctttgttgaaacaaagggaaaacctgtctctcttgggtttgcagctgctgttgaaaccaactgaacctgtttgtaaaattgtacctatgtcacagtaagatcagctgtgctaggtatgtcaggcctctgaaaagaaatgtcattaaagtaaacaagacttgggacacatgtctgtcagactgtacacagtagaagcatcccttgcaggggctgttgggttgcatcctaagctgtgctggagcttcccgatgtactctgtagatgtctttgcaccttctgtcctcattgccatccccaatcagtccctggaacaccagctgtggccctgacccttttagcccctgcatggaatgcacaggcaaggcgtgtggcctttgggactccagccgactagagcaagacagaggaagaagagacggggcagagggcagccgatagttggaaacttctgtcccctaagccaaaaggttctcaaaactgagcaacaggatgtattgtgtctcctgatcgtattgccatggaaactgccttctgttctgcctagaagaaatagtactgtttgaagtatctcatccatcaacactggtcactgtgagaaaccacaaaggaaaagtgaaaccgagagctgcaaaactagcctgggactttgttcaagcgatcatctcctttccctctagtttattattttttccaatacctactgagactactgctaagcagcacagaaagatacaatacactgtttttatagcacgacacaaagatcatgggtggcacttcacatgacagggttagattcagtcttctgagttttctaaggttcctatttttaagactttaccaaggaaccaaggctttcaaatatgcagcatggtttcttctgggcctcgcgttgccccatctcttatccaagtggtgaatgtgttgccagtttgtgtgtggttctggtggtgggctttgtttggttttctttttttgggctttgtttggtttttccccagttttgccacaaagcttttgctgaggacagcagcctctgtggtgtcttttctctctgtattgtgctcactcttgtagtcatgcaccacataacaatatgttttggtcaatgacagattgcatgtatgacagtggtctcataagattatgatgccatatttttgctatgtcttttctatgtttagatacacaactaccattgtgttacagctgcctccagtattcagcacagtgacttgctgtacaggtttgtagcctggtcgccataggctacaccaagcagccttggtgtgtagtaggcgatcacatctaggtttctgtaagtacacagcaacaaagtcacccaacagcacatttctcagaatgaagccctgttgttaagcgacacgtgactacagttttaagtctaacaagatgcctctcgttcagtcctgaagtgcttcttgtttagtttttaatgtacgtttgttttgttatctcagccaaactcttttcagggccataggaaattagtcatttctctgtgtcacagcctccttatctggccccaggacagcgcactacgcatagaaggcaaatgagtaaaactaagtgtaagcatattcatacttacaccaaaagctgcagcttccacagagcacagggaattgcaaataactgtcttctatgaggagctgccatttgtggtttcaccagtttcccagcattgcttctttgtaactcctggttcttgtattagaagaggatgctatgtccatgaagaatgtaggtatcaagcatgtcctttgggagcctccttgctttaacccctctcaccccttccaccccgccttcattagtaacccatcacctgggtcttcatatcccaactaactacagtcttggctaagaaaaccccatacgccttaactcagcaatatgcctcactatgtctttgtccattcagttatccattttgcaactgtttcttgagtgcttgcatatgccaggtcgtacaggaggccaggtctacaaacaggacaagatggagaatcacagtccccgtggagctaataggctgttgtgagattcaggccggttagcctgcaagtgaaatgggatgtgctgagagctgtcctggggaagggatggtgaggtgtgagagcacgcagaggagtacagggtggtgagagcaggctccccagcaggagtagagaatgtgagggcggtgttgtgagaaagtgactccagtggcagacaggagtctggtaagcccaggtaagaaatttctgtcggattctgaaagcaacagggatgcattgagtagcatcaaaggggaggatgtctgtagtcatccgaaaaggcccttaatgtactctccctttcttttctaactgtgtatctatgtggctggatttgcttcatgtacttcaaaaaccagagtaacagaacaaaatcgaatgcagaagcagatgggagaatccagcaaccttctagtaagtcagacattaaagagatttgcaaaaatggaaaacagtgccactcttctcagtaattctgtttgggaaaacatggttattttttatttcaaaaatctatatttatgttagcaagtaataggcttgtgattgttaatgagttattaaatatttttaaattaataaaagggcaatgaggagccagcaaagggtttctaagtagaggaggggcttgacgagatttgtatcttaggaactaactctggagccaccccggccatggactgtggtctcacacggggcagtgagagtgagggtggagacagtggcgggggagttccagtggacagagcctagagatctggtttatgcagtggatggatgtggatgtcacaccccaagacaggggacacagcaagagatatggggtgggagatgagtttgtttgggacgtgttctatcttaggtgtctccttaacatttagatgaaagtgtgttcaggagacagtgggttacatggctctgagacacagtgtttgggttggaggttcgagtttgggagtctctaccccatgaagccctaggaatggatgggcacccagaacacggaagaaggagagaaacactccccacatggaaccttcaagaacacccgtgtctgaaggacaggagtgggaggaggagaatctgaggacactgagaaggcgtagctagagggctagaaagaaagcgggatgccacaaagcctggggaagagaatgtcgaggaagagtggtcagtaagacctggtgctgccagaaggcaggtcacagagcgctcaggaggatccactggatctaacaaagggtgctttgataacctggaagaaaaaggaaaaagtgtttcattattaaaataccagactatgagcttctaaaaggcagggaggttgtcttaattctctttctacttttgttgctgaaagtattaccaggtacattagtagatgtgataattttgtgattttacattaactcattcaagtaaaacgatctagtctttttctgcccttgatctccgtggtaggtcatcccctttgtcagagactcctgttaaatcaacctgtttcctaaatgtgtaagtatttccttatggcctggggtaaagcttcccagccactgtgccatggtcatagatgggctgagatactggtcccctccccgcttgggggcaactggaaagggcctgaagccactgggccagctgtaaacagttttggcttttcctgtggaccatgcaaatctgtctttttctgtgtgtgccatgaggtggaaaacatttgaaagccttggtccatagcacactgagtaagtccttgtgtgggccctgcctcgcctcccgtgtgcccaagcacagcacccctaaagagtcacatcgcccttcgctgcctaccccatggtctcccccagaaccttccctgcatggtggcctgcagggggccaccgattgtagactggaggtgcccctgctgtgtgcttcacacttcaaaacctggcatgctgataaaggctttctgagcaccaaagactgagaagaaagggtgcatttgtttccaatggccaacagtcttaaaataagatgaagatgcttttggaagtcattttggcttttctaaaacatcgcattcataatgccccctctgtaattgttctccattttactcttttatggggcaccaacttgtacgagcagtcagctcaggctgcagtgagctgagagtggtactggccacctgggaaatatgttcaggtcttccatccatcacagccctccaggatcctgtagtctagttgggaagacgagaaacaatactgtataaagtataaggccaagtagtaaggatcagaataatcatagctaagctgcaataagcttatagatggctttacgttctattttaaatgtttcacatgaattaactcttttgattctcatactctccatgtgaggtgggtgcagttattattaccactttacaggtgagaaaaccaagggtcatggaaatgtttgaaaatgcatctaaggtgttacaataagaggcagagctgggatttgagcccagttattctggctctagagactgttcttaactcagcttcctctacctttttgtccctctgccgttattccttagcattgctttgctccttgaaggcggtataaacccacttaggcccctttctttgaacaccttggggaaaatgccttgcttgctctcttctccatcgttgaaatcattctcttttaatattcagccccagccccatcctcttggaagtcttacccctgtgctttggccgcagtgggttgatgtccactctgagcttttctagtccttttgatttaggcctcacagctcccatcttaattatatatcatcttgcattgttctggcttttccatttctgggtatcttgccttcccccgaggagatggggcgctcttcgggagcaaggatgagaccgcgtgcctggctcacactctcctgtggacgctcgagtgcccgaggtcagccacccgtgagctcttctggcttctctaatgtagacactgcctgaccatcccatccagaaacctttcaatgcctgtagaacatggatttctgttccatggaacttctgcttaataaaatgtcagaaacttttactgctcctcggttgggaaaccatcatgtatgtatgtatgaatatatatttattcattcatacatgtatatatacacaagaatttttacttcatttgaaatcttcttacaaactaataataagtatttcataaaacgcctgttcaaactgcaagctgtttccttcttcacttttaaaatatgtggttattgcttttgaagaagacaaagtaaaggaaacatttcctgtttatagaggctcatatttaaccctacgtaaagagcagattcatgtcaaaacatcctagaacctagagccgtaactttctgctttttaagcacttttctactatcacaggagtagagggattggggttttgtttgctttgcctactctttgattctctcactctcttgtaagaaatgaaatggaactcaaagcccattccccttccactgtcctggagtgggtgtgttgtgtgcctttgcatgtttttgtatctttactacatacatacttatcagggtttctcaacctaaacaccattgacattttgatccagaccattctttgttatagcggctgccctgtacattgtaggatgtttagcaacatccctgacctctacctactaaatgccgacagcaccaccatcctgtcccccctcccctccttcacataacaaccaaaactgtgagcagacattgccaaatatctcctggattgggggtaggagaacagagtcaccatgaccatatatccatctaaaaaagttaaaatagaccagacgcaatggtgcacatctatagtctcagctactcaggaggctgagatggaagattgcttgggtccgggagttcaggactgcagtgcgccatgattgtgcctgtgaatagccactgctctccagtctggacaatgtagcaagaccctcatccccaaaaaaagttaaaatagtatatatactcgtgttctgagtattttttaatttatgtaaatagtattacattttatttatattatttacataaactacatacaatttatgtaaatggtatatgtatatgttgtatatgcatattcttgtacaactttatttgttcattaaacattgtatatttgagatttacccatgtaaatctaattcatttattgtagctgcttttataatggtcttttatataatagaaccacttattaatttatttccctccttaggaacaactgaatttttttcattttcttacttaatattacaaccagtgcttcacagaagatcctcatacatgaccccttcagcattcacagctccctagaggtgaagttgccaggtcatagactagaatagtttcactagatcttgacatgttgctctccaaaagggttgtgtcagtttatactctcatcagcaacttatcagagttcccatttctttcacatcattcccacactcagtattgttgggctgtgtatttttgcgagtcttgtgggtataaaataacttgttttcatttgcctttccctaacactagtgagattgaatatcttttcatatgtttcttgacttgggatttccccttctgtaaatggagtattcatatacattatctgcttttctcttgagtcacttatttttttctcattgatttataagtgttgtcttataagttcataagtgtcattgatttattaagtctcattgatttgtaacttttgaattttgagcatatagcagttatatgttgtaaacattttctctcaatctgtagtttgtcttatttaattcagtaacaattgaacttttaatacaaaagttcttacaggtaaagtaatttttaaccacttttttcattgtgatttatacttcgtatttctgttttagatatcctttcctatcctaatgacatgaaaataatctcctatttcttcaaaaaaattttcacagtttggctttccacatttaaatctttaatcttagtttttatttttgtgggtggtgtgaagtaagggcctagttttatcttttccctatctatagccagttgtcccaggactgtattcagtacgggctcataaccaagtgcccatgtttactgttgattcctagactctgtcttctgtttggattttttgcctaacttccactaataccacatgactttaattactgcagtctaatagtaagtcctaataactggtagagaaatcctttcttatatttcttcaaaatagtcatgcctagttttgagctttaacttcaagtagtctagtcccaccaaaatatacacatgtgcatacttttgaattttgagtatatagcagttagggaataggaataataataggaatctgactccacatgacagataacacaacatagcagaaacttaaccgaggtagtttatttctgtcttgtatagaagtccagcagtgggcagcccaggccggcggggcagtgtcctgaaggtgtcagcccccggctctttgctgctgctgtatcctcagcacagggcttccacctgatcctctaagaagggcgagcccctgcctctgaggatcttcctggtcggcccatattccctttctgctgacataccattgtcagaacctagtcaacatggaaagatactgagaaaggtagcaagtcacacgtatatacacacccaagaaaaccaaaactgttttttccaaagggggaaaatggatattggaagtgaaccagcagtctgctagactggagttggcagtgtctggatagattataggattacatgttaccaggctcaattcaggaacatgctgaatctttccatttacttagaaatcttgtagatcttttgtttgattttattcttaactaccttatatttttattgctatttataaatagtaattttttgtacttacattctctaatgatttcaatagagggaatgttactttttaatcatactctcttgttctcatgctttgagagacatttgtaaacactcttggattttctaggtagacagtcatcatttgaataatgagttttgtttctctttttctatctttatgtgagatttttgtttgggtttggtttttgttctcatgctgtgacttgtgctgaatgcaagaattggtaataggcatttttgtctcttcatgaatgggtattgaattttgtcaaattgttttcatacctattgagatgagcgtttgatttttctccttcaaactgttaatgtgtggattatgttgctagtttttctaagatttttgagataaatcctaatacagcacatcatactagataagagaattattttgaaaacattgttggattgaatttgctgatattttatttaggattattgtatctacccaagaaaaattaactatatattgtataatttttcttgctcataatggccttgtctagttttggaaacagtgttatgctagtcccaaaaaattaggtgggaaactctccttccttttctgtactctagagcagtttatataagataaggagtcattaaagatttcatacacttcacctgtaggtttttggtgggtagatttttaagtactgtttcaattacattaaagtatgatatatatccagaaaagtacatgctatataataatagtcatacaaatgtactttttgtgtttattttgttcaacatcatttgagagattcagccatattgttgcatgtcattctggttcattcattcaaactgctttattagattacagtatgtgaatgcaccataacttacccattctatagttgatgggcatttgggtagttcccgtctttgactgttggaaataatgctgctgagaacgttctagtccatgtcttttgatgaacatgtgtttgaatttcttttattcaggagtggaattgctgagtctcacatatggctcagcttaagtagatggtcctgaacaattttaaaagataattaccaatgtctgttttctctagaataagttttaataagttatacttttctagaaagttgtctttcatcaaagttattggtatgaataaagtattcttgtgatttttttaaaatctgccattatatcccttgtattattcttaatactgtttatttgtgctccttcctttgtcttttcatcaagcttgccaggtttgcctattttatttgactttgtaacagccagcagtaggttttagtgactccttctgtttctttgttttccgttttactgacatttgctctcaactttctactttcttctttctcatttttttagattattgttactttctctaacttcttaaattgggtatagttaaccctttaattttcagttttctttttttaatttaatctcaatatttaaaaattacatcaaccactttattacatcccataaactttgataggtaggtaatagttttattcattcttagctatcttctaatttccattatgaggatttttttggtttccaaatgtgtgaggttttttgttttagttattattttgatgttgatttctcatttaattgcattatggtgagaatataatctgtgtaatgtttatgatttggtatttgtgaatatttcatataggatctagtacacaattactttgtaaatactttaaatgtaatggaaaagaatgtatattctctaaatattaaatgcaaggtatatatgtccattcagaaataaacttgttattttttatattattttttgtctggttgatctatcagttactgagttatatgctgaaaattaaatatatgtctggatgcttccacttctcttgtaattctattaatttttgctttctgtgttttgatgccattgtgttacatataaatatgatattcatgtattctattgattttatccctaatactgcctttttttgccttcgaggtctatttatttggcatgaatgtagcaacaacagctttctttgattagtatttctctgatttttttccatctctttacatcaacttgtgtacgtctttatattttagatttatcttttgtggggaggaggtgagaggtgagagtggcttctgtttccctaattttttttcacatctgttttttctcataataccttattcttttctttaaggtcctcctgtgacgtcctagtctttttgaagtgtgtaatcattttcagatcctcctatattcaggtccttggggacccagtctcttgtgtgttttgtgtgccgacttgctcatcatgggtgatttccttgtggattttgtggttttgaattctgagtttttccccactggagctttaactataaatcccatgtaaccccaaggcaagagaatatctctccagagtaattttacatttgcttttgcttggctccttcgatatctccatcccaaaaccaatctttatgtaacttttttgatgggttctgagaccatgaatataacaacatatgtatagtataacttgaaccccaaatttgcctgtggttcttaattctcaggcaggaccaagattcctgctgtctccgggggaagacaggctttttagtttgatttttttttcatccctttcgctgagggtgctgccatttgaagattgtatctttagacagataattgagctcaaaattgctgcctctttcagacccaaggccgcatcttccgaactcaaacagtgatagaacccaagtggtcctgggtgagcagggcctctgctcccccgtctcccaggctgctcacagtgtgcggctctgcttcccacgcccacttgttcctgaggccttgcaactccacttacttctttcatatttagctgtgtatagaaatatttatctattaatagcatttttaggtgtttgtagtaggaagagtttcagatcttagtctataattttgtcaggactagaagacttctagaaatagagatttaaattaataaattcaaagattgccatatagctagaaacatggatttttttaaagcagcatgtgatgcatttttcttcccatggtggcttcttttttgttggtgacatagactaagccaggaacggcattgctgtcagtcttcaggatccgtggagccaccctcagaaagatggttactgatgctcacttctcacctttttgctgtttgtcagatttcccttcacactctctagcctgttgctgaggttttatcacagtctgcagtcttcctccactgtgtgcgctcaggatttacttcagtcataagaagaagaaaggtagagcaggggagcattttaagggccgtgatggaaacaccagatttctggctgccctcagtgatttagcctcgtctccatgccttccttcctatcacaccctgcaaagccctgagctcctaagagttaactggagttgggacagtcagtggcgtcacagtcgggctgaaattaggagtgtctgtacagtgtctttcactgccttccagagccacagtgcacaaagagcttttacactgcctattactttcttttctcctgagcacctactgcaggctgccaattttgtgctattgactgaaggatgttgtgatacttttgaatttgaattgcttgcatagagcggatcaatatgatacttccttcccagtctatagatgtaactgcattgagagaaagctcttccaagcattatgatgattctgctccttctgtgtctgataactgtgtgttgatctctttttagggaggaatgatcaattggaatcgtctttttcctcctttacgtcagcgacaaaacgtaaactatcagggcggtcggcagtctgagccagcagcgccccctctagaagtttctgaggaacaggtaattaatcagtaatacctggtactcattctaaatccatgtttcagagttgaagcagtttcgatcaacaggactcaaaagtaatcaagcgtgtaaatacaaagatggtgacagcagtccatctgccaccatgatagagactttgggcttttttttggctattgtggttcttacgagtttaaggaaggcattattggttggggggcggcgggtgggaatgtattatggtagcttgttttagatgctcttacacttcatatatacaagaaactaatgagattggttctctgtgaaggatcggggacaaggaggtgggaggatggggagggagtgtgcctttggcatggtttcacttttgtatggttttgagtcatgttaatgttttacatattcaacaagcaaaccaaaaggacagggacaaatgtaaaactgaaaagaaacaaacaaatgctctaactgcatttcaaatgaataacataatcacattgaaggagggaaaatggatttcagtaacgtttgtaccggatataccctcagtctaatgaagaaacaaaaagaactgcaaacaaatcttaaacatttcttcaaggtttagttttcataaaggtatgagtatagcaattctaaaattatgctgtgtgtattatagatttgagcaaatgaggaactcggttgattttattgtggaagaaggaaaataaatatataaagcagggaaaggcaagggagaaccctgtggggttggaaaggaattatcactatcatcgtaaactcatgagagagtgtgtgtgtgtgtgtgtgtgtgtgtgtgtgtgtgtgtacacataccctcactctgaccgagagggctcagaagcagtggcctcctggtagcagtgggctcacctactgcccagatctggtttctaaacactcctccccactaaaaggaaccaggcctatttaggaaaacggtggattccaggcccagtgtagggaacgtacaggatagccctggatcatcgtgtgccaggaaagtaaggaagtgatcagtcactgctggggcctgtcagaaggacactggagccagctgcgggatcccactggccacatctagggcatcggcttggggatcagaataaataaaggatagtaagaatacatgcattataatagtagataaatatttatataaatacatacactggagggaaggaaatgcttttcctaaatggaatgtcaagtaataaatatacaaagaatgatagtatcagaaaatcacaaatttgcaagcatcgtaataaaaatccattcagggaaaaatgatcaatatatgaagactaggctatttatatatagatggtccctgacctataatggtcgaactttaacaatttttcaattttacagtggtgcaaaagtgatacatactcagtagaagccatacatcaaattttgagttttgctcttttcccaggccagcgatacgtggtacgagactcttttgcgatgctgggcagcgactgtgaaccgttctgtttttcacttgcagcacgatactcaataattacatgagatagtcaatactctagatttgtgagagatgatttttgcccaactgtagggtaatgttaagtgttctgagcatctttaaggtaggctagattaagctgtgatattcagtaggttaagtgtactaaatgcatttcaacttatgatattttcaacgtacagtggatttattgggacttaactccatcgtaggttgaggagcgcttgtaatctcaaagtatccctccacaagttacttactaattataaaggaaaaccgtaattctacagaagagaaattggacaccaccttaaccaggttatcaaaattaacatcaccaattatggaacaaagaattattatgttcatatcctgaaaaggacctatcagttatgtccttgtaacatatgcagttacaatcaacatgcataactttgatcgtaagggaaaataagataaacttaatttgagggacattctgtaaaatacctggtctatgttcttcaaaaatacgatgttccagattaaaggagacttgggagtcatgctgcccaagtggaaaatgtgatcctggactggattttgtactggagaaaaaatgtctgatgaaaggccattttaggatcaattgatgaaattggactatggattggatattggtattatatgaattttacatttccaggacttggtacataccgaccgtggttaggaaagagaatatttcttgttcttagaaaatacacactgaagtatgaaggaaaacggcaccatgatgtgtgcaacctgctctcaaatggcttaggaataatacctgtgcatgtcagtacatagtgtgtgattgtgtgtatgtgtgacagagacagagagagaaagcagctatggccaaataacaattggtgaatctggttaaggaggaatcaagagttccaggtactattctagaaacttttctaagtttgaaattatttcaaactacaaccttttcaaaatctataaaagaaagttaagagtgttgccatcataatactttgaagtttccctctgcctgttgtttttccctttcagcaaacaaaacaaattgagatcagcatttcacagctgaccacaccatccacgccatcgcctccccattccctgtccccagagtgaacaaatgccacgcacctgcctctgtagcaaaactttgtcctcatttttcccaaaactcaaaaggtgcccctgggcagggatctcatagccacccatgggtaaggctgtgacaggtgttttcaagagaaaccactgtcacgtgcccattgacttgatccagcccctcccgcttgccacttctccactcagactgatggtttcagcagctcttcaggattaacaggtggagtatggagccacagttttcctcttctacctccactagagaatttctagacaaaggttatccccatggataagaaaagcccaataacctgccatgtgtaaaatcttcctataacatgtttaaaaaataagatactgctgtcaagttcagctgaaaagaaatatcaaaattccgttatgttactgtttacttgatacagcagtgagtcacattcctcatggggcagccgttaagacgaggtatttaaaggtgatatatttctcagtttgggcacttcaggaaaaaaaaagtgtcaaaaagggagtgaaaggagtatgtgtgtgattgaagtcttcagggttgtttttttttttgtttaatgagtcatttttccttgatcatcccagaatgacaacagcgaggttacttcttgtcaacatcagtttaaaacagtacttaatttcttcctcgctccgtgttacgagaagttgtaaaaacatgaggggttgtttttaacatacactttcttatacattgattttctaaatcttgtttttggtgtttcttgattatcctgcaaatagctgttataaaccattgttgccttaaagatgcaaggttcttactggcattattcattctgcaggctcttggtgttctttgcagtgggtactatagagattataaaagataaaaaagatactgttgttgccctcaagatgcttacaaaaaagtttataaatttatattgtataatctcttggccagtttgtttaaccactgtctaaaatatttgttaataacatgttaagataacttgaattaacaaaagctttttttgcttactttttcaattaaatgtttgtattttcttcatttaaatatcagagccacgtaattttaatgcattaagaaacttagtaattttttaagccaagaaaaatagaaattattatttgagttttttctgctgtaaacagatactttaggaatttagtgagagttcaagaaaacctggtagacatgaaatgtatgccatgtactttgaaagcagaatattctaagaagaatgtgcatcctttaataaatccaatagtagtttgatagccatagaaatcttttgccaccttttctacttttgctatttttgctgttattaagattcaagatttttagttcttcagaatccactcccgttttttggtgagtaaacccacggcacctctgccaattcatcacccctcagagatgccaccccagccccatttaagaatatcccaagaaggaggctgctgtgcaggcaggcggtgggaggctgcagagtgccaagccacacagtgcgccctgtgctgcctggcctgctagctagacagtcaggatggcaacagcgatccccggaaaccacaaggcgagatgtctgctcatgccttccctgtgcagacgtgcggggaggaagatcagaagaaaaccccacaagttcctatcaatttcacagaactttccaagtgctcttagagttgaaagataatgtctggggaaagagaagtctaaatctgatgaaaggacaaaggtggataaagtaggctgtggggggaaaatgaaggatgatggaccagctaagggaggcaaggagaaggcccctaatgccccccaaagaccactgcctgttctgttcaggatccccagcatcaaatccatagaccctgggattgcttttggagatgggtagacaagcttggtgagctgtggaatcagtgaccgtgagaagcagccttaggacaccaaggtggggaagctgctggagaaagacaggtggcgtcaccggctctgagtctaaagggaaaatgggtggcaagaaggtcctgccagggttgcccagagaaaggtagacaagaaagaggaggaggaggaagaagaagataaatagaaactgtttgtcaacaacaacagcaaaaatgccaagccaaagaccacttgataaaactccttcgagtaatcaaatacgctcaatgtctgctatcttagaaataagtgtatccaggccgggcgcggtggcccacacctgtgatcccagcactttgggaggctgaggcggacggatcacgaggtcaggagatcgagaccatcccggctagcatggtgaaaccctgtccctactaaaaaataaaaaaataaaaattagccgggcatggtgacgggcgcctgtagtcccacctacttgggaggctgaggacaggagaatggtgtgaacccgagaggcagagcttgcagtgagctgagatcacgccactgcactccagcctgggtgacagagcaagactctgtctcaaaataataataataagtatatccattattccatctctctcttttttattgtttttttttttttttttaaacaggtatctttatactactatgacccatactcaaaattaacaaatgattaaatttttctcatatttgcttctgatttttttaaaaccaaagggggaaaaactcatcaagtgtatctcttctgaccctcccaaagcttagaaaatgactgttaggtaaaatcagacaagaaagttaaataagactagaccaaagctgggatttaacaaaaggaagatgagcaaatttcagcttcctctcttcgattcatgtctttctttcctttagctgacagtgaccagctgtctgctctgcaccggggctaagcgctgtgctgaattctgaaaacactaagatggataaggcggaatgtcctgccctgaggagctgtgagcccagggcagggaaacaggtggacaaagagcttgtggaagtgttcgggtgctgctgaggccaagaaaggccgtcagggcagtggtgttgcagaggaggggcctgaggacaagtacatgggaggtggggagccacggatgggtgggctggagtagaggggactggagggccggggcacttcttgggattctagaagctggacagaaaggaggccagacaggctcgccaagggtctgatgtgtggcatgtggttatactctagacaccaaggaaccatgcgggatcttacacaagaaacaccatcattgggtttcccaagaggatggactggacacagaggagggggcaggttataatcttataattttctctatccaggcccaggaaacatggtgcaactgcccagacaagagatgttaccatttggtgcattaatattaataatacatttataatgcatgtcaaacgacagaattacagcaaatttagtgacagatctatttggcttttatttgcaacttatgaattagtgcagcctccattctacaaaacagaatgtgagctcccgccaggcagtactggaacagtgcattttgtaagaaggaaacagagcaatagaaaaataactgataggttaacattgagttacttcaggttgctttttttttaagggttaaagcagaggggagttccttattatgctgacttgtgtagtctgggatctcctatttttagaaaaagcaggtcttcttgttttgggatctgtctgcttccttaaagtttcaatttgattgtgtggcatttagcatgagtgactccatttagtttggtcttctggtttgttggagcccaaaacaatggcgtcccataattttggtcaattcacatgacacgtcgtgtggattctgtttatgtctctgagatatccattagcccaagtagagagaatggctttaaacccacaaggtgctttcactcttagctgataaatagcaaaatgtatttagtattagagaatctaaatcttaatgaggctgtctcctctcttctcatctcaggaatccttaccactgtctccagaaaacccaccgaaactcctaaaatgctcaccttctgaaagcagggctctaatatttattggttttgagacacatctcgtgcttctgctctgagtagccaagcatggcagcacattgggtattgggttagcctcccatggcgtctggtctccctgtggacagcgagcttcctgagggctggggccatgtctgccttgtttgctaccctatgaaaagcctgatacacacaggtgccccagcatcggtcggagaagggttgaacacgaaggtgtggccagtaaacttccctttcagaactcttgttttcacataaaaaatgtgctagagagtggtattatgccaggtttttccattgcttgctctagtagattggaaatacgttttctaacaagatcccaaagttagatgtgttacaatgaaatactagatggtactcaaatagtaaccaacttttgtggggtgtctcattctgctgggtgctctgagagatgtacacaaaggagctcagccagccttaactaaagacctgctccatacaagaccctgacgaggctctagacacagttggtctcagagcagcccagaacgctggcagggtctgtaataaccagaaacctgagttcaaccaagagatgtgaaaggaggggggatctgcagttctcccaaggaagagagtggtcagacagggagaggggggtgggggctgcactgccttgcaagggtctcggccatgcgtcagcatgggggtgggcagctggtgccaacaggtaaccggtgccagttgctatgacagcagtgggcgaggcaggcccagcacatctgggctcccccaacagggtgtgcatgctaccctgcacccagtgtgagctcaggatcgggtgggggccgtcttcaggtgggcatcgctttctgcaagcgtcagaatatgggaagtaaaaacccaaaaaaaacatttgtttttgacgcacttagctaaaagggaagttaaagaaaaccacactctagtttgaataaaccaaaaggagtctttcactgaggggagttgctagaaatctcattggaatgaatgtcccattttacttatgtcaaagaggagttgaattgcaagtaaaataccaaagtgggatttcatttattttcttttctcttttcctttttccctttttttttttttttttttttgagacatggtcttgctctgtatcccaagctggagtgcagtggtgctatcatggctcaccgcaacctcgacctcctgggttcaagccatcctcccaactctgcctcctgagtaactgggactacaggcacatgccaccaagcccagctaattttttttttttttttttttggtagagacaagggttgcccaggctggcattttcttaaatgagaattatcttgaggtagtaggcacacacatcccaatcatagatgtttaaaaataaaaaataaggaaagagaaactggtacagatttatttccatctctagggtgttttcctcattcagtgggttctctgaaaagcacattattagggaatgtattccatcttgctctcctttggaacattgtcaggtgacagtgacagtgctcttgtggcaacgcctatttctgtcatgctcccctgccttggtcagccagccatgtggaagtgtcacaccagggctggtgaagggctgctgacgcctgtggttcagaagctcgtgacgaaaggcaactgatggagtcacaccttgctccactggggcaccctggacacctccaagagggtcttcatccctgtgggggctctggtggggcaccctggacacctccagagtgggtcttcatccccgtgagggcggagctggagtttgccattgccacagcaccagctgcaccttggtgtcctctgagtagccttatctctgctcctcacctctggaagtcaggtttcctgttacggaaagcaggctctggatgttacatttggggaatgttagtgtctagaaataagaaataagtagatgtggaagacaggaaagcaaagcatgctggaggcgaacccaactagagctggcttctcaatgaagttagaggaaggaatcatttcgatttgggggctagaaaccaagctgcactctaatctgatattttgtggtgaggatttttaggcagaaacttcttgtgatgcctgagcaggaggaaggtactcgctgtgctctgagatggagagggaatgttgaaagaacacctttttagaaaatttctttgagacatttttaaaattttccagaccaatgaatgactgcaagcccatgaagccaacactgacgaagttgcagtatgcagcgccgtgcctcgcctcgcctcgcctcaccattgcctccactcacgccagaacaagtgtctatcctagcacagtcttttccagagtctcagtgtcctaccagcattctcattttgtcctccacatgtttattggtcacttttgatcttcacattcagccttctctaactggtgctgggcaccgggtgtgtcaggctctgtgttggggggaagcaagccaggcctggtgccagccctcaagggagctcaccgtctatgagggagaccagatccatgcaaggccctaacccagtacccaactcatgcaagtacctagtgccagtccttagcgcagaggagacctgtaaacattcattcctgtactttaacaacttgacatcaggagattttacattgaaactttctcttcctgtggatgttagatcggatcaggtgctcatggtgagttctgatgcttctcatcccagtagctggactacagagacaggaagcagcctgcagagaaaatgaagtagtccagggtttcagtgtgagttaatgtgtgttgtggctaaaatgtggtgctttcgatagggagagagatgggctgaccatctataataccattatttatatagtcatcagagttgtgtatttgctaaactttataaatacataaagtgtattttagaacaacacagtctttttgttagaatgttatgctcaccatttaaaaagattgttcctgtctttctgacttctttagggcccaccacacacctggccccgctgccctccataggagaatagtggtcctgagaggtcatgtttattgagcgctggtcatgtgcccgtcactgttctgggcttctcacatgcatccctctcatctcccaaactgcgaggaaacagagagtcagagcctggtcccctgcatgtggtcacacggggccaactccaaagctcgggtctccctgccaccctgcgctggagtcagacctaagacagcatgcagcttcccctgcatttttatttcacggaagcatgaacctggttttctgtccctacaagttgagtatcccttatccaaaatgcatgctgctctagtccttcagtaagcccatcacatattttctctgtgtcgtctgtagacactttttctgcagcgttagcatcatctccatcatcactgttgtcacagtcaccttgactcagaaccatctcagctatttcaccatgggtcagttaatgaacagctggagcccccttatcgatattaaaaacttcaatatctggctgggctcagtggctcatgcctgtaattccagcaagttgggaggccgaggtgggcagatcacttgaggtcaggagttcgagaccagcctggccaacatagtgaaaccccatctctactaaaaacacaaaaattagccaggcatggtggcacatgcctgtagtcccagctacttgggaggctgaggcaggagaatggcttgaacccaggaggtggaggttgcagtgagccgagatcacatcactgcactccaacctgggtgactgagcaagactctgtctcaaaaataaaataaaaaataaaaacttcaatatccacttcttctggcttactgacagactcgaaggtatattttttacctgttaggaggtcaggcatcattttatcctcatttgacatgtggaatccttcaaagtcaccaccttgttcgtcatcatcactgaacatagcacaggccagaggttgtgtcaggcttgcatagctgtgttctcagtcactgtgttccatgcattggcaacagcatgtgtggcatccttcacgctaaacgcctgttgaaaatcttccatacccattcatttgttgctagcatgttgttcaagaaggtacttttatatttatccttcattgatctaagaataccttggccacatggctgaattaatggagtcacatttggggaaaagtacatggcataaacatgatttttgatgagatgtcagctggaggatgaacagaaaagttgtcaaggtataacaaaatatttcagtcatcatccagcccagcttccctgcagtgagcacaagccacaggtccaaaatgtttgtgagaccaatcagaaaagatatccctagttaaacatgcctttttgttagcataataatggtctggtaagaaattcgctgcttgaaaacagcaaggacacaaacttttgcctgtcatgcaagtttacgcttatgcatgcctgctgcattagcacatcccagcaaagttgttctgcccttgatgtcctcagttcctggaggggctgtctcattagctgtagttgtgtctttctggagcaataaaaccaaaacagtgatgttccatcagcattatagacttgttctggcatcagatttttgtcagcaatgaccttggcaaactcaccaatgaatttctttgctgcttcatgatgctttgtcaccacattaaaaaatttggtttcatgttttttcttaaatttctgcagccaacatgttgaatattcatagttccttttcattttcagttcctcatcctgatagatccttgcttgtttcctgacccacatagcattaagtggcaggtgttcactgcaacaccaagggatccatcctcggtacatgatcaggatcttcatttttagctttatgcagtgtttctctatttttcattaatttctgtttatcacttttagcacagaacttcaacagtttatccttctgtttcttcagatcctatatggtggtcactccaacaccatactctcctgtaagacgtttcacacttacactgctctccactttctccaacagcttgactttctgtgctatagataaacataaatctttttcttatcactgttacccagagggtatctgcacaccttttagatattttaacaacatttttataacacagagcagaaagtaagcaaaaaagcacagtgagtgacgcacgtgggttttggccccatgcaggtcattgtggggaacctgcccactggcatgtgcttgcgtgggggagtcggggcatgtgcagaaaaggcatgtcacagctgaaggagggtgagagggtctcttttcccttggagacactgaataaactacgtgttgtggcctgcattttgactgcagcccatcacatgaggtcaggtgtggaacttgccatttgtactgccatgttggtactcaaaaagtttcaaattctggagcattttcgattttgaattttcagattaggaatgcttaacgtgtgttttgcttacctgactgcacgtctgcgcaggcctcaatttcgtctttctgtaatttgagcacaggagttgatgcttcacatgccgagtaagctttcccaggagagaccgtaatgagatgtgtggggactgggcgtgctgggcttctctgagcagaggaatagtgagagccacagcagtaattgttagtgtccaccaaagagccctacagacaactgttctctgtgctgctagtttttgctccagttcttactgtctatatggtgaacctctgaaactacataaagaaaggacagcaggggccacttggctaacttgcacggctgtgagcactgcactgcacccctccactggggagtattgggtaagcacccatcggaacacctatcccctgacccttctcgtccttgctggctggttgtcatcgcatacccaagcccaagcatgcagtttcagtttgccatggatgtttagttttggacactatgggaaaccttcaggtgccctttcttagtgtaattgtttattctttttaaagaactgtgctaacattattgctacttagcaatagtttttaatctggtgaaaataacaggtcagtgggcagtgaaagttctcctgtcacacttgtcttctcacccataaaaatcacttaaagctctgaagccagctttggctaaaggggcatgatctgccccgcagaggatgaagagcgagcccgctgcaagctgtgacagcagacgctctcttctgccaagacctgtgaaaagccagtcttagttgtcaaaaccagcaccgcggcacatgtcgttcatgtctgagagaatgaactcagaaggaagtctcgtgtacatagaaagctttcgttcttactctaggatgtcacctacgtgacttacaacccagcccagccatcccagacctaaggggttcttccctctccagggcagggcctgcatgcagtccatgctgctgccctgtgttggtgacctgtgtgtagccagcccattatcagcatcctgtggattccaaaccaaatgtatcatcagtggagggagagctcaagtgccaggtggagctgtggcctaaagtcacacttcatcactccagattatgaatcgtcatttgccagatctccaaattgctgagtgtggacagcagatggattcgtttgtgctggctgggtgcaaagaagcagccagtcctcagctgcacttgaagtactacaggtagtagtaaaggtagcttttccaagccgtttaaataaacgtcattaagagtggccaagttgtttgggggccatggcatcatggtggtggatagtaggtggaaggaaggcaggccagctcccgtttggcctgagttatctccaccaatgacaatggtccttaactggaaggaacatcatacaggttatttccacccaagattggaaagaccaccttgatcagagagagttttccttccacatgacacatatccagcctgagtcctccagcccctctccctgcacaacctgatggaggcttgagaaagcacagggaggaacacttagcttgaaaatgttcctaaggaaaaggaaagtgtgaattctgagaaccaagtggcagaattgaagtttcacgtctggcaaaagcttaaacagattattatcaaatagatggtttgtgaacgttgaaaagacagctgtggtctaggacaccaaaccaatcctgttggcaagagatcaccaagacctttgacaacatctcatcagcttatgagagatgttggtgacatgcagaatggataatgatagtgcaatgaagtgggtttgaaactgattaaaaatgttgattaaccccttgaacacagagttctgggctctttgacctgacgtgtttgacattttcatcaataataacttgaacaaagttgtagaggtttactaatcaaatttaggcatgatacaagtttgagggagatgattaacagtagataacaaaatgagaattgaaaataattcattttggttgactggaaaatgatcagatggagtttaacagagatatgtagagtcctagacttaaaaggtcaggtaggatttgagagacctgacttgacagcattttatgtgaaaattcctgagtgttttcagcaggcccagcttaactggccacaccagtgatgcagctccttacacaagtgcatgcacaggcacacacaacacatatgcacactactaatgcattcctctgctctcattgaagctaagggcccagactgttggagggcagtggcctcactgccctggtgagaccacacccgtggtgtcacactcagttctgggcgcggtgttctgagacggtgtgcacaaatgggaggggatgggctgaaaggaactggatcctgaaacacaggaatgagcaaaggcagccacagccctcatactgggagttcacagtggtggggagaagctatcaccccacagacacagctgcagggagcccaggacagaaggcagtggggcaatgaggacttcgctctgggggccttctagtctgggagacatggaaaaaggcaggggccccaagacccaccaggggaagaggagtcatcaggctcagggcagagggcagagacagcaacacagcagaacaagccacggtacccacaggcctgggtgggggccgagaaaagccagtgggttgagggaggaaggagagggctgtcacacccgcaaagtgctttatgtaggaaaagagaatagggttgttctcggttacttcaaagggcaaaatcaagagctgtggcattgtgtggatggcagcttgtgaggggcagaacaccagggtggcagcattctcagccacctggcagtgaggccagggcactcagccacagctgatgtgcatatgatgcattagtagtgtgcatgtgtgtgtgtgtgcctgtgcacgctcttgtgtaaggagctgcatcactggtgtggccagttaagctgggcctgctgaaaacactcaggaattttcacataaaatgctctcgagtcaggtctctcaaatcctgcctgaccttttaagtctaggacagtacatatctctgttaaattccatctgatcattttccagccaaccaaatgaattcttttcaattctagttttgttagctactgttttttgttttttgttttttttatctacgacactctctcctctggtgggaaaacaaactagaaggtttctgcctttgctctacgctgtccaccagccctgggcagctgagcatgaatcacctgagggcgccatagtgtcccaggtgctgggcatcttgctgctccaggacagccctccccaccgcaaggcatttggaagacacctggcagcccttcttggcttcctagccagggctgtgcgtcagtccccgtgctaagggttgaaagcaacgttccggggaggagcacgctcactgcgtgcatttgtaagcctagtcctcacccactgagtggtcccatgacatgggcggcaccccccgtttggaaaagccctggctggactccagcttctgagcagtgtccactgcgtgtccctgttggccctcaactcttccctaaggcttttgggggaggagggtctgggtgtctgggcctgggtggtcactgggaggttccctcccccacctgcctctctactctctgcaccttcttcctcaccttgctgagtccttaggttaattttgctcacaatatccagagttagccactaggctgcgggtgaagtgggatagagaggaagaacagcaggctttctggagccacatgcccaggcccatgcccggcccctcctccagccaccccatgccatagtccccattcacacccactgagtcccctgagcagaggaagggtggtgatactgggccccttctctttccaccatgtagcaccgagtagctcgctctctttcggaaagaaaaattggaaactctgactaagtcctcaggtgaacccacaaaagcctctttaatgcgcaagtggctaaaaaactcaacatgtacaagactgttgactttgatgaggtgttactgcaagtgcagtttattttaatataagtacaaaaaaatgtattcctgtggcaatctggggccatgaatatttttgtaatatattcttaattgggaaaaaaggttgcaaataagctttagtaacattgccaatttcaatactggagactgcctgtagagaaaagtacaggaaatctccgtattcacagaatcaggatttgtggtcaaaaacaatgcatgcctgttcctccctgcttctggtggctttcactgcctccttcctcagttgctgccccaggctcagccccactttgctgcctgcgtaagccccaggctgcgagtggcacagctgtcaaagtagtctgagcacccaaaggcaggcagttctgtggcagtgacgccaggagtgcgatgccagggccgagcatggcagtgacgccaggagtgtgatgccagggctgagcgtggcagtgacgccaggagtgtgatgccagggctgagcgtggcagtgacgccaggagtgtgatgccagggccgagcgtggcagtgacgccaggagtgcgatgccagggccgagcgtggcagtgacgccaggagtgcgatgccagggctgagcatgggtcaccaccatagggaatcaaacgacgctgagtcgtgtgtcctcgcagtgagcctgggcagctcatgccgacctgcttccaaggcctggtcccagtaggccactttaccctcagaagccctgtgtccttgtctgtagaatgagggttatgtgcgatcatgcatatatattggctacacatagtgaacattgaaaaatttgtacctggtataacttttaagtatcagattccatattgaaatgaaaattggtttttttgtaaacagttttgacctttgccacaaggctcacatgaagaacatttggggcccagggataagcggcaatgtcagcgccctcaggtttctgcgttttctctgcctgcaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgttttactcttcagtatttttctatcagacttgtacaaataaagccttgttccaggctatacatatttaccagtcaaccaaatcctccgcactgctcgtctttcttcagaagactgggtgctcatttgaagtgagtgaagtgcttttgttcctgtaagtagcactgcccacagtggcattacctgtgcaaacctggaagctcggcctcactgaggctgcctggggccactagctgctcagaggggggtcgaggtgactttcttggagcccagctggtcccacgcacaagcccctccttgaatctgaattgcgccatctcgggttgcaaggaacagttgatggtggtggagatgtccctgacttcattccctaactaggccacagtcaacacctcctgagtgctgagcaaagccgtgtgtgtctgacctctgaggcaaaccaaaatccactctctgtgttccccgtgcaaaggagcacaggcagagaacacccaaaaatacaccccctcctccatgctacccctttaaacagcacctagccaagtaaaaccaaaccagaggcaaaggtatcccttggagacgggggcagcaaatagcccctttgcaagtagctaattagaggccttgattcacacttgccagctgttcttgagtgtttgctaatcaggattccctttggaatgagattgtattttggagacctttgtcctgcccacaggaacctcagtgaccctctatgttggttgtttagagagtagaggattgaggacctaaatagtggcagagctgggagacaactacaggcttggtttgttctctttagttctttcagcctctttcccagttccttacagctgccaagtcctcgcctttgcagtggtggcccgtggttctccatccttgtcatgcaactaccaggccactctccctccatcaccaccctctggacacacacacacacacacacaacacacctgccttttcacgcttgaccatgttttctgtcttactggggttcgcgttgctcacccactcttgcttcctgcaaatattgacacaaaaacatctacacagacattccccgcagaagtttgaatacctgagagcttccacacctcttgtcaagacactgggactcttttttcaggccgatggcacccccaaggaagacctgcggagccatcccagccagaggagggcgccagtgagccacttgactgggcttcctgaggtctagaaaaggtttagccttttgattttgtgcacgtggtaacagatggggcttaatttttgggtgagcagattctagattgtgaattgagaaggtaagattttccatagtgaccccctgctcctgacattaaggaaagcctgcctgtgaagttctgatttgtaaagctagggtgagtttgggttagaaaggtggagatgttagggaaattgagtacaaaattgtgaacacattccagtgtcatttagaatattctgtgagtccctgagtttacgttcctacaattgttcttaagttgaaatggaagtgtctaaaaccatagacttaagaattttatcttaacctgagagcttacctgatacttaatttgtgagaatcaggagtattttcttcgcttccaagttcccctaaccaatagtgtttttgtaaaggggtggaccaagaacgccaaaatgggctttacagctcagactaaaattccagctctgagactgaaatcttacacatgataaaaattgccagaagcatgtgaatttataacctgccaatacagccctgtctgatggagaaacaaccccactagctacattgtaacaatgccacggatagacttggggttcaggtagaagggctggacaatgccatgaatagacttggggttcaggtagaagggctgggggaagtgatcactggatgttggaaatcaatctgaacagaggcggggactagagagtcaaatcacaagtcttgctcttgggatgatggagtaaattgatgaccaggaattaggagagaggagggctggggatggaaccctgaggaactcggcatctggagtggaggaagaggtggagaggtggcaggagtatcaggagagggcagcccaggctgggatgtgggagtgtcaaggattggggggcggcactactgctgggaagggcctgggcgagggcagagtggtggcggcttccagaggaaatgtaaagactagtgagaaagcggaggtggggcacaggctcaaccagggcacttggcagtggggaaggggagagccagggacagggaccgtgagatccaggcccagaatggggtgcactcaggagccacgaagcggggcaccgcagaaaccggaagcatccttcattcagtcccctggaactagaggaaggagaaaatgaaggtcgaagtgagaccgaaggcgaggaagctcctgtcctggagtctctagctccctaagaggagggcctgggggctaacagagagcagatggacgtcttcaaatgagagaaacacgaaggatctacattggctagaaacaatagctttggcctcttttttattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaggcagccaacccaatgcctgcacccccgacctccaccacctgtttggggctctcacactccaggccactatgcccctgcccttgtcaagcagtaccaggtaccaggcccctaaggacagcccctctgccccagagcctgcatgcccccctcccgttgatgcttctcgtggaaaccacattcaaggtcttgcccacgctctcctgaccctccctctgcctgctgaccagccctggttctcccctggctggcctgggtggcagagtgtgcccctctccttgggagctgtgagtaacgaactgtcttttcaatggtgctcggccgctgatctgttggcctcatcatacctgagaaacaataaagcctacagtttagagaagcccctcaactctccctgggactgtcgtccacctcacccctcccaaacccgtaccctcaccctaaatcgctcttccagactgcacacctcgtatgtcccactttatactggacacctccatgtgcctgtcctagggctcctaagcccacgtcttccaccctcaaacttcatctgaccccacgctccctatctcaggaagtgacagcaccctcaatccagtcccccaaccccaaactcgggagctctcccagagtttccctaaccccttctccgacgtcagtctccacccagcacctaacacacttcacatgttacgttgtaattgtctgattctgtatgtcccctgctggcctacctgggccatgaggctggagaccacgtctacccactgtgtccccaacacccagaaccacacgtggtgaatgtgggaatgaatgtggaagatgagtattggcctagagacaaaatcataaattactagagatgaagaaggtccccgccctgcccttggtgcacgcatcctctcccatgtctcagagagcagtcctttatacgcggggattgagctgagtcagcctgggactgaagttctggcaatgttctaccttggtcaatttatagcattttacaccttattgcaacctacccaagaggcttatattaggtgttactgcacacacacacacacacacacacacacacgggctcctcaccccctgagaccagctcccccgctgcctgtcctgctaatcacagagctcagcagaccatgtgtcaagactccttaggatccacagatccaagcctcagaaggtgaagttggcctttggcattagaaaatgtaacttcccagatttctacaattatagtggaacagggcgcccataccatgaggcactcgcgttgcctgaggtgtggtctgacccatgtgctatagggttgctgtgccctcaggtggcacggcctgccccaagcctggctgcccacaaccatcacaggccagggga

SEQ ID NO: 1349 - DNA, 1488 bp, Homo sapiens
atcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcagg

SEQ ID NO: 1350 - protein, 186 aa, Homo sapiens
ITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 1351 - DNA, 21795 bp, Mus musculus
  misc_feature (1)...(21795): n = A,T,C or G
actacccacccagtgtgtgctttgtgtttgagatgttgcttggtctcacccttcattgtctggtggtctgtggtacagtctaggtcctgagaccattgttattcacatgagacacaaggaatgttgtatactggtggagacctgtgcagagttcaggtattaattcaggctggagatgtagcccaggccagcttcccccctgccccccaatctaagcaaactccaaccctgctattaccatggaatagagagcgtaggcacaccgaagggctctacagcagtctgccctctcatgtctacttgaattcagaggtagccatggccttaacaaatctcatagtttcccacatcttccactacccaatggtgatgttctttgagtggcctcaaatcctaaacctgttccataccaacatggatcctcacactgagcctgctgtctgtgattcctggtacccagtcagtcctgctgggtctcacccccagccacagtcctttttcttatgtctgcctccttttcacattcctcccgaagaggtttctgttgcaagatgtttgagtacgggcgtcacatgccacaatgtgtaaggagaggtcagaaaccaaccgtgggtggccatccttgccgtctactttggcagggttccttgtttgtctctgtgttcatcaggctagctggcttgccatttccaggggtccccttctttccatctcctgtctcaccgtgtgtgggttctggggatccaaactcagctccttacacttgtgtggctggagctcacacacagagcagcctccccagccggctcagggtgacattctcgtgcctgtgtgccatcacaatctctcccctcacatcctgcctggtctcctgacctctcctgtagcttcctctcccccacagagtcttccttctcctctagcccttttgaaaacatttttttaaacgagtttacaaagtatccggttttcttacaacatcctcaaatgtcatctgtgtttgtctcttctcacccttctccctcaccccttctccctcaccccttctccctcacctcagataacaaaagcgtggtatgtttccatgatggaattttattcagccacaaagaaaaaaatgtgcaagaaaggggttgggtctggaaactattatgttataatataggtaatccacactcagaaagacagaagtcagaggtcctctttcgtgtgcagatcatttaacatttatatatgtgagccagtgtgggtagaggtcataaaactaggatggggagtatggcaggggcttggtgtgggcaccagaacacatcgccagggaagtgaaaggtggccactttaacccttatagtcttcatcggtgacacagccattgtgacagatggggaggcaagctaaccttgtctcactgttgtggggaatccagcagaaaagactacttgaacatgagttcgagccagtagagcatctttattaggacgctagcgacaacactgggtgtttgggaccacagtgcagtcctgagcctttcccagggtgggcttttagcacaaaaacaacatcctgggttgacacatcccagttagtaaggataggtggccagaagctgaattattggagccaaagagcaaggttagaacatttagggacttccctggaactgtggactttgatggattgggggtctgttctcgtgctggcaggtgtttgctgaccatgagctgggttccaaggcctgactggttcttccattatattgtcagttgtactgtcttggggcaaggggtggcccacaggagaggtcaggagaccaggcaggatgtgaggggagagattgtgatggcacacaggtatgagaatgtcaccctgagccggctggggaggctgctcagtgtgtgagctccggccacacaagtgtaaggagctgagtttggatccccagaacccacacacggtgagacaggagatggaaagaaggggacccctggaaatggcaagccagctagcctgatgaactcagagacaaacaagaaatcctgccaaagtagacagcaaggatggccacccaaggttgtttttgaccttcacttatgcactatagcatgtgacacccgtatttacacacattggcagcattttgtcgaggctccaccccacagttacctgacaacagccaggtgtgcctgactcattgtaaatggggctgcttgctccctcctctcttgctctctcctcttgcttctgctcccccctccccattctcctccccctctctctccacgtgctcatggctggcctctattcctctactctctctgcctttctttctctactacccttctcaactcccttctccatgtcctgaataaactctatactatactgtcctgtggctggtccctcacggggaagggatgtctcagactgggccatagaggcaccccccccccatctgactgcacctccacctctccttatttttgtaaaacacaccacatatagcacgtacacctaaaactaaaaaagaaaacattatgacaacaccaatcatcctgtacaccccatgtgaatgaatgtttcaaaagcgtagatgttgatcctgcagggtagggagggctgaggtccttctgcctctctgccaagctccaaagggaaactgaggttgctaagttctgggctgcagtaaccccagaggcccatgggcataccttagtgggaagaatcctttgtagctaaataactctgggtagctcttagcaccgtgagtgaaggaagaggaagaggggatacaaagaaggaagtgtctatggggaagatggacccacagaggagaggtcagaagacaaggcaggatggggaggggtgaggctggtggggcagggattcatcaacctatgagctccatatctatctatctatggacatgctgttccagctgaccaggctgttcatggaaggttctccttccagaatcttatctctgccaacaagacactgaacttaatggcacacagtcgtgcctggcttttggtatgaatgctctggatttgaacttaggtccttcacggcaagagctttttcccactgagccatctccctaccttcttagggtcactagttgcagcagaaatgggaaaccagcggatcccattggccactgagagtcagaggctgcacacgggaaatttcagagggacttacactctatgggtgtaatactcatgttgaccacaagagatcaccctgcaaccacatcctgggcaggcaccctaggtttgaggcaatgaaggagccgatattttcaaaaatttcaggtacgtgatgatcttgtccttggtaaactaaacagtttgttctaaacctaaaggatcgttgtaaattctatgtgggggattccatctcttctgtatgaataatgagaagaaacacagccaagaggaagcgatattcagaacaagacttgttaaccttctggctgggctaccactatggagttgattaacctctctgtgccattttcttcacctatggggtgacctctcagggtcaccatgagatttaagtggtgcttacaacagcacctggcacacagcaaaccccacgggaggaaaaaaaaaagcttgataaataaaatagccatagtgataatactaatttgctcaaaagttattaaatttttgtgtcaaatgaataaaatccaataatgaaggggcactcacaagtcccaaaacatgttgaatatatttaagtcctgcagtgttggtatcctcccgtgtattatgcagacagcaggaacagagattttgttcatttgagacatggtgtctgtctagatccagccacatagccaaggaggaccttgaacgtctgcctctgcctcccaaatcctggattacaggtaccaccttgccaggctttcagagagggctcattcctgtctagaaagtaggtattttcattaaaagcaagtgaatggaaatttggccctttacccttggctgtgatgtgtgcaatattttgcatgaagtcctgttgggctttattttgactgcaaactatatgtcagggtcctggctcattttatatgacagacgtctctcagccagggtgcacacagccatgccaaatggccattactcagtataggaagcaggggtcccactcctcagtgtctacccctgaaaccaaccccacagaaggctggcttcttgatctgcctccatttggtctgtaatctccaggcagtggggttgacatctggccccgaggttatcagactggagtttacatttgtatcacagggaatcaagctgtggggtgctcaactgcagcgcagccaaagaaaatgagcagtggtgaaacatttcaccacttagagactcggctactgtggcagccacaggtactcaagactttgcaaaatcagagtcgcacggttgctttcctagggtgcatgaggtggtatcaggctgtggaatgctctggaagcactgttgtagttactccgtgccccaaggttcccccagcacctcttatggcttgtgtgcatcagcctgccaggcacatctttaaatgctttttcttggggagagcttcatcataaaagtggacttagtaggtccacaaatgagagcactcacttccgatcaggcactggactgagtggacttagtaggtcaatctacgtgagcacttactttcaatcgggcactggacggggggtgggggtggggtgtagctcagtggcagagagcttgcctaccacatgcctgtccgttaactcacagccgagaacataatcaatacaaaaataaacctaaccccaaactcccaaaccaggcgctctgttttcaccctaggtcagagtgaataagcactgaacccccagcgctgggtcttggtttgtctgtgggtgtgcatgcttgtgagtgtgtgtacgtgtgtgctcatgcttatgcatgtgttttgcatgtggaagcagagatcagccttaggtgtcactcctcagaagccatgcaccttgcttttttgagacagagtctttcactggtttggaactcactaattaagctaggcttgcttgccagccaggtcctctcctccgccccccccaacccctagtgctgggattaagagcagcggccatcatttgcgctttttctacaaggcttccagggactgaacttgcagttttgctggctttgccccgccagcacggtgggagggctcccatgttttccttagcttatctttcagagcagaaggcaagcgtgtggcttgggtttgctgcggctctgtcactattcggaaccccatgtgtgtgtctgcacaccttccactcccagagcagacccataaccagaattcaaatgcccacggggctgctagggctgattaggcgcccgcaggcctgctgggaagcttaggtgtgactaagatgacaggaagatggccttcaccagttctctcccatccctccccagcaagtcagacctgactgtaagttgtgagtggtggatgtggaccgtgtaacaaactcatttctcggttgcatgggatccccggagccattttagaggacttccccagaagtggagcttttctgagtgaaggctgaccgtcttcttctacctctgacttccagacttgttgcagccttcagccgcggggcacattctgtctctttgcccctgtctctccttctcaccctctctcctgcgtcctgcagctgctccagttttttccccctgcagctgagccagccttctttcctgatctctaattgaaaaagaatggctcgctcttcctcctccccacttccctcctccccacctccctcctccctgcagctgccaggctttccctgcttgccactcaaagttgttttttttttcctcttaaaatctaattaagtaccaaccagagcccccacccactctcctcaagaaaagagaaaaagaaagaaaagtagcagaagaaactcccttgggagtgaacaaaggacaaagatggttcgtgcatgtagggcaaagttcagtccctaggtgaggagcttgaggctcagaaggttctggcacagggtctgaccaggaagagggaacacctgtgacttggggagggggtgtttccactagggtgcacacatttgtgttccggtgtagggctgcactgcagctgactgttgctccaaatccttccttactgtcgaaagggaaagtaggaatgcaggaatgatttgcatccctccgggggcagccaaggctctgccatcgcttctgtctcccccatgccctgcaagtgcacagccaagaataatctcgccttccagaaagctctcaccacggatgtccggcttgctgcgaaaagccttccctttttgtttcctgtttcctgtctcggctgtccagtgaaatgccccccctgtagatcagtatttcaccccggcaaggctctgaggacagggcaggggtggaaagggctggtggagcctttaaatgccggcacgctgcctctgctgaggtttaggtcttgcataaagatttttatttcttctttaacaaaattcaccgtcatcatgggccacagacccatcattagcaggtctggggcgggggaagggacgttcttctggaaacatccaaagacttgccttgtcttgaaaagcattgataaggctaactaaccaagagaaggcaagagtccacattttcctttttttcattgaaaaagtgtcaatgaatttggcttttcctaagacagcccagggaactccacctgcatggggctgggctcctcagcctgctttggtcttgcagccttggtctagctgtcccaggggctggcttagggggctcgaggcatatgcctgctgtttaagatcattctctgtgcacactccaaatgcagggtggagggaatgcttcacagagattattgccctggggaccgactccatcttccttcaaatgatgcaagctttcctcaggaccccctcctagcagacaaagtcatggagaagttcaccgagagaatttgctgggattggggactgtctctccggttggcccaggctagcctttagacataagagtcctccttgctcagccttccaagtagctgggattctaggttttatgcatttcttttaattcgattttgaggtagggcccaaggtatacccagctagtgctagtgttgagttcaaggatatccttggattccaagtgtgcactacttactatgcatggtttataaagccggtcttgatgcacactctgtatgcatccgttctacctaccgagctatatccccacctctaaagggtttcaaaagtgaagtatatgtgaaacttccgctttagtagactcactgtcccctgtattattaaggtttagggatgtagtaagagtgtagccaccggataatatggggtttagcaatactgcctgtgacgttgggcccggccctaacctttctttcctaattgagatggggactttgggaccactaggacttagctaggtaaagttgtgtgaggccctaagcttaaggcagagaggagggtttcctgtaatggaatactttgaaaatgccagcagagtagactagcttcggggtctgtcaatcatcccttctgacccagactggctgagggcgaggtctggaaatgctagtacttaagcctgcgctaacctgtacagaccttcctgtgggggacaggccggaggatggggtgcgcgggggggtgtcatttcctgcaacttggtaagtgagcacttttctagctataagtggaagtagcgggtgtgcgccaagacatcaaatggattattatttccgacgtttccttgggatctgaaaccaatgggaattaagaagtaataaaactggccgggcagtggtggcacacgacttttatcccagcacttgggaggcagaggcagaggcagaggcagaggcagaggcagaggcagaggcagaggcagaggcagaggcagaggcagaggcagaggcagaggcagaggcagaggcagaggcagaggcagaggcaggtgaatttttgagttcgaggccagcctggtctacagagtgagttccaggacagccaggatgagaaaccctgtttccatcacttaaaacgtattttagtaggaaggggtgttaagaatctgagagaccttgcagaggaaccacagggccgacacctgcagttctcaatgcagcctctgggaggcgcaaaacgccggcccctcgcctagcctttggcgttggcaaacaagcagcttccccttgcagcaaaaacgtcctttaaggagttcaaaaattaacactgaatgatctatattcaccacccacctggagaacgctccagtagaaaggagaaaatccactctctctctctctctctctctctctctctctctctctctctcttctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccacgcgccgggcaaccccgcgaccccggctcccgacggggctcggcccaccccaccggcggcaggtggacagtgttgctatgaaagagaaagcgtcgattgtccccaccgcgaactgccacacgccagacctcctcttttgtgtgccccgtatagaaatgcaaacgagccgcgtgtgccggcagcaatctgctggtccctgctgcccgcgtcccacagcgatctgctaggggtaggggtgggggatgggagggcttagaccttgcagccgcgaccccgaaaggcgcagagtcctgagtccctagtggcagcctaggcctaatgtcagctgcagttgcaaacctttgactttaagtttcggtttcgatgtaacaaccctataaacttcaaactgaaaattgaggaaaaattagaaaggtcgcaaaaaaaaaaaaaaaaaaaaagagcaaaaaaaaaaaaaaaaagagggggcttttacattctccaagtgtgcattctacaaattccagtatcgtatcagcaaacaacgtactttttttttaaactttttccttttaaggacttacaaaaaaagaaaggcgagatgaaatctgcaggctccagtctgcctggtaacaccctgacaaaagcggcagatttgaggctgtgtcatcccccgcacccctccccacgtggccttctggcacgagccgcaggcctgccgcctcatttgcatcagaaagcgggcgctggccaatgggagtgcagcctcccgccagctggcggcggcgcgccgagcctgtctataaaagggctctcccggcccagcctggcgcactcgctggtggtgggcgcgcatcggactctgggaatctttacctgcgctcgggttccctccgcactcttttggataacttgctgttcgtggatcgcacaatgactctggaagaagtccgtggccaggatacagttccggaaagcacagccagcgtgggttttggggtgccgagagttggccttgttctggtagtggtcttacagggtccttctaggatagaagtttgcagggtgggagccgtgcactgtctggctgtgaggtgccgaggcgcgggaccagaattactgcattcgattcgtgtctagagctagagtttggggtgccagcacctgatcgtagttggggagcctgatatacgggcgccagatcagaagtagggaactgggagtgcaggcgccaggtcgagactgggtgatggggaatgagggcgccagatcatgactagggtgccagaggtgtgggcgtcaggtcgggactggggatccgggtgtgtgggcgccaggtcgggactggggatcctggtgtgtgggcgccaggttggagttgggaggcaggaatgctggcgccaggcaggtctaggctaaggggccagctgggacttggaggtcagggcagggatctctccgtcgcgtccccgtgctggtccccactcacggcgcttgttctttcacaggatgcagggcgccgggaaagcactgcacgaacttctgctgtcggcgcagcgccagggctgtctgaccgctggcgtctacgagtccgccaaagtcctgaatgtgtgagtgtagaaaggccccgcgtgcagggattggggttggcgcggcgcggagacctgggggtggcatcgactctgaccttgtccttcccatctgctctgcagggaccctgacaatgtgaccttttgcgtgctggctgccgatgaagaagatgagggcgacatagcgctgcagatccatttcacgttgattcaggcgttctgctgtgagaacgacattgatatcgtgcgcgtgggagacgtgcagaggctggcggcgatcgtgggcgccgacgaagaggggggcgcgccgggagacctgcattgcatcctcatttcggtgagtgtcccccactgtttccctacgccagtcccccaaaccatcctggccaacgacaagcatggctgacccatgtattttttttttttttaaattcagaatcctaatgaggacacatggaaggaccctgccttggagaagctcagtttgttctgcgaggagagccgcagcttcaacgactgggtgcccagcatcacccttcccgagtgacagcctggcagggaccttggtctgatcgacttggtgacactctagcgcgctgctggctctggagtggccctccgagggcgctcgagtgcgcgtggagactggcaggcgatgttgcctggagagcgaggagcgcggcctcccaagaagggggtctggcggcagcggggacaccttgttccgagcccaggactctgccagtgtccggagaggctgctagcacaggaaggcctaggcgaggacgttggccccagggccgggaagaaccgaccagcgaggcaggtgtgactcagcaagcagccttccagtgaaaggaggggaaagaaaggcaggcgaccgcctggacttggtacagcggcaggagcggccactgcaggagcgagctggacttagccgactgcactgctctttcaaaaaacggatcccgggcaatgctttcattttctaaaggacgctatcgtggaagctttgaatatcacaataaacttattgaaacaaacttaatgcctttttattgagggtaggggattctaatggggagggggcggcggtaaaggatgtttcacggcacctgggaccacctttctgttggggcaagaaactgcagcctcctggggctggcggtgggggagggggtgcaggcgagtagtaaacgggagaacttgggccagagtactgtttgagcctttcaggaagatttcaaacttgcaagacaggagcatacttgataaggcatccgggtgcaggagctccaggcttgcaatccaattcgataacagtgacttctgcctccagtacctcccctcccccgctccgccccctccccccacctttgcctcgacagctgcttatctgaacagcttgcgggaggccctgtgccttccaatacaatgagcttgcctctgcagctctgcccttggtgcggtggctggggatgggggcgggttgctctagctttcaggaactttctccttttaattgctctgacaaagctacgctactaaagtattaatatcaaatatgacaccagcgagttgcgttctcagtatgaatcatcattttgtcacagccgtgatggaagttacagtatcttagcagaagttggaaggcaccgtctattataaataggagtgagccagtctgagtggggtgggcatctgctagttcctattctcagggcttctgcccaccacatcagtgagggctgctgctctccacaattccttttaaagtcggaggacaaactcaccagagccaagattatcttttgagaaggatctggggggtgggggaaacgtcccagtgagaggactttttctgtagcttagtgcttctggctttcactgcgcattccaggccgtgctgacggatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcccacgtggggctttcttgctgtcagctctgctgccgggcagagctggagccttcggggaagggcggggtggggtgctgtttttctaagaaggccattgggctgatttaccagcaacgcttagggaggctggtttgccggttgaatgccacttaaaaaaaaaaaaaaacaaaacaaaaacgccacagcacattctggaagcctgtgcagggcaacaggaaaagtgcaggagcgcgtggacgcttcctgtaaggaaagggtgccctttctgctccacaccgactctgctgaaagaatgcagccacggtggtgcccaaagagcagcgctgtttcgcttgggcgttaaattttttaggtggaggagcctttcagtggggaagtagaccagcatgctgataaaaatgacctcttgccatagtgttcaggagaacactgcaggctggcagacccttgtaggcacccttgacttggcagtcggtaggaaactcggctttctctgattggtccttacttctgcggccacctgttagagttttaggagacaagaattatgaggagggcgtgggggtggggagtaggaatccagggtttgacgtctagaggctgggaagggatggttgtggccagaatttgtgctgaattcatatgtgtgtgtgtgtgcgtgcatgttattattatcattaactaaccaaaagggcataaaataaattaaaaggtgtgcagttatttaggcagagtcctggtctcaaactcagcatatagttatggataacctcgaacctctgttccagctgccttcagctccgaagtgctggaactacgagtgtgggccaccacagcccattctgtgcagggttgaggatgaaacccaggcaacatacacaacaccacatccctgtacttcaaaagcatggagtttgaaaaccttgcatcccatgcttacagtgaccatgggtgaatatgcatgggtaaccctagatacatgctaaacatgacatacatgtccaggagaggaacgtgagtgttgagcccaatactctgcctctagaaagcactgaatgagtggtgatgacttaaaggctaatggcaaaagaaggcaaacacaagagccacagaacaaatgggtgagcggtctgcaggctgattctggagaggcacctgttttcatgggagacctttttttttttttttttaaacttataaaagttataaatccatttggaggaaagttgcccaatgcaaaaactaaccaagagacattgtagcccagtggggacagacctggggtttgcctctggtttacatcttgcaggtgcacaagcacacatacactgtatctgcttttgtcacttcccttttcagtgggcagtctcttgcggaccccttggagtgagtgacttcaaaggctacatacaactggttcattccagtctatgatccagctgatgagtctttgccaaacaagacagacacctggagctgggggacatgtcccagtatgtaaagtgttgtagacaaagaattcaagccccacaacccatgttaacacacctgagcatggtgctatggacttatacccccagcactgagtaggcagacacaaaaaggaggatccctgagtctggttggccagccagcctaacctctgataagatccaggttaataaaagacctgtctcaaaaaaagaaaaggtggctggagctggaaagatggcttagtggtttacaattacctgttgggatttgaagttctcctctgcaggattctaaatgcccagtgtctaaaacaaacctgtagcactgttccagagcagtaaaagttaaccacgctggccttttattgtaaaaacctgtcttaacactagatgattgctgtaaaatttgccctggcacacttcccaaagatgagatggatgcagacctggtgactgggctgttgaggtagcagagcaggcagagtgcttgtccccaagcctgattggtgacctggtgacctggctttgatccccagaacccacaggacaggaggagagaacagacttctgcctccccatgggcacgcacacagagaaataaatacattaaagaaagattgagctaattaaaactaaaacagaactggggggttctgggagggccaggcagccctgtctatgcagaatgcagagcgttgtctactcggggagccagtgcctccttccaggaagataagaggaccgaagaatctctgccatttactgtaattctaaagggctgacttctggaattaagcatttcattaaaggattcaccccagtgggaaaaagcaaaaattaaattttccagatgaagaacaaaccaaacaaggctggtaagacaactcagagaatagacttttttttttttaaatctgtttttaaagaagatttggagggtttaccattggttctctaggctatcagcttccttgaagttttcattctggtatgtagctattctgacaagatagaagatactttaaagagagattcttgtaacattagactgctgaaactccaggccctaaaggattaaaatttccacaagaattccatgttgggggaagggaaggccgaaaccctaatgccagaggaggaacttgcctcctgggaagagattcacacagttctgataacttatcagaccacctagaaggacagactgcagcctagagatggctcagtgataggtgtgacctcacccaggtcagtccgggcttagccgtgcatagcttacctcttgtctttacaggaccccaaagacaggcaacggggatcactgggtctctattttcccctctctctgatgtggccacatctgcttttcatgaccacttgttgatttacttagtgaccccaaagtaggtggctgtttgcttggggctgctgggggaggggggggacaggttctaactccacctactagctccagtcccaggttgctttgaatggtcccaagggaactgtccttccacaggccccacgggtgctttatgattggggacagtgaaaacacggtttccaatggcaagccttaggttgggagagcagctgagctggctgcagggacaatggggactgtggggtgctggcaaccaaccctatcagggctttggtttccgactatagcaattttacatttggcctttggaacttgccctgcttttaagttgaattgaagcctttatttcttctaaggcttgccaaattatttcacctttctaggtaaaaataaataaataagcaaataaataaaataaaaataaaataaaagctctccaggaaaggatgaaggctacctggggggatgggaagtctaagaggaggctgggtagtcttagggcacttggcatccggccaaccaaggcaactgagtttaaaataaattttttttcttctgtttgcagcatctggctttctttagctcagtgttgagcatggcctactccttcagtcctggtcaggctggaccgtgtatacagggtcctcaggcccaccggaccctcacagatctgaccttgaaggcattgtgttgaaagcagtgcaaaaggggagagcaccagggagacctttcccctcacacagtggctaatcatgtgacattcctgcaggccaccgaaaaatttgtcaccactcacattcctgttgatttagtgtttcgagcaccgtctcccatttatctctgctctctgatttctctgcagtccagcccttcccagaacgtggccctgtgctttctcccaggagctaatatttattacccttctttcagatccctctccctccctccttctctttcctctatctcagccccccccccgtgtgtgtgtgtgtgtgtgtgtgtgtgtgtgtgtgtgtgtgtgtgtgtgtgtaggctcccgagaggtggatccccctgctggggtgctaggtcagaatctggggatctctcgggcagaggctgacagttcgcccctgtctggagccctcggagaccccttgctcacgtttactcttttgccttggtgttctccagccagccgccgtctcctctgactcaccagggctctccttgtgctgtgagccctgcccatatagagaggtccagtcagtgctgggacagacagtgactcagccccagaccgtcttggccaaaggcctcctgcagagcgccacacttatcctttctccacgtttcccttgattcacaatctcctttgagggttgggttcaatccctatgaggggggctctgggcatagcagtgtgactgtggtgacatggtgaggaggaggtggtcttctgtgggctttgtctatctgcttccttgtctcgtgcagctgcctgtccctgcccttcctacttcttcctcaattgtcaagattgcagctccctccctacacttagggttgcctaggttactaggcaacaggaagtctccaggtgagagagcagcggtgttcagaggaggtgggtctgctctgaagccctggctgaggtgacttccaggccttggtctaggagcaatgatagaaacagatctctcagcacccatggcagagatagtggagactttcaggctatacagctgcctgaggcaggcggagggctgaggagagtagccaaccgagggctgtgccaggggaggtgatggagtctttcagccccagcctctctcagtcagccttgcaagaggcaggaggcaacaagcacacagaggaccacgatggcctgaaacagcgccaggaggtaaaaaatcaatattgcagttgccaagtgagtcttagaactttaggggaacagaacacggtgtagctgggaggacagagtgggctgccttcctggcccattcccacaaggaacaggcacttctggacatgagactcagtgtcttaggctgacaacagatcttccagcaatacccttgtttgtacctggcttgcattgctaggctgggaaggccacaggcagggttctctccaccaagaagcccaaagaaagagtcaacaaaatctgattcagagatgagtaggtttcgggataaatgtcacaagcgaggcccttgaagtccaggagtctgtttctccaaacctgtcattatcaggacaggtaatgatctctgagcacggatgagagggcagctggtcccctgtgcatctgctgctgtctgctggacctgaaagccaggttagacagaagaccctgtcatcagcacagtggcgtcccaggtgacactcactgggaggcagagctctgtcattctgtgaggaaagccagctctgtgtattcttcctcagatgattaaagagctttccagaggtggctaaggttactgagcagtgtatctgaaaggagagagatgctctgctgggagatgcgtctagcctcatgcaccctaaagagcagcgatggggaagggagttggaggctgtgggatgtatctatccatcactgctggtttgaaagatgaaagcagcgaatggggtggttcttaaaggcaggatgggtggactctggctggcaccccacaatgtgaagaggacctaattcctacccacacaggtaacctgtgcttgtcaacaatacagctgagctcgaactcaaaactcctagagtctagtatacagtttggtctttcctgggactctgcatagtacttccccagcctggagtctgacccagagtgctataagaaatggcatggcagttcctttggagtagtgtgtgtgtgtgtgtgtgtgtgtgtgtgtgtgtgtgtgtgtgtgtgtacttgagtatagtgcctgcagaggccagaagagtgctgtattccttggagctggagttataagcagttgtaaaaggcctaatatgggtggtaggtatctcacccaggttctctgtgacaaccacaagcacttctgatagcttagccatccatcacttcagctccacccccttaagctaccctcacttcttgttgtccaaagactccatctgtactgtgccacaaacctctggtgttcccccacctggcccaactttccaggcacactttcacactctgcgggagtgtatgttcccccagggtctctatacatgcatactgtgcttccttggaggacctgcagatgagaagaaaaaccagcatcagaattcagccaagttcaagaaataacagagaggctcttctgcatgtaccgtggactgacagcttgagcactggtctggagagaagacattcagggccaggcacagaggtgacagggagggcagcatggcagacccaggccaccatcagggctggctctgacttagctcgttttagtttcattctattgctctgctgaaaaaaacctggggagcaaagggtttctctggtctctccttccagaccacgggccaccatgaaaagaagtcagggcaggaagtcacaacctgacagcaggcctgcctgctattctaggttgcacaacctctaatcagggaactcgcccacagccaaggaagagcaagcagaaaccttgggggatgctgcttgcctgctcattctggcccattaccaataagacccttatataagaccacctgtccaaggaacagtgctcttcaacgagcccaccttcccaatgctgccgccaccctttgatacaggtcctcgtgttgtagtgatcttcaagccataaaattattctgttgctacttgaaaactgcaattttgttactgttataaatcctaaggtaaatatctaacattcggggttttgattatacaaccccatgggggtttcgacccacaggttgaaaaccactgatctagggcacacctcaattgagactcttctagaagatgactctgggctgtgttacatggacggttaaagctaactgggatggcagccaagagcatggccattggaagaggagttctctctctctctctctctctctctttgtgtgtgtgtgtgtgtgtgtgtgtgtgtgtgtgtgtgtgtgagtgtgtgagtgtgcgagtgatatttcaacattgctttggggttgctggactgttgtgccttggaacccaatcacccctacaagaaatatcaattcccctttaatcccagcactcgggaggcagaggcaggtgcatttctgagttcaaggccagcctggtctacaaagtgagttccaggacagccagggctatacagagaaaccctgtctcaaaaacaaaaacaaaaccaaaaccaaaaaaaaaaaaaccccaaaaaaccaaaaaacaaaaaacaaaaaaaaaaaccaaaacaaaaacaaaaaaacacaaaagaaaacaaaaaaaaagaagaaatatcaatgcctctcattccaagaaatgaatgcctgaagccacagatagtacctgactttacatttgatgaattttcttctatatgcatacctgtgatgaagtgtaattttttaaaaattagacataaaaaataggtcaacaataactaataatgtccaacaactttaatgatattgtacaataaaagtcattttaaaactttaaatagtctttggaatttttcatgtgatctttttggactctggctgaaccaagaaaagaacactggatgcagggactgaaatgatgtgctggggactgcctgtgttgccgtctccctctctcacccctctcttcctaaatacccttcccttccttgtagctcatttccaagtctataaccttgcaagttctaggtgtgggaaatgctacattgtcctcattttgcaagtgaggtttttccctgcagctataaattatgggctggaccaggtctcctcggcagctgggacttccctgcactttgccagggacactctggcccctgagggccaccctaaggtgttcccagtgcttgggaattctcctgagaaagaaaggggctaggaaggagggactgaacacagctggtctctttcctgggatgtgtgcagcttggcctaattttcttgtaatataatcaggttaaagtccagctctgagcgccggtgttgttcatggcttcctgtgacgaggcacagacgcacttgcctggctctccagcccctggatgtggggaaaaatagatcaatgagctcctggaagaacccaggcctcactgtctggaagtccaggcggcagaacccagacagttatgggaacattcacaggatggtaatgcttgctttctccttcagtggctctctgaccctgtggccattgactgagctggtggtcacgtaccgagtgactgatgtggctttactttgtcatggtgaagggacgtgggacgcactacctgttttcagacttcagagctggttgtgggttgaggtttatgagcctgttgtgtggtagtttgaattgatctcactttaataaattttattattattattgttattattagtggtagtggtggtggaggtttgtgtgtgtgtgtgtgtgtcaccgtgcacatatggaggcagtctttcttgttgttttgtctaccctgggcactctatctctgaagtcctcatgaattcccaagtgattattttccctccatttatcttactatagaaatgctggccttacaggtgtgtgtgcaaactcactccatcaggattttatatatatataaaacattgattgcagggatttaactccggtcatctagctagcaattttaccaatgggccacctgttcagtcctttgattctaatttctgacattggtgtctatccccacccaatcatggtgacctggttcatttgccttatgtctttccggatttgttatttttatttagtgtgtgtgtgtgtgtgtgtgtgtgtgtgtgtgtgtgtgtacatgcaagggtatgtatttgagtgcagtgtcatcgggttatcaaaggccagaacaagacttttgtcactggggtcaccatgcttgagaagcactgcatgtgaatgctgggaactgaacttggttcttctgcaaaggtagttttca

SEQ ID NO: 1352 - DNA, 1073 bp, Mus musculus
ggtgggcgcgcatcggactctgggaatctttacctgcgctcgggttccctccgcactcttttggataacttgctgttcgtggatcgcacaatgactctggaagaagtccgtggccaggatacagttccggaaagcacagccagcgatgcagggcgccgggaaagcactgcacgaacttctgctgtcggcgcagcgccagggctgtctgaccgctggcgtctacgagtccgccaaagtcctgaatgtggaccctgacaatgtgaccttttgcgtgctggctgccgatgaagaagatgagggcgacatagcgctgcagatccatttcacgttgattcaggcgttctgctgtgagaacgacattgatatcgtgcgcgtgggagacgtgcagaggctggcggcgatcgtgggcgccgacgaagaggggggcgcgccgggagacctgcattgcatcctcatttcgaatcctaatgaggacacatggaaggaccctgccttggagaagctcagtttgttctgcgaggagagccgcagcttcaacgactgggtgcccagcatcacccttcccgagtgacagcctggcagggaccttggtctgatcgacttggtgacactctagcgcgctgctggctctggagtggccctccgagggcgctcgagtgcgcgtggagactggcaggcgatgttgcctggagagcgaggagcgcggcctcccaagaagggggtctggcggcagcggggacaccttgttccgagcccaggactctgccagtgtccggagaggctgctagcacaggaaggcctaggcgaggacgttggccccagggccgggaagaaccgaccagcgaggcaggtgtgactcagcaagcagccttccagtgaaaggaggggaaagaaaggcaggcgaccgcctggacttggtacagcggcaggagcggccactgcaggagcgagctggacttagccgactgcactgctctttcaaaaaacggatcccgggcaatgctttcattttctaaaggacgctatcgtggaagctttgaatatcacaataaacttattgaaacaaacttaat

SEQ ID NO: 1353 - protein, 158 aa, Mus musculus
LWKKSVARIQFRKAQPAMQGAGKALHELLLSAQRQGCLTAGVYESAKVLNVDPDNVTFCVLAADEEDEGDIALQIHFTLIQAFCCENDIDIVRVGDVQRLAAIVGADEEGGAPGDLHCILISNPNEDTWKDPALEKLSLFCEESRSFNDWVPSITLPE

SEQ ID NO: 1354 - DNA, 21543 bp, Homo sapiens
atccttgtgatgaaggttgttaccaccactgtacaggagaggaaagaggcaggaagcacctgggtgatccaagactctccccttagggcatattggccctaggtggcctggtggtggcctcctggtaggcgctgaagggtggggcagggagttgctcaaagccaggggccagcaggagcagaggcgagctggaaaatagcagagatggatggagctgggcaaaggagaggatgggggagctgcatgggtccatgacacctgctctgacagggttgccatcctcttcctcattgaacttagtgcctgttgcatcctagagcaaggcaggggccgggacgcacatacctccatgaggagggtgagtctctccaggttacttaaatcaattatcctggggaagtgcaagagcggtgggatccagcctgagaagacaaggggaaggctgggtggagccgtctggttcaaccaccctgagctgggtcatctgtcatggaaaccgagagtgaatagagcagcccactgtcctctcggccatgaactatttcttacagtagactcttcagtaaaatggaaatgcaccatccaggttctcttctgggctgttttttaaaaaattaatattacggtttaatgtggattcaggggaactagtaaacatttcccatctattcaaaatatcagggaaggatgtgaatatatatgctcaacagctcctgataagcgaaagagcctgggtttgctgctgagttttctccagtgctaactgagcacatacactagtgaccacagacaccctgctctgatgacctccgacatcctcctgcaaaacacactcactgattccaaagggcagaatagcgactttaggctggagaaacctggcagacaccatcttggtcaaatgatcatcatcccatggcaatcaataaccagaggacaccccatgacaatcaagaaccagaagacaaatcaaagcacatgatcctgatatgacacaccaagaaggacacagcatcaccactgtgatggtccagttaatggtttatcacctgaattgaatcaggaggaaacagcagataagctagccaaaccccagcagtgtgcggggtggaggtggagaggagtctgtaacataacaggcctgaaatattaaaaagatatcaatgccatgaaatgttactgtcacaaagcaaaactcaggaatggttttggattcagggagatgacagagatgtgactactgaatggacctgtgatcctggactttcttttgctacagaggacatcactgaaacaactgacaaaaatctcagtatggtttgtagattaggtaattatatcaatattaatttcctgaatttcatcattttactacagttgatagatttaggataatattcttgtttttaggcaatacacattgaagcatttaatggaaaagaggcaacatgtctgtatcttaccctcaactggttcggaaaataatatatatacttgaaggagagagacaaagctgaaacaaatatagtaaaatgggggaatctgggtgaaaggtacatgggaatactttgttttactatttctataattttcctatgtttgaaactttatcaaaattaaaaaatttaaaaatacctccaaaatacagaggcttaagacagaagattgtgtcttgtctactgaacacaacagtgtggagtgtacaggctagcaaggaggctcggctccacacagccatgcaggaccccagaccccttcccttgtgactgcataattgagtcacaacagcaaggaggagaaggaagctagttggccagctacaaacttctgtttgagcaaggaatgtagaggaactggggcccaagaccaccccatgcagcaagggagactgggaatgcagtctctggctgggagtccctgtgcaaagtcaaaacgccattactgtggatcatcagagagcagacccgagggctcgtgagcagtctgccccctcaccggttctcagattcagaggtaatctgaagagtggccatgaccgtgataagcctcaaggttctgcaactagtctatatttctcacatctgcccttgcctgacagcggcttcctgtgggggcctcacaccatcctgccccttagattctgaaacagcgcctcccatccaccctataccttgcaccttttggcgaatgaatgaccacacacttatgtgcatgcatgcatgcattaccctgggctcttgttaaaaggcagattctgattctgtgaggctaattagctcccaggggaagctgaggctgctggccctggatgcactgggcagcagaggtctatgggcatcttcagggtgcacctgcgtgctttggagatgaaggagctgtgactcctgttccttttgagagggcaacgctgggaggtgttgggtgcatgggaaatgcaccagcaagtgggactcaccttccctggggtggatgtcatgccgcatatgggatttcacccgtggcaggctgttcatgtcgggtgttgctgaagagattggtaaattaggcagagttttggaggaagttaccttgcaggtccctcccaagtttaaatttgcctgtgggtttgtgagtaagaaaaaataacctatatacttcacattgtgtggctgatgaggggaattcagaactgaagaccatgggtgattcagagaattcctgattttgtaagaaaagcagggtatacaccctgactgatcctcccaagtacagctgagttgcacagtaggctgtgccccagggtagctgtttagctgtaagccaatgttctgcctgtggtgtggcccaatgaacctgaggctggaggcctggcacatgctggctagaatcccagctccaccattggctgtgtgaccttgggcatgtcgttaaactccctgaaactgagtactcctatctgtgaagtgggcatgggtattacagctgacacaggaacgctccctgatggtggggtctcttttccttgttgatggtggttcacactgctctgtgactaccaaaccctactgcaccatcctctgagccggcctgacttctcgggggctgcccagctgtggcacagtggggtctgagcccactgttaccagggtctgctgcatctggatattaaccttaatgtgtgatgagagcccatgggctcaccagaaacacgcttacagggcagcacttgcaggcctggaagggtttaggccagctgaggtgttagaagctactttttagggctggaagcgatattctctttgaccgcaagatgtcaccctgcaaccatgacattgggacaggcactgttggattcagggttcctgaggagaaccaaaaatggttttgaaacctcattttcacctggatgctctccttgtccttggtggtcaaatggtttgttctaaaggctcgagaaatggtttcacagtgaaattcatctgttccctcttgcttcagagaggagctcagaacacccagctttgccacctcctggctgtgtgaccttgagcaagttgttcaacctctctgtgcccaagattcctcatgcctaaaatggtgataatagcacctacataacgagtttgttatgagaattaaacaatgttttcaaagtgcttggaacagtgcttggtgcacagcaagtcctggaaaagtctagtaaataaaataacaacaatactactaatagtgtactcaaggagtgccacacccttctcaaacagacaaaattcaaacactgaaaaattaaataataccctacagtctcaagcacaggttgagtatattacatgttttgaaattttagaattccctgctgtgttatgtaggcaatggaaacaattttcataatctattactgtaattcatttctggaaaacagacattttcaacaagaagggagtggaagataatttcttccattgctgcttgcctcagtgtgcgcagaggatccccaagggtcctgtgaaccgcatttgtaaggaaaggtgccgtccagggtgtttggttctgacttgccggctggccttctttcctgcctccagcatgttgcctgggattccatcccagtcatgccagagttaacctccgagtacagttatgacgattttcactcagtcacaggcgcagaccggcgtcagatggcaagaggaggagtgcaggaatcaaaggtcacagtctcaggagcaaagccccacagacgtctggcttctggatctgtgaccatatggtcaaagattgctctgcacaataacctccagagcagtcaggttgaggatgtctggtactgaagttactccatttgagaagttttatatatttttgttaaataaaattgaattgtaaatgtttaattgcagtaaagcatagtgaagaaaattaaaaatcacttataatctcatcactccaagatacaatcaccattcctactttgtgactttatacagtgatagtcgtgtacgctgaaagtttttgcaaaattagaattgcacaatttcgtattttgctttttttcacattatatcatgccgggaactactcttcagaactcctttttatggttgcataatgtttcatttctggttacaccatgatttaacactagccccctataatgttttctaatttttcactattttaagaaacattgcaataaatatttgattatcatatacatttttgaatggcgtttttggagagcttaattaacgggtatttaatgggctaaccagcatgaattctttctactttacactttaaatcatctgctaactcttcactcaaggtcaaagttagcaagcagctaagcccagctttgagtcctgctccacaaagtttaaactccaatgtcatagtgccttttggaggttgttagtacattttagcttttggaacataaaagaaggaaggctttactgtggaagttctgtggttctattattctattatatgctacatgtaaacatttccagaaatctgttagaaaagaaagtttactgccaacccaaatgcctgcagggaccaggcaaatgccagacagggcttacacgtgccagtggacctaatgtgacatttggaacatacttacagtgacagagaggatgtgtgccaccaactctcccctacacaaatgaacaagtcagatctgaatttgtaagtctttcgggacactgtccaccaaactaaacccatctgtgggccaaatggcaaccaggagcaatcttataagaccccaataaggttcatgaggggtaaagggcacaatttttatttcctaggttgggaaactaaggttcagaagacttgggcatgtagtcaagctgggaagactgcacatctgtggcttctcaggggttttcagctacagtgcaggctggtgtctgtcactacctaggactgtgacaggtgccatgaatcatttcttactgtcgatagagaagggaacaaatgcataaataatgtatccttccccctcaattactttgaaggatttccctgggctaatgttaacctctttcatgctacataagtgctcacccaagaataactgctccttccagaaagtctttgcataaggatgactgaccagaaatgtccagcttttgctagatgtgtgtgtgggaggtgtcctcctttctcagcttcctgcttcttgtctcagttgtcctctgaagcctccccatgtgcagattcatgcttcaccctgggtaaggaggagggcatggtggtggtgagagccaatgcaatggtgtccttcacatgctggaaggcatctgagatgcacctgttgggttttaagtaatagcttttatgtgtcctgcatgaaaacctggcttccttttgagttaatgtactattgtcactgagttgctgctgccccctatcattcaagagcttttttggaccgaagaaaacccaacagaggacccccgaggagacttgttctggcccgagaaggggctggacgagggagaatagtgagggcaacatgaaaccttttggaaacgggccagcccagagtgctccaagagccctgtgctgacataggacactgtcctgcacaagctgagacacaaatgatgctcaacctttttggcttcatctttaggaacttggcccctttattttgtgcttcaaacttcagtttcttgattgtaagcgcaaatgtctgcaggtgacaggagggtgatgtaaatgaacaaagcagccaggtgtcctcagctggggtctggtggggattgaggtgaatgggagagcagtgcccaatgcgggatcccagtgcccccgacccctgctgaaggttaccaaggtggggaggggactctaggcacatcatggccaaatctacccattttccaagagaagctagaaatccagatgtttatatgaatgcagctaactttgaaaagtggcagtgaatttgactttgcctaagacgcctcataggccaaagaaatcccacgtgcagtctgcaaggggctggtgcgtagccagctttgcatcccacagcctctggctgactggtcgtggattctggcacattgtttgggtaggataagggcatacacctgctatttaataacaatgttgtgcactctccacacataagtaacttgtgaaaatacaacaaagaatatctcataaagcttactgcttacttaaagctcatttccttctgtacccaaatgaaagacatctgcccatcaatgacctagtcaagccatggaagaatgagaagcacattttagagaatgtgttaataaaaacagttcaactataaacatttccaaaaaggttttagaatagagcatctctgaggatatccctttaagtaagtcaccatcacctgcattattgagatttaggggaaggtttaggggtgcagtcacaggaagctcaggacaacatctcagccacctgtgacctgaagcacagagcaggccaagtcccttgctgcatgcaatttgggagagctgtggccacaaagccgtgtagtgggatattctggatcctcaaacttctagtgggcattgcccactcctcaacacaggggcatcccaggcccagaagcttcagcatgtgtctgaactgaagggtggtggtgggtctgctggaaggccacctttgcctgcagacaaaattgttcttcccaattgagatgggggctttggggccattgggactgacataacaaagcaaagtgaggctgtatcatatgtcaaaaaggcagtttcctgaaattgaatactttaaaaatgtgagcagagtagaacagccccaggggtcgtcaatcatctcttctggtccaggctagctcaggagggactggaaatgcacccacccccaactcgaagccgggagtgttcattagtggccttcctctcggaggaggggctgaggcttcaggcctagcctttgttttctctggcctggcatgtaggcagatttttagcgtcataaattggagaggtgggtgctagcatgttaagtaaatcttatttccagcatgtcctggggacctgggactaatacattttaagaaatgtttaatagtaggccgggtgcggttgctcatgcctgtaatcccagcactttgggaggccgaggtgggtggatcacgaggtcaggagtttgagaccagcctggccaacatggtgaaactctgtttctactaaaaatacaaaaattagcccggcgtggtggcgcacctgtagtcccagctactcgggaggctgaagcagaaggatcgcttgaacccgggaggcggaggttgcagtgagccgagattgtgccaccgcactccagcctgggcaaccgagcgagactccgtctcaaaaaagaaaagaaaagaaaagaaaagtttaatagttttaaaagagtaatacctatattccaatcacttaaaattaacatattttatccaatcaaggcatatcatcattttatacatcaagaaagaaaagaaactagcgaacaaacggggcataatgccgcctggctccgcttccccctcccctctccccccgtccttaggagacacctctggagttcagaaatgctaggagagcaagctcttcattcttagaatccaggaagggccgggcttttgcagctctcctctgccaggaagccgctggggggcgcaagacgccagcttctcaccttggcagaagtgcctgcctgcaagcgcagaatggaaacttccccataacaaattcagaagtaccttgtacattcaccacccacctgaagaaagcctgaatgaaaggaacaaagccacggcgttgtttactttcccattatcgccccagtcttgcggcagggcccgggtttccatccaatccacccggcccgccactgtcctggccagtctccaaggcttcacccaaaaaaaggaagcaatgaggtgtcccccagcgcgccttttcacgtagcacagaaggtgctcagtgggtgaatcctctgaaagtgccagcgtgtatggtcaaacggcagcaacctctagcctattaaactctcccaagatctcttccagacttattccattgccggaaaaaaggctttttacatatgcgcatttaagtaattaagatatttcaacatggtataagacgtaggggctcttactccatcagtactggatgggaatttccttttgccctctactccccagggtaactgcagtcccacctgaatgcgttttgcagcccttactcgggttctatttatgcgcagcttggacagggctcactgggcccggccgggcagctccgtggccgtccctctccaccgcccttcccccgcgccaggccaatgcaagggtgtgtgtgttgggaggaggggaggacaaaaggggttcaggatctttttaacctgcctgcagatggcgccccgggaaagattccgagctgcattccctaagctccaggggctgcagccgcggggtcccggccacagggcgtccagccgcgaagactgcacagcagctctccgtccttcccaactcgcgcggctgttcggcacccgtgcgaggaacggatggaagggaattacatgtagcagggccagtactgggggcgtgcactcagggatcacggagtggcactcagcctcgaccccacgcgccaggcagcccggcgacccccacgcgcggcggggtcctgcccaccccacccggcggcaggtggacagtgttgctatgaagagaaagcctcgattgtccctacagcaaaccgccacacgccagacctctgctattgtgcgccctccatagaaatgcaaacgagcggcgtgcgccggccgcaatctgctcgcccccgcccgcccccgtctcccgcgccccgccgcgctcggccaagggcggggaggtggggtgggatcttccagagacggctcaatgtacacattgagtatgcctggcaggcatcaccagcgcgctcgggacgctagtggtcagctgcagggggctgtgcccactgccttttgcaagcctctaactggcgctacctgtttttaccttaatttctggctccaatgcaacagtctcatagacttcaaattaaagaaaagaaacaaatagaaaggtagcaatacaaaatgcaaaaaaaaatccctttgcttctataaaggtgcttttcgcaaattgcagcatcatataagcaaacaaggtttttgtgggttgggttttttcttttttttttttttttactttttccttttaaggacttcaaaaaaaaaaaaaagccaggcgagatgaaatctgcaggctccagtctgcctggtaacaccccaacaaaagcggcagatttgaggcattgtcatcccccgcacccctccccacgtggccttctggcacgagccgctggctcgccgcctcatttacatcagaaagcgggtgccggccaataggcgcgcagcctcgcgccagctggcggcgccgcacccaccagcctatataagggcgcgcagcgtagtaggggcgcactcgctggtggtgggcgcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggtgggtttcagggcgctgagaaagccgctggtcggtcggcgaccgtcagggttttccagggtgggaatccgcggggtaggaggggagcgcgggggtccgggcgccagatcccggttggagagccggggtgcaggcgctgagccgggattggagtgtggttggagttggggagccaagggtgtgtgccggtggccggggctggggtctccgccgcgccctccggccggctcccgctcactgcgctggctcctccgcaggatgcagggtgccgggaaagcgctgcatgagttgctgctgtcggcgcagcgtcagggctgcctcactgccggcgtctacgagtcagccaaagtcttgaacgtgtaagtgtagacgcggcccaggctgggagacaggggcgggggtgaatggcgaggagactggcggatgggaggggtggcggcgggagaactcggctagccggttctgacctaggtccccgccttgccctcgcagggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcggtgagtacagtcccgtcctgtccccgccccagtgtcgttcccgcctcggcccgcggccagccaggctgaccctgctctctctccgcagaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagctttgaattttacaataaactttttgaaacaaacttatgctctttattgagggtaggggatctttgtgtcgggggaggtggcgtgcagggtttcagaggattgctggaactccgtggaactgatggcacctgttccgtcttcctgtcgggcaagaatgacaggctcctcccctctggcagagggagggcatgctgcccagtgctagggtagaacttgagcctggctcctacttttctccttttaggaagattttaaacttgcaaaacaggagcatacttgagataagacagtgcagcagctgaagtcttgccttccaaggcgataacagtgacctgtgcctcccctccccctcctcggccctcctccccctccctcctacagctgcttatctgaacagcttgcaggaggcctcaggctttcctgcacaatgagcattgccttctgcaggccctgccctttgtggtccctgaggatggtggcagactgctcctgctcttggggactttttcctcttaaatgctctgacacaaagcaatgctacaaaggtactaataccaaatatgacattgatgactgcatttaagtatgagtcattactttgtcatggctgtgatagaacttggaagatctgagaaaaaattggaaggcagcatctatataaataggcatgagcaattctgagggggcctggcatctgctatctactattttcagtgttctctgcccacatcagagttacgaggattgctgctattcacaattccgtttaaagactcataggaaaaaaaaattaaatattttaagccaagactttctttaaaaaggaactagggggaaatgtcctgatcgaatcaatcttttttatgagaccaatatgccttgagttcgttctgtgtctaactagctgctttcagcaggggaaatacatgtgggacccttgtgctgtcagctagactgccaagcaggctgagccttctgggcaaaggaggcatgatgtgctgtcttcagtgcttggggtggctgatttacctcattgagtgccacgtcctaaaattccgtccaaattacgggaggattcttgaggcaacaggaaaactgtactgaattactcttcttgtaatgaaagcgtccttgttttccatttatcagctcctaaaaacatctactcctcaatgggacagaagcctagataaaaaattcagttgtatttgtgcccaattttcattactattttacctatttgctgcttgaaatcttaaggttttcttattgaggtagtcttggggtgggcctgtctaccagtctgcgttccagcaaaatgaccagaacatgctattgtaaacacaaagtggacttgattactttaaaatgaacccttaaatgagtaaattcagcagaacattgcacagagcaggtaggcagaccctcctgttggccaagcgacacttgtagaacatgaggttgtaagcccttggttttttgattagagcttgctatgaggccacctgttggaaccccaaagggctaggagaattttcaggtgaataaatgcatgatgggacacagtgccatgcccaaaagttgtgctaaactttttctttttttttttttttgatgaacaggtgtttaatgctattaacatgaactaactcagagggcagataataaaatgtccagtgtttataaacacataattgcatttagtacttccaacaaccctatatgataatgcatatataagccctcagtgcgtggtaattatcactacatatgtgttgggggtgacccataaagacgagcacaatgcctggcatctagaaagcactgaatgaatgttaatgacaataatacttaaaagctaacgaagacatttgtcccagaccacagaactccaagtgaactagtgggttttggactagccgtctggtttcaggaccaacacgttgctgccatgaacttccgggtgctggagcacttgcggcaggcttattttggaaagaaggctattttcattagataactttctacctttataagttatatgtattcattgcagaaaaattgtaaaatacatcaacattaaagaaataagtaaaagtgcctgtaactgaccatcagcaagttttgatgtattaatatttccttctgaacttctatttttcctcttacatattctgtaacacacacaagcacacccaacagtttttaagctgcatttggcttagtctgcattggatttagttaccgtctccttttccttaacatgctattacagctcccatatatccacatgaccttgggacagggcttgtctctgctttagcaggctccagtgcctgggtgaaaatacacattccagcctgggatccagctggggcatcttctttaccttgcagccctcactgaactggaaacatgactgccgtttgcaggattttaggtatcacatgtctaaaacaaacctttgccacccccagagcaatgaaagtaaagcattcttatttttaatttttttaagttttgcatatggtcactgtaaaaattggcactggcaaagcacctgttgtgaagatgaaatggatacagaatgacaacaggagcagcttggagagtcaggcattccttgcccacacccagcattgcccacatagggagctgaggtctccttgttcctctcctggcaagatgataggacaaaatgatctctgagatttattttatttttaagggctctaattctctgtgttatatattttattaaaccattagcctcagaagtacaatgcgtattggttttgaagccacttcagaaaaaataaaaaatgaatttttcagaggaaaagcaaggatgttggcaaacaaaccaaggcgtgtagggtcagctcagtaaacagatacccaattttgcttttttgagattcttgtgtttttcagttgcttttctaagatgccaacccctgtactcctcatttgagtatgccctccaaaatgtcaaaagtgtattgtctttccacggtcacaaaggagagactttatgacttaactgggggcaatgagacatgatcctgcgtggtgcacctgagctgctgcaagcggccgccagaggagtggctaagttcgtgtgcagggccagctggaagcctcggggtgcctggaatgactacacggctttgaattctgtcctagcgcaaacttatatttggtttttaggtctagctcaaacttccctttatcaactagaataaaattgccaaataatttcactcccttcatcaactaatagtgtgtgagtaaagttcatccacacagggtggcagagtctagatactgggagctggtggctgcaccaacaagatgcatggcttcttgcccactgatgcagcagaggcctttaaaacctctgtgagctcctcatgctgggtaagacaggcactgccttgggctgctgggcttcaagggtaggacataggctgtccaccatgtggttcaagcgttcattcattcatcccctcattaattcagctggcatttcctgagcacatgtgctgtgccaggcacagtgctaggcatggcctccccactgatccttgcctgcctggaaggtcctgacagcattgagttgagcccatggcttcgcattcccaagcccatccgtctcttattcatcctgcctagaaaacacggtgaggacaggaatgagaaaggtgagtgtggggacaccatttcccataccaattgctaattttatgagactctcattggccaactaaaaaatatgtcacagttggcattccattacctttttgcatcaaaaacaccctcggcttctttccttctcaccatctcccttttctttctatttcttcgatttttctccagtccaagacttcccaagctgtgacttgtgcttccctcctgagcactgctagtggcttccaaagactgctttccaattctacttccctccctgcaaccttctcttcttcttcctttttttgcctccacctccacctccacctctgctcttccctctcgtccattttctcccacatccttcccttcctcctcctttctttcccccttccccctccaccttcacttccattttggagctcctgctgtgaaccaggccctggggactcagacgagaaacgagcagcctctgctcccaggagctgggcctggcgccagctctctggcctggcctggggctctctccagttcccttccatccactcagtgtcccagatccatcccctcaaacttgctaggccctgaccctgtgtggaggtccagcggacaccttgtctgattgagcccaaagtcagtctctgcccagggcccggcctggtgcaaagagccatgcacacccgcatgcttattccatgcccttccctgggggccaaggtcctgatctttgaggtgggcttgtggatggatgactgggctatgaggtgggctatgatgacagtgatgaggaggtgaagtttcccggtgaagagagtatcacaccctgtgcaaacatgggtgggctccacatatcccagtgtgcccagggtgcagcgctctgtctcctaggtttctccatgctctgtccatgctctgcttctgccccttccatccctgtcctcagggtccagctctttactgtcacctacctgagtcccctacttttagggatgccagtataggcttgggggtagcaggaaggctcctggtcagaggagcccctgctatagtggagatcatgtgactcctttgggtctggcccaatctgcatctgtgtcctgggccgtggctggagggagctcacctgggcttccttttccattttcctgactctccctaaatcactcagtacatctgacagagtccagaagcttgttcatcttgggtggaagggaagagagtctgggggctgggtagcttgctggggagggtggagatgcaagggtgggtgaggatgagggccacctgccaccatccctgagaccatgatcaggcaagtggtgcaggcagaaggcttgtggatgactgtgcaagcctgaaagcacagcctgataacaatcaataagacaattgtcccgcaagactcccctctgagcttcagaatagaacagtgtttctgggagaacagagtgggctgagtcctccttagctctttgtcgcatggaggaaaatgcattagaattgacatcttagaagtggcatcttcctaggaaatacaacccgaccaaaatgggtggaagaaggtgctgtggaaaggagacagcctgcgtgttttctatgcctctcgtggagtacaggctcatccagcagagctgccttcagagcagaaagaagggatgggtgaccctttgagactgagctgatggtgtcaggctgcaaatcagtgaaggtcacatgaagtgttgtttgctattggggagcacgggattccacaaaacctgccagagatgagcaattttctttttatagaagttcagtaaatgtctcagaaggacccctgcaaagtccccgagtccctttcccatccagatccagcacaagcaactccctctgagtacagcccatggggagctgctcagacttgcccctgctgctgtccacctgcttctcacctggatgcgcagtgactgacagatgaaactgtcttacttatcttagtgatatgtcagctgatatctcatcagaaggcagaattctaccacaaacctccaaccactgcctcctggtgttattcccacagttgtgggattaaggaatgttgcagatgtaattaaggttactaatcagatgacctgaaaacagagagatgttctgtatgggccaaacctaatacatgaatatgttaaaagcagagactggctggttggggaagcagagccagagactttgcagattttggaagaattggacacaccattgctggctttgaagagggaggggctcatagagcaagatttgagggtggcctctagaaactgagagtggtgcttggctgacagctagcaagagaatggggacctgattcctacagatgcatggaactgaattctgtcaacgacatggatgagctggaagcaaactcttccccagagccttagagatgaccgcagtctggctgacagcttggttcaagccttgtgagaccctgagcagaaaagtgagttgagcctgcctgacttcagatccatggaactgtgagcccataaatagcgaatgttttaaactgctgagtttgcgctaatttgttactcagcaatagggaacgaatacatcccaggaacatcagggtctcctccttccctccccctacctctcatgcttcgattgggtctacctggacctcatcttacagcttttgtactcctgtcctgcaccacctccccaactctcgcctctccctgtgtcccacagggcttctccctctctccagacatatcatgccctttcataccccggggccttggacgtgctggtccagctgcgtgaactgcatgttttcttgaacggcgactctgcttgcaggtggaatgcatggagtgcacgggcgtctgcctagagaggagatgtgggggctgggcatggaggtagccgaggagtcagcctgcgggccctgggccctaccagagctgggttccaccttagcatttaaggaggtggcctatacagagcaggtggcagtgtcgggacagggggctccttccaaggtcaccatgggattggtgggcaggcctgtgcctgtggtccagtctctggctctgattggagcacgctcattcctacagaacattggcaaccctctatcgctcacctgcagctggggattaaaagacccaagggccactgactgggccactgaatcactgattttcatccccaaatcttttcccttatatgaaatttcccaagtgctgtcaaatcacagattcttagtgttggagggaagcttagttattcttcatttcacaggcaaagaaatgggctcagagaggtgagtccatagttgcagtgaggtccaggtctcctcatcaggtctgggctttgttgacccagggccttttggtccaaagttgaaacaaaggccttttagcatcccctctgggctgctatccgatgcctagatgatgggccaaacacaagcaggatagctatggaattcacggttctccagagaaggaagcagatgggaaagtgagacctgcctcgcctaattttcttgtactacagtcttttggttaaagcatctctcattttgttattgttgcttgtggcttcccattatgaggagttgacgcgtttgtctgtctgtctagcctctggatgtgggacaggcagatcaatgagatccaggaaaagtttgtgtcttgctgtgtgaaagctgaggctgaccgaacaaagtcactcagttatgggaacacttgttaaaaggatgtcaaagcttttattttcccccctcaaagtgggtctcttgtcctataaccactgaccatcttgatctcataccgagccattgatgtggttttacttcacctccaggggaggtgggatttgctactgagtttcatgattcatttttcagctttcagagtttgctttggtttgaggtttacatgcctgtcagtgatgaaacatggtcattagaattgattccgatttttgacacttgcgttatccctaccctgcaatggtggattggggtcactcatttacagcctatcttctgcaagtgggaaaattcaagagaataattaaaatgtgttgcgttttcactatgacaaagttcagacaaatagaattctaaggaacaacagtgaaacaacagtaaaaagcaaaattgaaaggaaaggaacagctacactctggagaaagtatcctcttttgcagcaagattaaatttccctagagtgattcacggcagcaaagcaattcatggaactcccgcgttgagcaagaatttgatgctaacattccaggaaggaggctgcaactgcaggttaggctcagctatcataagaccagttaaaaccatggtgtcttgacatgtctgcaaatcactcaagccctgcaaggccgaaacaatgaccaagataaagtccagggagttggtaggtggcccacatgtcaccaaatgatccacttgggctgactgagggtttgaggtcctgccaggctgtgtggatgcccacagtccccatgcaggggagggtgagtgagtttctgctttcaccgtcatgagcaggggcaagcagctgttctccttctatgtggcccctaggcccctgggtatgctcagtctctccaagagcttggagaagactcaggagaaacaactgcccacccagaggggctgcaggagctgggggtccctcggcggcagcattctctgctggggaaggagcttagccatctggagctgcctgtccatgctgggttccctggccttgatcttgattatgttgatagagaagcagaccaccccacaactgggaagcccattccaaggcaaatgggccattccactttcagagctccccaagggggccccggcagctaaagtgaggcctgagcagaacttgctggcttcctctggtcaccagactcctgcagtgcccatatgaggtcaacagtgtggcatgaggcccaaatgatatcaggtaggggttacagggattaaactaggagcccaggggtacacccccagctgcatcctccaagggactatcatcataggcacttctcagtggtcactgcaggctcagaggacagctgctgaagcccactagatgaggccatgtgccatagtctgaatatgtcctctaaaatatatgtgttggaaatataatccccagtgtaatggtgttgggaggtgggcctaatgggaagagtttagggcatgagggctctgccctggtgaaaggattagtgccctataaaagagcttgatggagggagtttggttctttttcatccctctattcctcttgccatgtgaggatgcagtgttcctggccccagaaaatgcagcaaagaggtgccattttggaagcagagagcagccctcaccagacattgaacctgctggtgccctgatcttggatttccagcctccagaacttccaaaaaaatttctatttttttaaataaattacccagtctcaggtatttggttatatcagaacaaacagatgtacacactgtgcttagtgtttaggggcttgagtgtcctgggggacaggccaggtgggggtgatggactggggcagagctttaaaagtgaagcagaactcaggcaggtggagctcatgcacagaattgaggacagtcactgccctggggacatcttctaggtttgctcccggtcaccccctcagtcctgtcctaaggctgggtctgcagggagcccacgcttggagagcagatgctgggcttgcttgtgttgcctttgcttttcccagctcaggggcctgggctcacactcttgcagtaggagagattcaaggacccaagggtacactttttctgtgggtgaatggagagggagagagggaaggtgtgtgtgtgtgtggaaggagagagagagagagagaaagaggttctcagagcctaagcaggagtaggatggcccacggtggagagcatggtagcccagggagtggggtctgtgttagatgtgggctgcccgtggggggagggtgggcttctaacagtcccaatgtgtctgagacgcgtagggccctggggtgacctggcagtatctgttgacctgaaggtcgggacaggaattgctcagcttcttgagggaattcggcacttctctctgtgtccctctgcataacaaatcacccccacacacatattgggatgtttctcagctccggtgaccagctggcctgggctcggcaattcccttgctctacctgaggctgcccaaggctgcctggtggtcatgtgggagccggactggctgagaggctcaggaagtgccatggaaggcacagggtggggttgtgaggctggtcttcgcca

SEQ ID NO: 1355 - DNA, 1302 bp, Homo sapiens
gccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggtgggtttcagggcgctgagaaagccgctggtcggtcggcgaccgtcagggttttccagggtgggaatccgcggggtaggaggggagcgcgggggtccgggcgccagatcccggttggagagccggggtgcaggcgctgagccgggattggagtgtggttggagttggggagccaagggtgtgtgccggtggccggggctggggtctccgccgcgccctccggccggctcccgctcactgcgctggctcctccgcaggatgcagggtgccgggaaagcgctgcatgagttgctgctgtcggcgcagcgtcagggctgcctcactgccggcgtctacgagtcagccaaagtcttgaacgtggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcgaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagctttgaattttacaataaactttttgaaacaaa

SEQ ID NO: 1356 - protein, 141 aa, Homo sapiens
MQGAGKALHELLLSAQRQGCLTAGVYESAKVLNVDPDNVTFCVLAAGEEDEGDIALQIHFTLIQAFCCENDIDIVRVGDVQRLAAIVGAGEEAGAPGDLHCILISNPNEDAWKDPALEKLSLFCEESRSVNDWVPSITLPE

SEQ ID NO: 1357 - DNA, 147443 bp, Mus musculus
  misc_feature (1)...(147443): n = A,T,C or G
gtacgaggtacatacatctgggtgtttgtgtttttgttgaggcaggatcttatgcagctcaggctggcatcaaacttgttatgcagccaactggctggccgtcaactctttatcctccttcctctatttctcaaagtctggaattgcaggcattggacatcatgctgcatgtacaacttgaggaccttgcagccattcaactggaacgatacttgcttccaagtttttcacttacctttactccctggctctgaactactccccaccaccaagtgggatctcagtaattagatgcatcggctccaagctttctaatctgcatgtactctgtggtatgaacttaacccacactaggaatactcaatcgactagaactgtcttgaaggaaggacttttctctctctctctctctctctctctctctgtagatataaaatctatggaactatgaaaatagaagaacaaaagtaccatagacatctgccagtttttttcctattactacttgtatgtctcttccatcaccaactcttgccctgcctacttattgggcctatggtatttctggtgaaatcttagatgcctcaggtgatcttacagctactggcaagaataaaagtcctgaacaggtaatgtgctcgccactgtacagtggaggaccctgaaagcacaggatgttcctgtgctttgcatgaggctaaatcacccagtgaaggacatgggtaacctcaggtatggttgatgtcagcattcacagctaactattccagttaactgtttcctcctcaagtctaatcagtttcccacagcatccacaatgcataccctgcctgaagcactgctgatgtttttggtgaggcctgttgatcaatttcctacagcattgtagttcaattttccagaatggattgaaattctcttttcatggtaaactctctaagagaaggtgatagtatatataggttggcaacttgacaagatctagaatcatctagcaaaagagtctctggccatggctatgtaggagtgtatagagtagattagcctctggatatgcctctaatggattttcttgattgggttgaggtaagaaagtccatactaactgtgggcagcaccttttcatgggtaaggcctagactgaagagaaggagaaaggaaaagaaattgccatctagccctctttgcttcctgactgtggagcagtgtaaccaactgccttgagttcatatgacttccttgtgttgttggattgtacccataagctgggagctaaaataaaccctttctccctgaagtcaagagcagaccttgcttttgtcaagctattagtgggttagcctttactgtgtattactttcatctcatctttttctgataatcttatttctgaactagatttttaaaaaattattttaattttgtatgtatggaggagttgcctgcatgtatatctgtgcacctgagtgcttagtgccagaggcagttggaagacagtgtcagactccctggaacccgagttacagttgtgagccaccatattaggggaaggagtcaaacctgggtcccccagaagggcaagcagttaaggcatctctccagcccctgaaccagcttcttactgaggcagtaactgatacttccaggtagctctgcaccatgggccttgcctactgtacatttaaagtatagaaacaattttaaagagtaggtaaagctgggacagcaagatgggttcagcaggtaaaggtgcatgctggatgagccaaatgacctgagttccatttctgggctacacagaaaggtggaaggagagaaccaacttcatagagttgttctgttacctgcacatatgcacacacacatgtattaagtttatacataatactaataagaaagaaaataaagtcaagtcattaaatttaaatgacttaaattttatacatctaatgatatatatttaatatagtaatacatgtacagttactgaaatacatagtcttaattaaactacacgcatttgttttaacctttcttgacattacttatctgctacttactagttatttatactcctcccacctctcaacctgtaactaaatagtagactgctggttagagattgctgtaatattaaaacaagacaggaagtggtttcattggtagcaaggttatgtatttttctttctacttgattaaattctcaacttcttacaaagttatagacacaggtagcagttacccaacaattttacttgatttacaaagagatgtggcagtgcaaaaatagttcaggtatgagttgcttgctcattttgagattgtgacagggtataaatacccacatctaaccaagacgggactggttgagtaaaccgtggttcatgcatgtagtaaagtatgcagagacataaaaaagaatgaccaaaggcctgagagggagcaaccacccatacatttaggtgtagaaagcgatgtagagagcagtatacatggtattcaatgttttcacctatgaaattgagaaaaataagaaaagatggattcttattttgcaaaacgaaggttgcaagaagagatactggaagatatacaacaaactaataagacatggcttcctaaagaagaattgtggtacattcctttcatcccagtatgtaggaaacagacataggccgatctctgtgagttcaaggccagcaggggctacccagcaagacctttcacacacacataaaaatctgtatatcataagacactgtagctcaggtttttaaatttatataaggtagatccactaaaataaacacattacctacattttctaaaagtgtttgctgtgtgtttcaagcctaaggtctacagatacactttctcttcctggtgacatcacctgttggtgggatctagactaacagttctcaggaataaaacctcatttgtaataaaggttctagaaggtggattgactgattagaactttgtgagtacagagattagaatgttgcagactcagagccaaactatcttgggctattacagcctcttttagccaggcatggtggcgcacgcctttgatcccagcactcgggaggcagaggcaggcagatttctgagtttgaggccagcctggtctacaaagtgagttccacgatagccagggctatacagagaaactctgtctcgaaaaatttaaaaaaaaaaaaaaagagtccactgtcatgctctgtatgaactaacaccctgtgactaatacaggaaaccttctggaatcatgactagaccactggaatccactaacctcagataagaatgtcaccagatctattatctaagacatgtagatttccccacttctctgtaacctgcctacctgatatttccatcaatatatttgaaaattcctcatgactttcctttgttcttgtaactgtgaaaatttcacagaactgtttctactttggaacatggtttttaaggcaatctgaacccatgtatttgggccatgatcactaatatttggcttaagaataaacttacttctatttctttcatagcgggtgttgatttatgctgactaagctgtatgctgatctttcagggcttgcttttgtgccttcctccttattcatggagattactgttttcagcctgcctccacttttatattttcatttagtattgctatgtaattggagcacaggaaatgttgataggcgtgaacttactgtggaaatgaaaatcttttgctttcatcttgaccctaatattgaaaagcctttaaaaatctcttcctgctttaaaaaacacagaattaataagcatttcttagcagataaaatattaaaaatggccccagtacttgggaggcagaagcaggtagatcttacgtgttccaggccagcctggtctacataatgagttccaggacaatcagagctacataaagaaaccctgtcaaaaaccaagaaacaaaccaaacaaaacatcccttaaaaccgcatctctaaattttgactctcaatacaaaatgtgatatttcatagaattttaaatgtcatagattgtcagataccattaaaatgttgccaactatcaaaatacattttaaaattaagccccttctgagattcatcttgattttaaaaatactgatatgtggaaaatgtatatttagagcacataaaattcagacaactatgttgacttagaagattaaaaggttgaattaagctgggtagtggtggcgcacgtctttatttccaccacttgggaggcagaggcagacggatttctgagttcgaggccaacctggtctacagagtgagttccaggaaacccaggactatacagagaaaccctgtctcaaacaacaacaacaacaacaaaaggttgaattaaatgtgcactattatcaggatattccaaaactcctcaaattctgtctagagcaatgccaaatatatgttttccagtgctgcatatgaataaagactatgtacgtgtattggacagttactataatatagatggaattgtgcaagaaaatatgttttaaaaatgtttagcataggtaatgctctggctcttcagtcttactctagtgaaagagatgcatgtaacatctttgacaataagaaaggacccagcttcaggaagataacagttgaaattgtggggatggataatgacatcaaacaggcttgcaacatacagagagataaaggcatgtccttggagagtacctatattagatgggaagaagaggaggatctagtgaggaaaatcaagatgtggttagagagataagaagagaaattggagagcaatttgtcattgaggccagaggcagggatggattttacggagaaaggagtgatcagcattgtcaaattgctgagagatgggccaagatgagggctgaggatgtcatcagatttggcagttaggaggtcatcagtaacttccaataaaggggttccaggaaaatgactggagcagatctagattgtagtgagttgatgagtaaatgcagggagagtttatcttaaaaaaaaaaaagtttctgaggaaggataggaagaggcagggaaaaggaggaagggcaaaactgaaaccaccagagcagggaacaggcacctcagtgcatgcaaacaagggaaagagtcactgcacacaggaggaggagggcaggctggggagccaggtggaagccaaggccggaggaagcaggtctgagaacacaaagaagcatgggggagaggacgtgagatcgggcaatccttgcttcaattcctatctcccacttcactgagtgaatttaggtgtgctacttggcctctgcccttcactgttcaaaaagaatcctcagaagacaggcactccaaaaatacccctacagtaaatatgatgcatttctaagaggttttcttaggattgtaatgcaggctgatgacataagtccaaagagcagttctaggaaagaattttacaaggggacaaaatgatgaatcttaagatcatggctttctgacagtttggcttttaagagtatccaaaggtgaagtagcaaatggatttcatgttgcatgccaatgctgatgagatgccagtggctgcctgaagcactggttggaaaaaaatgtgtttgagcaagagtctaatctcagtttaagaaaggggttgtggattaaagttagccagaggcttggaaaagatagtagcaagagcagtattgtatgtttgctgaccctgaactagagggaaaaatggctatgtctctatcagacagctctccataaatgctattgagctttttgatgagtattgaattgtaaagatctcagtgtacattctttgagaagtagaaagtctacattgtacattaagggtagaacataaattctatcagtcagctacaggcggtataggcttaccatccttttatgaatgctacgatatttggcttaagacatattcattgacttaagagaatggcttttcatgttgaataaggagatccactgaaataaatgttcaaggcaggcttaggatctttcttggaatagcttctgaatgctctgtaaacacagcaaaagggagacgaggaccccaatgattcatagctaatggccataatcactttatcttgaaacctccacagcatcttcaaacatggaacagcctggtggagtcttttcaggcagtaaatcccatacatatatatgaagtagtattaccatgtttccaaatatatctcatctgtgctccaatataggtaaagcagagccattctggtaaagaggaggtagagatattgttttctaaaaatctgaccttaagctaaccctgagagtggcacataacatagtttgcaaacctctgccataaaagagttatcaaattgtacccatagaacgtcaagcaaattattccattctattagaatgttaacttcatgaacagatgaaatatttataaaaatgattattttatcttagtcactcaaacctatcattaaaacgtatttcccaaagtcttcactgcttagcccttaacaagcatgtgtggcagtatggagagttaaggtctatttaaggaacacagcgccactctttgtctcatgatcccttctccccgtggaggcaagatcaagtctgcttattcctaacaacatattgtatcatgggaacaatggcacctcacggaccaagaatgatgaaggaattttgatcctcattcatgtatttaggaagcaaggaaggaaaaggaaggcattttctttaagaaagaccacaaaactccaatttagttacatgaccatacctattcacaaatcaaaacattatttgtcaataaaagacatggcctgatccatagcagatccatagcagaatggttaagatggtctcttgcttatgtttgaacttcagttgcatcgtttaaggatagtgtgacgctggacaatctttatgcttcaatacctccatcctggaaaactaagataatagacttcatgccttccaaggtccacatggataaaagaggttgctacctttaagtgtgctagactcaaaacactatctcaggtatttccttatactcagcaactagtaaagatcatggtaacatcatatttttgaatgatctcatcagtttaaaaaaaacccttatataattttatttgcttttaaaaaatccaataatcatttatgtgtcacaggattttccctgtccaattacattagtgcagaggcctgtgaccagacagggaaagggaaggcggagctaagagttgagagacagagaggtctcaggaggagggagaaggaaaatggaggccaaagtggtgttatcaaaaggttagaatatttgggttaaagttttatcattatcaattggccctgagattatttactggcatcttgtaaattgtgatattattgatacataaatctaattggttaacttaaggcttaagagtcattattttgccgggttactgggtattgtgttatcaaactttgaggatgggggacctatttggttaatggagtgccggttacaggggattgtggccgagagggaactagtggtggcaggagtttgagagcgtggtctgacagttgtcgggtttattttttaatacctttcaaaacacttataagcatctactaaagccaagagttgggctaagcactggggacacagatgcaaacataaatactgccattatggaaaagactgatacagactattttaaacttttcccaccctacacatagaattattctttaactaattctctccacacctacttcctttgatggaaatgaaacaatgcagaatgaatagtgtatccaccaggttcagtgacttgaacgaaggtcatattcatttaatttttgaaccaaagagcaaactaagactaaataggaagaaaataggttagtggtgatgacttcaaatttgtacctgccaggaatagtgttgtttacttcactttaaattatattccaagatttcccttatagtaatataattttgtcatatttccagatattaattgtaacatggttcaaatttgcatttcctttactgtgctggtttgtgtattttgaaataattatagggtggaccaattatttggtttaagcagtcatgtgcacaccctaaggcttaattacttcgaataaatcaatctcacctcaaatcactagctgtaacagacagacagttttaggtgtacttgtgcagagtaaagaattcaacaagcaacctcgggctcacaatgaaaactttaaccgctaaaataattgcttccaggtagggatctgtttatttagggtgtttagggctgtgtgtgtgtgtgtgtgtgtgtgtgtgcagaacctgcagttttacccagttgaaacttaggaatacccctctcaaggacagcctaggacctatttattcttaccacacagtatttttgtttttatccttagaatttttttaggaaaatcttgggacttgtcaagagattagtaaaatagatttgggtcttcatccaggccttttttttttttttttttttttttttttttgggcaaaaaaggagcaatctgggcaatattttggctaattacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgccccccgcgatcgtatttactgaacgacagagcaaagagaattcgtaaccgttggcgctattgccaacttgcatggttttaatcaggtcagtttacaattagcctttaaaaggtgctccagaagaaaaaaaaaaaaaaaagaaaaaagaatccctacgcagatggggtctgtttgtttcgcacgggtgggcgcgtgcaagggcgtccgggcgactcggacggccgctcccacagaggctgggccgggcacgcgcgacaagtggaggcgactctttgcctggctaattagagccgccaggacacgcccccaggagtccgcccgccggccccgccccgaatctgcggcgtgggctgaggcgcggggcggggattagctcggattcaaatttaaagcgggacgtccgcgcgtggcccagcaggtgcctcgtgcccgttgcccgccgagggcgtttccgcccccacctgcacacagggccggaaattacctcggcggggagcggtcccctccattgtcgcagtcaactgcgagggagtcctgaaaaagtgcgcggccgtggagcgctcgctagtccctcacgcgtgtcctcgcggcgagacgccgggcatgttgcccttttacagtaccgccgtggaaaccccgaacttatccgggaggggactaacacggaagacgggaagcccatcccgagacgtaaacaagcacttgacatactacactttggggtgaagccgcgctcccggggggagggagggggcgaagagacgcgcatgcgcttcctacctctccggcgcgtggagaaaactgcgcgtgcgcacagcggcgcggacgggagggggaaagaaaaaaaaaacaaacaaggaagagatgattggcaggttagggggcactttagaagcctgagggggcggggtccctgcagcctggacgcgcgtgcgcgccgcgcgcgcaggggggtggagctcttccaagggggccggcggagagcagcgccggcctcgggcgccccctggcgcgcgcctcgggagaggaaggaacgggagggtgcggagaggagggaggcggcgagcagggcgggagggggaggggagcgggagcgagggagggtttatcgaccgggcgattttggttaaaatattcaaaatggcggacggaggagcagcgagtcaagatgagagttcagccgcggcggcagcagcagcaggtaatcattacagcattttacatattcatattcatactcgagccgggctcccgctgccccccccgcgacttagcataatttattagtactcaggattattataattaacggcgaggagatggggggccggggaacacagccccctctgggcgccgagcggagggggaaaaggagctcggagcggccgggcggagggggaagaagacccggggcaaagggggctgtgagccaccgcgctcctcctgcccccggcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccacgcgctggtagccttggggaccctctcgctctgaggcctcggagctctcggaggtcacccgagaactggaccgtaaaggattgccctcctgccctcaaagggctggcctgacaagttgatcatattctagatttctcctgtactgcggggagcgggggtggtggctagacacggagatccccctccctgactgtgtgtggtagtgctttctagctgcgtgctgggtcttctctacttgcttctcatttgaataatgtctaattcagggaggtttatattcttgaaatggccgcctggctttccccgcctctcatgtttagtaattcagacctttaataacagccactcacagcccaacgccgtgtttatattttacattcgccccatgtgcttttgtggttcgatatgattctttttttttttttttccttctcctcctccttggcaatccacaggactctgagatcaaacccagtctgtgctgggaagacaaggagagaactaggcctggactgccctagttgcctaggccctgttctctgctgcttgatttatttactaataaccaaaatgactcccccatcaactgccactcgagtcccctcctccgcaggcaaaacacatcctcttggggaccttccagcataaaaacagctccgagctaagcatcagctctgaggttggcttgttttcttctaaaaggagtttatctttcagttcatagtatgtggaccttatttccaatttacagaggcttctgtgagctactggtttagtacaaatacaggactttgttgtgggaatagtcactctcttcctgagttaactcgttcaggctatgtaaagatttgtagtatttgtaaaaccggcagacttccctttcaggagtgatggagtagcgaggtattttagaaagtccggctgacaacacttggatactctctcagcagggctgcttttccagtttctgcaccaacttgaagggaggccggcattcttgtgctgttactgacatagacctgcctgttttaattgcagcagtatggaaaacagaaatggggttatgttttccttggtcatggttaaatgagtgaaaatagaagataaacagaggcattgtgtccactctgatcttggaacttgcttagcctgctggcctcttgctttaaggtgtcagaattgatttttgttttttctaggcttaggacatttggcctatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagcagtaatatggtttcatgccttaaatagcatatgtttttgcacccagttcccaagaagtggtcagactgatgatgtcattggacagaggacaaggtgcagttactgtgatttattgtcctgaggtgaagtatagcaatggaacttctccatagggaaaccatttatctctggacaatttcctttatagctgcagtttaaccactactggggctctaggtattttatccaaaaggataaaatgcacactgtactttacaaacaaagctcactgttacagtttttgtcatacagaaaaaaatatgggtattgtgagctggccttttatttcagttggctgtccttgccatagtaaaaaaatcacttccgatggggagtttggatttaaatgaggatacttgtgctacatacacctgcttattttatgtggggtttgttgttattgctgtttataatctttctcttacaagaaactacttctgaatcccagtatggcccaggcttgtggagtgttctggagcctattttaatgactaaaacggagttgaagaaaatgagggcactatatttttatgttaaaattatagtatttaaaataatgtaaaacacttatggggaggcttgtgctttgaagtagcttttaaagaatctagaattctttttggatttgtctgcacatgtttgtacatttactgtgaatggtgttttaaaaatctcctttcaaagtagtgatttgcatacacagtttttgacattaatttttgtaagcatttcttctgtttcttaatgggcatcttaaagacatggttaagattgggccgtgactgggaaggccgccgactcttggagctgatgcattaggtgcgctcagctcactcagtgctcaggtcattctgcagctcggcagcctccaacctgccaggctcctgttgaagttgtcagacaacttcctagtacaagtttctagaaaatcggctgctactttcttgagttgccccacccattaattataatgggatttctgaattaaggtctttgacattcatgacagctgaccaaatgttcttcatttctgaaggatttatgtttccaagtgtttactgtaaaagtaacttttagcctcttcccccccatttcacttttgatttatttttgttggggaaaaaagccacaagtcaaggaaagcacaaacagtggttgttcagttgtaacggtgtaatgcttttgttcctattttaaatctgttattctctatatcagtcggcactagatagccaaagaaagaaaattgtttcagtgctgccctactttgacctaattgctaatcacttgatcagttgcctttgagtgagtttagggctcagaatgccaacctacctttaccaggtcaccaaagatatgtaatagagtcctgaatagcacaggcaagtgctttaaaatgatggaactgagaatactttcttaaatgtatttcatttaagaatgaaatatttgaattgtttcttgaatctgtgttgcttgatcttgacatgtagaagtgtgggaattaaatgaagaatttcctttgcactgagaagactctatgtagtcttgtgtaggggcattgctttgctcttcttcttcttcttcctcttcctcctcttattttcagtgttggaaaccacagtcattccatgtttttcctgatggacatgatttcatttggagccattcaagtaacttttgttagagaatagaataaactagaacagataacatacacccagttttggtgataaatgtctggacggacatatcatttgtcatagaaatccaacattaggtgttagagtgaaaattgggacttggctcagtgacatgactctctatttcactttctgtattctccctgagttaatctctgcccccgtggtggctttgcttttatttttggtattgggatttgttatagcccatgctggccttcaattctccacttacttgccttagcctcttgtgagctaaacttcaccccccttttgtaagaaaactctgggtcagaattttaaataattgttttcccaccatgccatctaaatagctctttttaagtggttaaaagaggtaataattatagttcataaagaatagcaatttctttatgcaactttcagaaagtgtatttttgacatcttcattttgtgaatgaggacaattgagctgatttttaaataagtgtggtttattttttacactaacatacttgtgtcttaaactgacagtgagctttttatataagctcttagagtggtaacagcagtggccaggagtcttatcaggtggagccctggcctgactgatcctgtcacagtggatttagaatttaaaggatgagaatggctttgagtttctgaacctttggcttgaagaaacttgttgcatgtgcatgctgcttacaaagactcgtgtcgttactattagtgcttgagtggttgaggactgataggccgtctttatatacttagtgacggctgcagcttatttcttctttaataatttcactcctagcattcgttgttgagtaaattttacaaaactagtaattgagcaaagggagattcaagagttgtttagctgtctaagattctcctttgaaatgctgtctagaaaactgaatatttacttagggaggatatagtgtattaattttttttaaaaaagataaaaaagcaccaaattaagctctgtgaatgcttgcagtagtaataatattgaaagaaaattacaggtatagtttaatttgccacatgatttatttaataattctttgtaactttagtggtttttgttggaatcagaaatagttaatgaaattaattcagcacagtaatacatttagacttttctttcttggtgaactttgttcgaattagaaagtattgacaggaatgtctggaaagtaaacattttgtacatacttgggtttaacatgttaccttaagcagtgcagggcttatggtagctttaagggagtgtgtttcaaagagactcatctaggtgttttccttggtcttgtatgttttaatggtttggctaatgaaaaaattcttttttgctgatttatactatagcaaattattacaatgaatctttaaacataattaacatttcttagcttataaaaatatatctgttgtgtacctcatctaactccattctttcttgtgcgcaacaaaggaggtataagaatgttatagtagggacataatgataatgtcttatttaagcagggaaaatttaaagcaatgtatataattacatattaaaatatgcaacataatgaagattaggaaagaaatcagggtgtgttcacgtttgaattaatcaaaacatcctagaatattatagccggaaggtaatttagctgtaatctatgccaaagcttttgcttccctgtgtgaaaatattcctcagtttttagtgacttgtttaccagccactcagccgttgactagcaggggttgggaggtggctcaactagtaaggtgtttgagctctaattccagcactggggaagtcttggatagaggtggggctagggctattcctgaaacctgctgcaggaagtgggtgagctccaggacaatagaaatcttgtctcaaaaagcaaagagagctacttccaaagatagttgatgtcgatctctggcctccatacgcacacacatcagcagcacacacacatgaaaatgtgtaagcatgtcagaacataggtttctgactttgagtgttgtgctggtttagtgagtaagtgagagacacctgtcctctcctgggaggcaggcggaggactgactgaggactggctatgagcagctgacggtgtgcaggtgatttgaaaagggagaaatcagagtcatagaaacaaggatacagaaaccgaagtgtttggcttatgttaattgctgtacgtgcaatcaagatgcttacaaagtaaagcaattacttgccctccgatcctttgagtctagtagtagagtaatggtacaagccagacatgtcggagatggtaagtccggttgtgcgacacagaagagattctggccctatctttaagtgaggaacttttacttctgagttcacttttactcttgtgaacagagagttgtctacttgctttctttccaaatcaaatacaatgctcatgctcacttagtgacctaagggaagcaagcgcataggcagttgtggtgtacatgttcatttatgttcttgtatatgttttgtgctccttttattgcttccatctttaaagtcttgttttgtgttttatatgggctgtttcctcttaagaaaggcaggtgtaaatacagttaccataatcatgacataatgataatgtctgcatttttatagtgtcttaagttttatagcagcaccctcattttcattacctcagttagccttactgacaagtagtattatgtccattttatagttgagtaaaataaaggcccgataaagtgacttccccaaggtccatgtgttttaataagcactgagcgttgtggagacccaggaggggtaaggccagggttggagctttgtcagtaggagcttcacatctgctgagtgctttactttggttcaaaagttaatttattttgttttctaggcagcaagaagtcagtttgtagttgttttggatagtgcccttattttaaaatgtttcctagccagaatcaaagagtgagttataaagattttgaacttggcttatctgaaggagattagaatcatgaacagagagatgtaaggaggttgggagagggaaaataagggaagaattcagttaaaaatatatttttgtatgtatgtgtgcctacatgaatatatgtgcactatgtgtggctagcagctcatcggaggccagagaagagtcttacacatgggtccctgcaactggagttacaggcatttgtgaattgtcaggtagattgcaggaaaccaacctgggtccttggcaagagcagtaagtgctcttaatctgcagggtcatctccctacgaattaacatttcaaacatacttgacacagtttggggcagatcttatttaggttccttttgaaaattgagaaaaatgtgaattaaataaatatgaatgtgaagggtggtgtctgtgcatgccgtgtgtgtgtgtgtgtgtgtgtgtgtgtgtgtgtgtgtgtgtattgagcattgacatctcattttgactttgccactgacatttgtggttatttctgtcaacaataagatagtgataatgacagtattagaggaattctgtggggaggaacaaattgatagcagaggcatctttaaagtactgtaataatagtttttcttagaggagtaccagaggagttctattagttgtgctgctgtagaggaagagtagtggtagcagctgatgggttctgtgcatctgtgtgctgccagccagtcccctgggaaagaagtgtgtcctttagtacactgaaaacctttgcactggaagtgctgcgttctgtcttttagtggtacctcttcctgtacactatctttttactacttacttattgagcttccaacaaggagtatttttttaatgaagttttgattttagaaaagttgcccttggggagaaggatggctgtattttatcttaagactttcctggttccttctccagatccatcccctatcccagtcctggtgtttgggttgttgggaaagcctgcacacacagcactgcctgtgcctggagtgccgcggaatgtggagcgtagacaggttctaggagttgagatgcttatgttccacatcgcggcctaggtgtgtaattgtgtaattttaggatggtatttaacgggctgaaaacattttgcatgttttaaagtattttaaaatatttgcacattttaagaggagtgtcacactttttggtttatttttattttttgtgatgctagggatgaagcacacagtattactgaagtactgtaccactgagctacattcccagcccaaatttcacacttttaaaagcctctggcacttttatttaaaactcaacagtggggctattctggtctgcctgctatcctctgtgaacagggaggttgggcatttgtccttttctttctgttctggttatggccttagtccttcagcaagacttttaaaagtctttagggctgggatctaggaagcatttccttttgtttatatgaagggtctgtcacctgcttatctttagggacctatctattcatagcttgtcactataaatagcttcttttttgtccgagctcctgtcctactttcaaatcctaatttagtacttaatttgtgttcatttagctaattcagtgcttcactgtagacagtctcattttcttccctaattgattatataagtaaatcttgtcacataagaactgaaactcaaagctgtctgggttgaagaaatgtgtgttgctactgatgcatgtatggtttttttttatattggggggggtgtttgtttttgtttttctattaaaagactcatctgtcttaaaaacaaactatgaaagcaggaaccgtaggcaaccggcagctagcgcttgcctaaggtaatgggttctaattctctaattctaactgggagatgagaaggccgtcacctgaggtcctaacactgctgaagtctgaaaacccctatcttatagaactttacagtgatttgataatttattgcttagagtgtctcaaacaatggttctcagttactgcaccagaaagaatggctgggggtgtagctcagcctactaggatgtaaatgaacagggcataagtattcagtttgagtgtgaacagggagataattaacaaacctgactgatccttctgcctccctccattttgttccttaaatacagttacttttccttggcttgcactggagataaagtaatgttagtgtaaacactacctcaaccctcagagctcatcatgttggagaaatcatgtagtaacaatgttcatagccattcattgataaaagtatgtggggtggtggtaccatgggaatatatgatagatgccgtagtctggaagagctggttaagaaaggctttctgaaagtagtgtctatggtaagacatagaacgggtagggcgtgatcagctcaagggttgttagtaggaggctgaaaattgggaagagggattgaaagtgttctaagtagaaaacaatacatacacacacatgactgaaaataacattttcagtgttttcatggtctttatatattttagtcactgaacctgcagtcaggttttgtgacaatttctataccttctgataaaaatgcattgatttcactagcaatgattgtatctataaagtttttgccacttagtttaccaaatgcaagcaaaaattcacattaatcacgaaaaccctgttggggaatgaaatggcacccctggacttgaggtgacaaacaggccaatgaggatgagtggcataccccagtttcaggtctctcccggtggtgtcaggaagttagtgggaacagagtattcccttgggcattgtcttctgtctcaaacgagttgaggaaggagacatagcaagaattgggggctttctgagtttctgcttgtaaaaggtctgtatttaataatttcatttagtttccagacccagatcctgaggtaggaaaaggtcagtttgaatttttatttttatttttgagggataaggtcttgacataagactgccctgaagcacaacttttagctttgagtctttgtcttgctgtttggtcatggacacctgattaccaaatatagtactaacttagctttcagaaatttccagatgatgactataaagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttgattggttgctatttatcttctgttttatgggggaaactgcctgtttgagagttgagtttgagtaagtgactcttggtatgaatgacttcattctgatttgatctgattcttagggactggtcccaaacaatggcttctcataagttgtgtccaatagaatcatacacatttaaagatgttagtgtcaggaatttggggatggtaccaagtcatgttctctttttttaactttttaaagccaaatctctctatgtagttctggccatcctggaactagcaatgtagaccaggatgctggcctcgaacttacagagatctgcctgccactgcctctggagttcaggaattaaaggccagcactactgtgactggccagatggcttagttacaggatttatcagtgtcagtatctccactctctagcatagttaattattagttttctgaattttttcttggatgatagatgaatatctgagtgttttgatttttgtggttttgctctaagttgtgtgtaataaatttctatttttctgtatattttcaaatgtaaaacattttttattacagaagttttaaccttttcaaagtacttgtagtttcattgaaaagtttttaatttattttcttttgtacatatgtgtgtgtgcatgagtgtaggtatatacatccactctggaaccagaagaaagtgttggatctcctggaccttgtattacaagcaattgtaattaggatggagatggtacatgccctttagacatcttccacaaatacttcttctattcccaggaagtgcagcactactggcatagtaaggatcatcaaggagtcctaccagagtaaacactgactcggaaagtgttcactggtgctcatcattaatggtagaaagttaagattgggcagtcgggtggcatcgaggtggtatcaatacgactgtattggcaggctcatgggcaggcctgattcgcagaaactcaattatttgtcagcatagctgccatacagtatacttgatgaaaggaacagtgcctgtttgtgttaaccttaacctgttatgagaaatataattgtgaagtccactagactttttattcattgtgcaatctattattttgctttagatgaaaaagctaaataacaaccagaggagttccatagtgactcctttaagttgactgttttgaagatcaggatatcctggtcagagttggctagagcacagtgctaggtacattctgaaaattgttctttggcttctttttcttattcttaatgaaatcaaattcccacctaaaaacattccattcatcactgacagcataaagagttgtggttaaaaagtctacttaaaatattttaagtgggcttgagagatggctcagcatttaagagcactggctgttcttccagaggtcctgagttcaattcccagcaacagcacgatggcttacaaccatctgtgatgggatctgatgccctcttctggtgtgtttgaagacagtgacagtgtactcacacatataaaaaaataaatctttaaaagaatattttaagttaaggataaggttactagttatttgcattattttgggccatacaagatggctgaaagagtactgcggggaaacaagacttagtgtgacctgtttcaatctgagctgttctcaccaacaaatattagggaaatatttcttttttcatttctttttgctgtgctatcaaaatgccattaactctcagttataataaatatgaatcttagtgtgtatttttgttgttctagtgcagtgaaagtgcatatgtaaatgtgctagccatttaggcaacaattcaaatgtaattctatctcacactgtaagtacaaatacataatgaactattgtgatggctcaatggttaaaatttagctttgtactcaaatctgatactctcactcccacaccctcttatgttcattctagcaggtgctggaaatgctagaagcaaatgggtagccacctgaaaacaatgtcttctgaaatatgatcactgtaatgcagccatgaaaacgtcttatcatgaaactagagtttaggagcccagaataattgaaattggcattaggtgaaggaccaggtggttgggacagttggcttcttatttggaggggggaaattatgtccatttcacacactgcacacaaattagttgtgaagggattaaaatttaaatgttcaaagggtaacaacagagttgacgaccacaggagcaggagtaagttttacagatcaaaagacttctgacatacaataccccacaggccataaaaagaagagatttagctgtggacaatatttaaggttctctcagattctgcaggtaaaattaacataataaatggtagaaaataattggcttatgaaagattgaggattaatttatgttaatatacaagtactgtttaacattgataggaagtgaaactattaggaggtttggccttgttggagtaggtgtagccttgttgaaggaagtgcatcactgtgggagtgggccttgaagctctgcccagtgtggaagagaccttcctcctagctgccagaagacggtcttctctgggttgccttctgatctctactgcatgaagccatgcttcccaccatgataatagaaacctctgaaactgtaagcagaggcccagttaaatgttgtccttttataagagttgccttggtctcgtcacagcaataaaaacctaactaaggcagtgtataagtaggcatttcacttagaatgataactgaacctcagcacctctatcaagaccctctgtagtgaagaccaaaacctttaggacatatacaaaaggacaaagggccagtgacgcgcatggttcatctgataaagtagggaggcactttttgctcaagcctgagtcccattacatggaaggcaagaactgactccacaaagtgtcctgtcatctccacacgtgtgccacagcacaggcacacctctccagttcacatgcacaagtaatacaatttatttttaaaaaagggatgaaattgaggcatgacttttggtgaaatagtggacaaattaaactattaagggaaagaatagtgctggagggcatgctgggtgtaattcagaggtaattgtatgttttctgcttgtgattttattaaatgacagtcatcattttaaatcacaagatagttaaggagggatttttgccattcctgtttcaatacacgggtcacaaataaatgattataagctgtttaagctggtagagaactgtgcatttcttcatcggtgtttcctaggtacctgtaagcttgctgtcaatttttgtgttcctgtacaaattccttttaaaaagcaaacttcctccatgttttgctatttagtttttgctttgtttataaatacctttaatacacttttgccatgtcctgctgtttgtcttttgcttactttattgccttctctagagttctttaccattattttcatagagatttgtgtagtttagatcttttgctttggatactcttgattctgtatgaaattgttccaggaagtttttacctaggaggtagcagttagcctaactcttgtttcactatttatctctcattggatgatgtcaagcagtaacctaacaaaacatttgttataacttgtttgtgttattgcacacaactccaaattgtctgggatgggggtagttgaaataaccaagtattttgctttaaaagcaaggaatcagaaatgtttattttagttactactgatttgtacatagtgatgtcagtaaaaagtcacttaagcagataaagtagttatgctatttaaaagaatgtgaaggcaacctttgttatagtaagttgacaacatgaatttttgcttggttaatcgacatacaacttcagttattagcttaaggtagactgagtctggataatagaaaatcatgttatgtaatgatatctgtgtatttagttgtttaataatggtagccatattcctttatgcttaaaagtttctttgtttttaaaacttatatcaattaaaacattaatgttagcaccatatttaagattatatgtaatttttattttgtgcacactagaatcttccccctccctctcttttaaagacaggctattactatgtaagtctggctgtcctcgaactcagtatagagaccaggctggccttgaactcacagagatccacctacctgcctctgttccccaaagtgctgggattaaaggtgtgcaccaccatgcctagcttagttttgttaagttctttagtcccctgaaagtattcctggcatataaaatgaagcaaagtgttcgttttatgcctcattttgcatataggctagctcatgtgataatgtgtacatatttactattttctctggggagttttaagattgactgccttctttatgacatgcctcatgtgtttgtatcctaaccactacaaacatgttaagctagtagatagctatctcagcagtcacaacacaatagttttttgttctgccgtgcatatctatgcatagctgatggttagaatcacctgctcagagcatgtttgtgcatgttctttatagtattgccagtttccttctcattctttctgtgagaatcctaagtatagagcacttcagagagcttaaaatcctctctgaatagggtaggaacagtgtgagaatctttgccactaaaggatagacataaaaggaagacacagatcattgtggtgaggaatctgcacatggttttgttgggtcctctatgttaagccttttaaaaggctgcaatgctttggcccaaactatagtcttatctgaaggttcagatgggagggagcttgccgagcttgctcacatgattgttgatggatggagttctccttactgttgcacttaagacctcagtttcttcttatctagtacttggttgatcagaaactgccctccctcccttcctttgtggtttctacagctttcttccttagagtaggccttgaaggagccaaagagaatgctagcaaggaaagaacgttagcaagattgaaaccattgtcttgtaactgagtcaaggtaggttaggaagactcaactccttctaagaggacatttccctctcagatggtatttgggtgaggactaagtactgggtgacatttttctgagaacaagacttaattttttggttagtcttcatagctagcacccctcaacgtacatatatatttttgatgacaaaaattgtcaggcacagatatttcaactacttgattgacagttgtcagacctttctttctcccacactgacctacttgtggcctttatctctgttagagaaggctgagtccaaaatacaaagagccagcaactcagccttcgctgtcatagtcagtagcagtgagcagtacaggagagagatagtagaaggctggggcgtggagcgtgaacagctgagattaaagagggtaaaggacagcagagagtggggtgtttgaaaaggtgcaagctctgtctaactgctggcagaattccagaacacttctaagagctctggcttcttaggatccataataataagagctaagggtccaaacacttgaagcttggaagtgtaacactagtccttcagtactagctcacaagaacttaaaagtgcagaggtgtcacactgaaagcagaccgtctggatatccaaggctcaagagttactaacattaaacaagtgttactttgcttctgcattcttttcatctatcaaagaatcctcacttgatcattaacataatttcctaagtagtatgttcccttctgccatgttattagaagcatattacttgatccatttcacactcaagagcaagcagtaatacttggagtcaggtatcagtggaggccattttagaaatctaccaacaccttgcagtaatttttaggatcctaaaagggtcctgaaacccaaaaattagttgttttcaagctgaagagttggcaggtcggttaagaaaacttgctgctcttatagaggatcttggttcaattcccagcacttacatggctgctcaagcatctgtaactctagttctagttgatccactggcttctctgacttcccagggtaccaggtacacatggggtacacatagaagcaaatccatgcttaacacataagtaacaaaataaataagtctaaaaattgtttaaagttgttctctagggcttggtttggggccttggaaacttgcatgtggggtaggggtgtgaagttgacatgagagtctcccctttatggacttcattttctcaaaggaaagatcttaatagtaccgtgactgtcgcatagcaacatcttctatgtagtagcacaagcgtaaagagtgatgagggttagcaaagcaaacgccgctgaggcttctgttacagtcttcaaagtgccatgtcgttcacgaaaaggagaccgtgttggtgtggtacttggttgctgagtgatagaattctgttgagtggtaagttatgttaccttcctgattgcttagcttcttgtgcaccttttcaaaggattccagaggccatgcaatacgctagacagaagagaggaactagtctgagttttgttattgtctccttcagtgatcttagtcttttgtttgttgtttgtttttagagatggggtctcatgctgtagtctagacagtcctcaacttgccaaaatcctcctgcttccccagtgctgggattacagatgttagccacaacttctggctctggttatgatttgtcagtataaaatttgtctgtaaactagaattgtggattacataatgaagagggctctgaatgccttcttggagcattttggtttattgcttgtttgtttttgatagcttggtttcaaatgggaagaaaatgaatgcctaaaactatgataatggtaaccgaaggcaaatgtttggaacaatggcatgacttgtctagtctagaccacagtgctagggattggaggagatgaacattaaactcaggttgtctggtttcagagttaggacttttactatgctaggagctacgcttgggttatgctggagataagcattccaaagagctctccatttttttttttttttgtattactaaaactaggacaggttgacgccgttgagctttttcctcccacctctagaatttcttacattttccatcattttctcacctctacccattcatttgtttccagcacttttaagtttctgcacactcaagcttctcttttatgttccttctagataccagctttctccagtcccatctgtagactctatttacctgtaatgcacctcctcaaacctgttgaaatcgaggttttaaagacacacattgagaaaacttaacaggtgctattggcctataccttctatttttatttttcctgggaggcaaaggtgtagaaagaacagtgaagaagaaacagaagattccagaattctgggcattattaatatatgcagttcaacaagatgtaattaaaagggaagtgaagtgaggagtaagttgtctgcacaggaagggaggtgtgaagggctaaaaggctggggttgcagttgaagagttcaaagttttaaaggaggtgatgacaaacaaggtataagatttgtgatagatttaaaacaaaagatagttatagagttagagatgatgacctacctagagcaacagtggccttttgtgtgcagtactatgaaccgcctgacagcataagctggaagactcttttgttatccttgtcccttgtttagaatcagataaggagataatcattttattagcaggggatatgttaattttgtaattgacatttgcaaactaccggaaagtagcaccatgtgtgatgaaattctttgtgttgtcttttgaggatatttttgagcactgtattttatgttagcagtgttttgaccttttctgtcattttgagctttttttttttttctgaccaacaaagaagagaaaagggtatgagagaaagaacaaattaatagatatctgtctcagaatgttaaagatatgctggtggtttggtggagaaatgtctgccatggatgacactgaaacaaagctgtaatcatgatgtgggatatattgcttgtcctttgtttgtttgattgatttttgctgttttaatcatgtatagttaagttataggtacttcttaggttttagattgtgaggtttaaatttgggataaagtggaaagtaaagctttgtagcattttattcttgatgtcactgcaagaatatgaaagggaaaatgcaatctcattttcagaaactgggtgtattggtaacattcacctaggtgaaatggagctgatatgcacaaatgacagctgaaccttgaggctcagggacatatccttaagagatgcactagttagggtttctcttgctgtggagagataccatgaccaaggtaactcgtagaaaggacagtgtttaattggggctgacttacagggtcagttattttattagtccattatcatcatggtaggaagcagggcagcatgagggcagacattatgctggagaaggatctgcaggctggcctggcttgagcatttgaaacctcaaagtccaccctcagtgatacacttcctccaacaaagtcatacctcctgctaatgacacttcctggtgtccaagcttctaaacctgtgagcctgtgggtaccattcttattgaaacaaccacaagagactatctgaagaagccatgtgctttccaaagtgctctgcaaattctcattcctaaccagcttttcatgttgaagatattcatgcaagaatcattaagtaagttttgtaagggagtctaagacctcaaatctgactttgatgttcattttttctctactggaaaagagaaccagctctgtattaaactctgttcttgatcatttaagaatacaaaccaaattaatatattctgattagttatggttaagttctagcctttattttatttggttttctatataaattcttaagtaaagaatatccataatcgagccacaaatggcaagataaaccaaataattctgtttgatagaaaaggttttaaaaagttacttaaaattgtaaccgaattcaatgtttcttataacaaattaatatggacaactaacttatgcctattatttgagccaggtcttgctatgaagctcaggctgtccttggattccctatagagcccaggtaggccttgacctcgagatactcacaccttagactcggagtactgggattaaaagtatcaccaacatacctagctaatttgtgacttgataaaaagtgtatttctctaaagtgatatttctgttcctcctattgcaaaggctacagtagctggcattttgccaggtttgttccattaactgatttgtttacatttaattccggttcattaaggtgtatattttaaagtaagttgacccattgcaaacttaatgatcaatttgctaatgggactaaaaccagggagacttgatttttcaagaaacaagaggataagaatttctgtagttcttatgtgtaatcggttgaattgttttattctcatcagttcaggagcgagaaacctttcagcctctaaattctgtactgatttattaagtagctcttgtaaaataagacactctctcgtcctgacctattgtattctttctttctttttttttttcttgagtttgaattagaactaagttaagtttgtgttcatagctcatcagaggggaaggtcattgtggtggtcagttccttccctccctgctgtcatctttgccatccttctttttgaatctggtgtcagatgtgcctgcttctgtaggcaaaatagtagaggtgttggctgatgggaaattttccatttttgctgtgcttcctttgcttttgatcctttctcccctttgcttttctaaagcatcaaaggggaggaaggaaaaacaaaatcaaaaaccttttaaaaaatccatgttctgagctgtatctaggcagttttatacattttgtttgtttgtttgtttgtttttacaagaatgcagagtagcttttttttttttctggtgtggttgggtcctttaacagaatataccagatgcctgaataatgtatattaaattacttaaataacacacttcacttctgaaagcctgttcgcacattacttggtttttaaagaagaaaagttttaatgctttttgaaattaggaaaacaccttggtattgttttaatagtttgtataagattagattattaatctgatttaaagattatgatggagggttgaggaagttagcttagttactgttttacttgcctagaatatacaaggtgttggggttaatccccagcaaaaaggtggcacacaccaggaatctcagactggggaagtggcaacaggaaggtcagacagacattcagggtcatcattggctacatattgagtttaaggccagcttgaactgtgtgtgacaccatctcttaaataaagattatgatggaatacaaatgaaatatgtggcagtatcagttatgttgaatataagcctggcttttgttccagtgtgctttagttgctacatacgagttcatttctgaactttgccaagggcagtcctggttacgccagtcaaacactagtcaattagtgtttggttctgaaggtggataggaaatagctgatttcccccccttttgtgattttgagaatctctgtggccagcgctagccttgagttgactatcctcctgctaggtttctgcagtgctgggttctagagttgcattactaatccactttgcgttggatgtggatgtggggtcattgtgtttctttgtgatagttcctgggctttacataggtcttgattcttccgcatagaacatttctgcagaaggcagtattacttctgagctggtaagaagccacaagtgtcttattgtcgtaaccatagaaaacctgcaagctaattggaatgcttacccctggtttcagcagttgatcatggtgttcagttcttggtcatcaatttcagttcttaatttagggaattttcagcttccaattccttatctagtgaagaatatttttattaggtagaatgtccagaaaatgagtatgatagttcactttttccatcatgtgatgtgtgtacatgtctgcaaatccataattatttgattgcctttaagcagattatggttgtttagtgtttttgcctaagaggggaggtactatcagcttcttgacagtacacgtgtcttagctccagtttaggaccccgggttagtgcggttggtgtggtacaaaattgagcttctgtaatcaagtaattttaatgtacttttgtttctcagtactgtaagaataagacaaatctgtaaatatgtcaattagcgattctttgagaaatcactgtatatttctaagttctccctcattcaaaattgtttcttagttttagttacccattgttaactttgatctaacactattacatggaaaactctatgaacaacttacgcattttgagttagatgctgcctgagttacatggtgaaattttatacaacactttgtcctgtcctgcccaggttgagagcctattcttgttatgtatgctgctcatatattagacagttagtagctgctttggttgctagattgactatcagggtcctctagtccttgtatccaagtgatttttttttttaatttaataatggacccagatacagactagtaatactggcacctgggatatgcctgagagagttgcagagtgtttcctttaaatgaaaacatagaagttatccacttaagaaaaagaaaaaaaaaactgtagtacaataaaattatttttgagagaccatgttcacatatttttacagttatagttgttctatattactgtatgcctaatttataaattaaaaattataataggtttgtgttgataaggaaaaagccagcttatgcaagctcactattgtcttttggcctgctggagatcctcgaacctcttttctgccagcaagtgagaactacaacactgacattttaaagggtagtccttagagaataaggtccttgtagagagctcaagatttcataaaagtagaaagatcttatagctcaaccttattcttctgggtgacttaatagaaactcccttaaatccagagataaataggaaacagatatcctaattttggaaattgcaagtgaaactacaggaaagagatggtagcagataggatgctctgtgaacatggagagtgaaattagatttgaacttcagaacagataacaggtaacagaataatagagcatgcattgtagtgatacaaaactgcaggcaggaaggctactggaacatcttcagaataatccatgtgtcttagggtttctattgctgagacaaacaccacgaccaaaaagaaagttgggggaggaaagggtttatttagtggcttaaactttcagatcatagtccatcacaggaggaagttagaacaggaactcaagcttggctggaacctggaggcaggagctgatgcagaggccatggaagagtgctacttaactggcttgctcctaatgacttgctcagtctgctttcttatagaacgcaggactatcagcctatggatagcaccacccacagtgggctggttcctcccccactgatcactaattgagaaaatcccttcagctggatcttatggaggctgttcctgatctgagggtactttctctgatgactctgtcaagttgacacacaaaaccagctagtacaccatgtgagtgatacagagtcagggtagagcacctaaccagcatgttcaaagtctgggtttgcttgccaaggcttgggcttgggggtgacaagacccagattaagagagtcctagttggagggtgggaaagagggtttggggaaggaaggtagaataatatcaagggacggattagttcttaggaagaagaatatcagtgttttccacttcaaagaacttctatctccaagtttgctccaaaccaagtgggcaatgcagctcagatttcaggttcaggtttacctgaagtcactcagttggttcagactggatttgctactcagataaagccatcactgcttgctagaagatggaatggtctttattttacttggactggtgtgatgtgattatctgctcaccatgggaaaccagaaaacgtgagagtaaagatagaaggcacatgggatcaggtcctggcaggatttcttgagcatttaaactgtattatgctttacataaactgtgagtttcctagtttgttttgtttcatttgtattgagtttttcagtacttaaaaaatgattagcaccacagctgaaaataaaaacgataaagttgttaaaactagagaacaaatggtgggaataggtttagctgaatcaaagaaaccttgagttctaagttaagaaggagggtcagtgacttgcattaatgtgagaagcagcaccggagaccagctctcagatcttacacttggctcagtgttgtttgtactgtatgatagcactcatctccactgaaaagttaagaaatggtagtcttaggatgaactgtgttggcactttttaaaactatttttttggggggagtgttcttatatttctgcttctaactctcttccagccctattctaccccaatcctttccaacccccagcactaggtaggagagaaagaagagggtaaaggggacgaagacctcttttgactgctttctgctggttaggggcgttgaatttcttggagccagtccaatcttggtcatcaggatatctccaacaacttcttgtcgaaccacagcaacaacagtcaggagcagccgtcaccacagggccctccctccctcaagggactctcacatttgtttttcctctctagagtgtctagattaaaaactgtctgcagctggcaaaagcccatgccctcctagagcatgagccagtcataggcagcagctgggaacagactgaaccagccccatagcccacacccggggctaaaacagaagcattcacctagtataactgtttgtttgtttgtttgttttaaagaaaccaaaattctcactatggaaccagttgtggataaagggagagtgtgtgcacaagaaagagcacgagcatatgtgtgtatggaaacactttgatatagccatgcaatgactatcttcttgtgaaaatcctgagtgaatacctattgatgtattagatctgggtacactggttatagctacacaaatctttgagacacttgtaattttggttgctttagggggaaagatacttagaaagcagtaaaatactgcctgaatgtggcagtcccttttcactctctggatgtgcttgtgaaaaatgtctcccagaacctttaattttgttcctaaatttataacagagcaatttcttgatgctcagggtgcttttggtgataagatttttattaagttgggtaggtgagttgtagaccatgtcctccagggaatcatttattgttttgttcgaggataggtagtattgaggagtcatgtctcatttttgggcatcaagtagtctcttgcttgaaaatctgacattggcactattttttttttcatttgaactgaaaaaccagtgcttgtttgagcataagcaagataacttaaaaaacaacttatttttaaagcattgcctctatttttgctctgtaaaaaaataaaaacaagaagacaatagaaacatatacttgtgtccaaatgtcaggaactgcatgcgattctttcctttaggaaagtgtctgtcttttgagcactaacattgatttccaattgaaactggtagaaatagaccagacttagaatatatgtgtgtgtgtatacgctcactctcgcgtgtgcacacacacacacacacacacacacacacatatatacacacacacacacgtatacccacatatatgtacacgtatatatgtgtgtgtgtatagtagcttcagatttaaaggaaattgctgagaggggaaataagcctttgttaaaaacactggaaccaaaataacattgggaaaaatgggaaatagagtgattgctttgtaggaaatagtaagggctctattcagacaagactgcctgtcggtggcatttattaaccctgattgatacaccaggttatgtgcttagctgcttagctaattaggtgtgtcaggatacacatgttttatagggtaagaatctggaggtttcagtagagcagctcgtcaaagcttctgaggctaagctctaggtctgacagttgaggtctgagcataggaaagctgatttgtgtcccagcagttattgagtgagctgtactcttcctccagatgtgattctaaaatgccattttctgttttctcttttctattttttggtatttttgagacagtttctcagtgtagccctggcttttctggaactcactctgtagaccaggctgaactcacagagatcctccttcctccgcctcctgaattatgggatcaaaggtgtgcatcactactcctggagttctgttctttcttatagtttaacatttctgtcttttgggagaagtgatttatgggtttaaagaaaaatgaaggaattcctcaccatagttcttattttgtatttgccacacttatttttgggagacttcttagtaactggtcatgaagaattctctgttttcttcacagctagtatttattatttaaaaaagcaaacagataaataaataaaactttaaaggatgtaattttcttttaactttcctcctcacaaatagtattcagtatctgtgtaaacactcttaaaggccaggtgtgtgatcataagtccacatcaggcacttgcgttatcttttctctaaaggaatagctagtcaatgttctggattctttaaattgagaagtgaaatgggtattatgtacatgcttatagaacaagggaaaacaagtctcagcacgtaggtaattagcaaagtgttaagtaagactttgtgatctaagccttgagaagaattcttttgaagaagtaatattttttaggatcccctgttagtgtccttacgatcagatcctttgcagacattttgtaaaacctattcttagtagttctgtgaataggtaaggacctgagtttggatctctaaagttcacacagggctggttggacttggtatatataccagtccttcttcagtgaaatgggagtggagactggaatcccagggagttcaaagactagacacctggtctcaaacaagattgaacacaaggaccaacactcaaggttgtcttttaacttccacacatgcctctacacatgtatacaggaacatataagcatacacattaaaaaacaaacaaaaaacccaaacaatgctggacagctagctcagcagataagaatactttttgcttttgcagaggacctgggttcagacctgtgcacatgggggcccgtagccatcccagttccataggattctatacccttttctcaaccctatttgctgcatatgtatacatgcatgcatacatacataatacatacatacatacatacaggcaggcaaaaatatacatatacaaatctgtacaacaacagaacctaaactattcttagcttgtgagccatataaaagcaggcattgtgccagggcttcatcaaagatgatagttcaccagtcctgtgtttgtcactgttctactggttcacaggaactctggaggtgctctgaattatagtaattgccagtctttgttcaaggcactgagaaaacaatgaaacaataaatcactgcatttactagcaagtattaagtaccaagtagggaaagaaaaagcataggagggaattatatatacctgtattattttctaaacaggggttttgtggttatgtactttgtgacagattaatgtattttaatgtattcatttggcttcttaaaatagtacagaataaactaaattgtgtccttttagatttctgttaactgatgtccagaggacatttgcttagttagaagcatggacacaggttactgggctctgcagccttgactataaaatcatgatgctatattgcttcttgtttaataaaaactttcttaattttacatttattgatgggtgtgtgcatatgttagtgattctggttatcaaacccaagaccttttatatgtcaggtaaatgctgtattgttgagttacatcctcagccttaggatgagttttgtacatagttttaaattatctctgttctcttttaacatagtagctgtagtatagatacttaataatccctttgttcttttaatgtggcctaatgaggaaaacaaaattttctttttagatttatttatttatttatttatttatttatttatttattgtgtatgcagtattctgccagcaagaatgcctacaagtcagaagagcatatcagattgcatcatagatggttgtgagccaccatttggttgctgggaattgaactcaggacctctggaagagcagacagtgctcttagcctttgagccatctctccagcctgaaagataaattttgtatgtggtattttttttttttttgctgtttgattcaagagttattcaggtgcatactttgttttaattatgagaaacaaaagataaatcagaaacaattattgccctcaaagggaatagtttctggaagcagtttataaattataaatatggctgttggcttagttttgctctttcatgtattaggagtgatcatttgcacttgaggtgagcggggtagtacaccaagatggagctagggctgtcaattctgagtggaaagctggcgcaagaatacagcagataggatgtcgacaggtggattatgattctggagagtaagactgcacttccaaaagaaggaagagctggggaagcaaggtctaatcgaggagaaaacgccagctgtgtttggagctaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttaagtgaagttccttgatccacttagatttgaccttagtacaaggagataagtatggatcgattcacattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagaagatggagaagagtgtttacaaaacaatgacacaggtgatgcttcatagacatagtaatatactcaactctctgctagtatagaaatcatgtgtgaccacacctagttagataaaataattttgttgagagttttgttaatagtgtattcttagtatgtagaaaactgcatgtaccaggcagtcagtggctcatagctgagtgaatgagtggagtaaaagctgaggggacagggaaaacacagtctggataggaaaggcttggtagttgaagtagttagaaaagatgtggagaagccgtgggtttaagacagaatttgtaagaaaaactaataggatagttgacagtgataaagtaattttgtttatctgttgtgccccaagctcagtatttccttaaactaccatgttagtaattagataagagaccttgttcagtgtagtgaaggctagtnnnnnnnnnnnnnnnnnnnntaggcttttgtgtgtgtttgtggggggggggtgtctgcagacttaatatcccagtaatataggcctagtgagaatttaggccctttctcaattacctccccatgcattctctactctatacatactattctttagctttctcttgatgttacatttctttgtagttgatgtgaccttcgcagagaagggtgtgtattaaagtgctgagaacttgggctactaggtcatatttggcagagctgagatgagaggtacttaaacttgctgtgtgccaggtattgtggcagatcatggagctcagataccaattgacacataagtggtcgctgctccttatagacgtagtctgcagaatattttaatcattagtaattaatgcactgctgtaattgcaaactgggtgagtcctgttgggaaatactctggggtactctgagcaagtataatgaggagaaggggtgaagctgatttagagaggcatgtggggaacatcttttggaagtgaatttaaaatgaggattgaaatgggagagcatgtagacaaggtagaaggaaagttattcaagccaggcgtggtggcccacgcctttaatcccacacctttaattccaacgcggagcaggcacaaccaggcattgattctcaggacccacatgccgaatcgttcactgacctctgcatgtgaagtatagcatgtgtgcattcttcctccaaaacggagaagtgaaaaaatgtcacctcaagccgggtgtggtggcgcacgcctttgatcctagcacttgggagacagacaggtggatttctgagttcgaggccagcctggtctacagagtgagttccaggacagccaggggtaaacagaaaccctgtctccaggggaaaaaaaaaaaaaaaaagatagagaaaagaaaaaaagaaagttattcaaggtggagatactgtgtatcaagaaccctacaaaaggggaagaatttgtagcactatgtaatctgttacttaagcataaagccttatctgttcctgttctatcttccaaataattaacacaaagacctgttaagtttattaacaaactgtaagcctaggctgggcagcaggttctgagctattctaaccctttaaagctgttaatatcagaaaaatgcccagttacttgccaatctggtcttgccttggctttctctgatccatttgtcccctgctgtgtcctgatatatggaaacctcctggtctctccatgtggtccttctctcactgggatccctggttgggattagaagtccagcctttctaattccactgcctttgaccaatcagaagaagatggagaagagtgtttacaaaacaatgacacaggtgatgcttcatagacagagtaatatactcaactctctgctagtatagaaatcatgtgtgaccacacctagttagataaaataattttgttgagagttttgctaatagtgtatttttagtatgtagaaaactgcatgtaccaggcagtcagtggctcatagctgagtgaatgagtggagtaaaagctgaggggacagggaaaacacagtctggataggaaaggcttggtagttgaagtagttagaaaagatgtggagaagccgtgggtttaagacagaatttgtaagaaaaactaataggatagttgacagtgataaagtaattttgtttatctgttgtgccccaagctcagtatttccttaaactaccatgttagtaattagataagagaccttgttcagtgtagtgaaggctagtgagaatttagtaagtattcagctgctgaaaatatttgtataaggtttgggttttttctgttttgttgttttgtttgtttgatttttgtcctggggaggattgtactcacaggctcaagcgtgtcagggagtgcattactgactgagatatggtcttagctcttgatgtatactgttttgttttgcatttttggagtcatggtctcatgctgtaggccaggaaacccctgtgtagttaacaggctggtctcagacttggcagcgctctcctaacctcagcctcttgggtgttaggtctctagcatgagctctcatgttggtttccttgtctacttaaaaataggactatgatgcctgtcaaggtggctctgtgttaagagtgtttgctgaaaagactgatgacctgagttcaattccttccacctggtggaaggagaaaagtgactgttgcaagttgtcacatgcaaaggacacacactaaatgaataaacaagtaaaatacgtttaaatttaaatggggtttgtgagatagcttgttgaagtaccctgtgatgtggttcccacctaggcacaaattttgttcatcccgttcttcccagggagaggcaatgatcagacactctcttgtaaataccctagagtgaacagacctgtccacttttctttcccaaagagaattgccttgttcaaaaagtctgtagtgctgcatttgagaattagagttagtggtgttaacgtctacacatgtgaaccctaaaataaccatatccatatccattcaaagagtgattcgaagtggttgttttctttctctcaacttttgttttttgaaattaaaattacaccattttcttccctcagactcctcccatgcaccttttgtgctctcccaaattcatggcctttccctttaatgtttttttcatttgttttagacaatttttggtctataactgacctacttccatgtacatgcacataagtctagctgaaaaacatcctttcaaaatagctattttggaaagggcatacagtgttttaattttgcctgttattacagttgcctttgagatagtgcaaagttttaagttttaagtctactcactggtactaggagttgattgtggcttctgaatacactgtgtagtgtaatgtgattgggcattaattaaataagtatcaactataaagtaagattttataaaattgtagctgactttaaagtagtttaaaagtactacttttacaacatctcagcaaatattgggaatatgtacacatgtacacattttcaggtaatttatcagatgtcaaattttaaaagagtatatagtattaggaaaacaaaatgataatattagaagttactttagcacaactttgggagaacagtgtaatacattgaatttgaaatgtttgcactgtttaactgaaatccgttatcactagtcatttgtttatagaattagtttaagctatcagggaaagatatataaacagtactacttcttgaagctcggatgttagtggaagtagaaataattcaatagagcataatatgttgttttaacacaccagaaatgagagctatgtgtatgatgacttctttttttaaaaaggagatgtaaaatacatgtatggcataagatgaaaatttatgtatctaagtcacatgtatcaggaaaacctgggaaagtaaatactaaatgtaacaggaataggacagtttcttatgttttagacttatctggttgttttatgctgagtatctttcaaaaacagtaaccaaatctattttaaagccagacattattatcgaatcactttatagctgtctttttcctttttaaaaaaattatttttagttaagtgtatgtgtgtgggtttgtgcctgtgagtgcaggtgtgcacagaggtcagaggcagtggagctcttggggctggagtttaggtggttgtgaagtctatgtgccaagctcctcattagcctcatacaactatgttttttattgctttaagctgacttttgtcgtacaaaccagagttatttatatttttgattagccaacgattcctaggacttgtgatttcttgctcagttattttttcatgccttcaagatgacaatcagttgatgttttttagtctgttagccttgactgcacacttcatcctgtaggtggtgctcgtggtttttggtgttcttttgtgctacttctatctcaacattttcctaatctgggaaatcatttaatacccactgttgttaatagaatgcttatcttttatgtaactcttgaaaaatcagtatttactatttaaagaaatatttgtagcagaaaataatctgtattaaatttttttttgtagagtttattttgcattttacttgtctacttaactacttagtgtaatattggaaatttttattttaattctgaattttactagccaactcctcaaaattccccaagtctagcagaactaaatcatcacaatgagttcttttttaagtcctcccttcccttctctttgtgtgtgactctcactcttctctctcccttttttctcatctgtcaagttcaagagcagctcagatgccatgaattaagtgaagcacaaaagagagaaaggagacccttttgaagaacaaaggcctcccattaggctgccatgttcttttctgaccaaaagtgcaccctgcatggttcctattgttgtccacatgccctgcacatacggtaaatacagtagatcctcattacctcacgttttcctccccttcctcctatgccacacacaaccagtgcagctttaggtctttgatatctttaggcattcttaatacagatgctttatatccttttaaaaactacaggggaagaaatggaagtggagaacaggcacaccaagtaaaaccccacaagaagggaaaattagctgttagataagctgcaacccaagagccagggcaggtggaggaaccaaagacttatggtgttattctgctctgtgctagttagcatcctggcttttaaagttacaactttgatttatatggactatggattagttattcttctctttgtccatgcgacagaacagacaagcgggacaaattgagttgctgagtgcagtctttaaatgagagcttgttggtaatctgcatgcttgcctttgctgtcatgtacgtgacttatccataggttcattgctctgttttcattggaaatgaactgcattacctataggttactactcgtgttctcattggaattgaactgaattatctgtaggtttattattcttgtgttttcattagaattgacctaaatcttctataggtttgttattctgtattttcattggaattgaactgtggactgggggaaaaaaagttttaagtggtaaatagagtaaactgtgcagagcttggttgtttacatttttttgaggcagggtctcatgtagctcacattggctttgaactcacgctgtagctgaggatgacccggatacctgatgtacctttacttcctagttgccaaggttatagatgtgtgcagcaaccctacctggccagaagttgctgaaagttcatgttgtatgcatttgagattagtctgtacagttgttttaatgttgctggaaacgcccgtggtacttaacttacaaaggagtgtgtggttcttgatatttgctcacagttaactatggaggaaaagactgtcattaccaagcatgtcgaagtagctaaaggcctccttattgtacagcaaacatggagtcctgacgactagaggtttgggtattggttttatttttattctttgaaagaaatttgacagttttttggtattgttaaggagaaaagagatggaaagaatgccagaggagaaaggatgtacttttactgtaattttaaataaaaacatttgttttgatgtaggaaagagtgagaactgacctttcggcagcatgtgctttctttctgtaagactgagctgacgacaagcagtttgtggcagcgcttacaggctgtcttgaactcactgtggattatggggctgcccttttaggattatagatatgatttagtgaggttaaaaagaacattaaataaaccttttctagaaatagtgacattttattttgaaattttcatgagatgaaattgatgttctggcttctttttctacttgacattcatattaaaaatacctaacatttaactttttttgccctaaaattttttcactaatattgaaacctggcttaatgcgtgtgattgttattgtgtgtgtgtgtgtgtgtgtgtgtgtgtgtgtgtgtgtgtgtgtgtgtttgagagagagagagagagagagagagagaaggagagagagaaatatttgaaaaaagtgtgtttaagagagagagagagaaatatttgaaaaaatatttgaccttacttagatgctttttaggaataatgaatagtttcatgttttgagggtacagtagtcagcaagaatccttcagattatatacttgacagcaaaataaaaggcaaaaatcttcttgctttgtgttgtataggtaattaccatttctgttgactgtatgcaacgaggactctcaggcaagtaagagacttgttctaattttgtcttgcttttgccactggtcacacaattttcctcttttgttttttgcggggtggcatttgccgtcagaagaaatcactgacagtcacacccagattgctaaactccagtgcattcactgatatgttctgctgggatcactggtgacagctttgatacaggtgcattgaaacatttgcctttgagagatggaaagtgagttctcgttcttttattgcatgctcttgtctcctgccatcacatttcaagaacagttttgttcctagcattcggcctgtcactagtgccccgctgtttctctttgctaatcagaatgtcccctgcacatccagacagttcatacatggagggctactgctgtgaaataaatgtgactccaggcctccaaggttgtggtcataattttataagttagtattgatttttaacattttgtatattatgctgtaaatgaaattgaacttacattgttttaaatagtttcttttagaaccattagctttagatttaaagacatgctaggtctttaaaatataccgttgttcaattataaccatagtacacagaattagaaaaatcaagtaaacagtaacttttaaaatcagaaagaatacccagggaagtggtgatagaagcaatttagagctgtgagccagctttcctctttgagctttctttgaagctatttgaacagttgctggggtaattttaaacattaaatgtatttgtgactaaaatcttccttctctagctactagctaccaaagcctcacagtggtctcattatatagaatttaaatgatggtcaaaagagacagggaataataaggttggttaaacctatatttattaaaagatagagcatgaaaagatttgaagccttatagtagttcaaggtagtaggattcataaaaagttgagatgccctcccagaacccctgctcccccccccccccaaggatagattttgacttaaaaacattcatctgtgccctggggagagagatggaatgaaacgaagacttcagaaagtttccttggaagacttagaactgggaatggaaagtagaaattaatgaactatcaagagagaaacaatttttatttccacaaacactgatgaaaaccggaggacagacagtgatccttaggccactctccacgtgctccttgtgactcacgtgctctctgtcgccgcgttctgcaacccatgctatctatatttacttggcccaggggcaagggttggttttatgttttcagatgtgtaaaaaaaaattagaatgaacaagattttatggtatattaaaattatttgaaattgaaatgctaacagataaacttaaatcaagacacagaaatagccacttgtatatgtattgtctttggtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacttgtatatgtattgtctttggtatttctagctgttcctgggctgcaatgataatatggagtagttgtatcagagactatatggctcataaaagctaaatttcatgcttatttcctggctatttacccaaatttgctggtcacagaaatgtagcatgttttctaaactagaagttcttggccattaatgaaatttttatacttacatttgcttatcaggaatacatacctttacccggtaaataattttattattattatgcagtaccatgcagagtctcgataatactcccttggttgagtgttttgtgttttgtttttttttttccctttagagatagggtctccatagataactcagtctacccttgaactcatgatcccccaacgatagccttccatgcttggattataggggcttgagggctagcaagtatttaattacttctggttctctcatttgaattatgaaaaaaaattatttttcagaagtcagtctaatttgctgttccaagtctactgaaaactttgtagctctatctttattcatgcttacaaaaattacaagaacttaaacatcagaattgctatttgctatttggaaaagctacattgagatgagcagttagtcttttcttgaaggtattagtactaacagaggttatgtattggatactttaagatacattagaagtgagtgctgtcaagatgtcttagtagctgaaggtgcttgctgtcaagcctttcaaacccacatgtagaaagacaaaatcaacccctgtagttgtcctctgacctccacatactggccctggttcacccacacaataaataaatgaatagttttctaagatgtactaagtgatcacattctaaacatatgctgccaacactggcttatctttctcttgttctcgggtctgctttgttcatctcctgtcagacgtaggagaagtgtggtagttgttgggagtaacatggaagtcttgtaatattctgaataaaaatttagggtaacttctattaggagtttttgagttgcctgggtaaagggagtactgtgtgcatgaggatttgaacttatactccatttctcttctttctattaagcctcacttgcctcagccaataaaaatatgagatttaaatactaaatgagaagctgtagagtttgcttgacagttaacagttgctgcccttcagatgacccaagtttggttcccagtgtccgtatcaggcagcgtcagaggatctgatacccacttctggccacccacaaacactaataaaaaccttttaaaataaagcagaagaagttagtaagtttaccagaggtagaaaagctgtagttaattttcttgctttctttcccttcccgagaaatcgggcctgactggaccatgctgcttatgattgaattaactcatagaaaaaaacaaaagccagaaccattgattaaacatttattctgagtgaacaactgctactagataaaaatgagacctcatagctaagttttctcagcccttatcatatctaagcagtaatgagtgatagttccttcacttcttagtgactacttcacacaaatgtaagggttattctatatagacctttcctgcatgtgtaaactattcagtttgtgtggtggtttcaaagagaaatgtttcctgtgggctcaggtccttgaacgcttagtccccagttggtgctgtttgggagttggtacagtcttgctggagggattgaccactggtttgtgaagtactgtgaacttttacccagaactttccttctttgacacccttgaccactcactctctctcttgaaactgccctccctggaagctgaaatcacgcctctgtttcctctcttctacctggtaactctcctactttgtctcctttgtttccttagatgttggattcctgagggcttgattctaggattccatttcttttcattctacagcctaatgtattcatgcccatggcttcagttactgtttgctgatgctatctggcatttccttgtgtcctgtatttcagggagaaatatcaaattattcatgcccaaggaaaagacatgctcccctttactttccaaatccatagcctgtcttatcctagcataggcaatccttatcttccctcctggagcacagcaggtacactggttccccccagtaggtgtccgtacagaagcaactgcagtgtatgttctgaaaggacaaatgtaaccactcttaggattataacttaggtcatttgggtgacacagcccattctactttctcagtctcttcccttgcctgtctatacataagccacttaggcctgtgtccagattctgacaaatatcctgctttgaccttctacctctctttcctagacagttgtcattttattatttgcatctcaacacaaagacagtttctgtacaaaaactgcttggtgcagtaattccacagatgtggaaggcactccaggagtcggaactagagaggagaggtctggctagaagggaaacagcaggagcgcaaagtggtcctcagcagtactgagaacagggtttgatgtttcttagactggcctctaactcctggcctaagttgatccttagtcctcctgtctcagcctctacttaggaatactggtgcttggtattggaggagtttgttgtggttggtttgtttgcttgtttgtttttctttttttaatgactagtcagacaaaagaaggtcactgatagcttttagaagcttgaaatactacattctacagcacaaaacagaattccctcaaaaaaatatgctcaaaaatttcagtagtgctaagtttaagatatagtggtcaaatgcagggtaccgtagagagaactaatggaaacatgcatctatattattgccatcgcatccattcttccaataaacagagacatgagtacaaatttaactcaagcatgtttagctcagcatggtacatgtaaatgtgtccctaaaacagaagttctacctgctcagcatggtctttcaccatgcaaaatagatgctaaatgaagccagctttgctataacctcccagctgtgttgtctctccctcctggggataaaaaaaaaagaaaaaagaaaatataaagaacatttgtttagagtagataataatttttttttaataactctgacagtgtgggaactaatagggtcaggggaaagagaaggaagggaagatagcctacttccagccagatttcctcctatactctgggcaggcagatgtgggagggctgccagacgctttccacttggccctgggtgggcatctaagccactgaccccactcgatagggggtggacaaggaaggggcagcctctgaaaccagggggccccagagcgacaccctgtagccctggggttatgggagagagggctgagggagagaggtttccacgcaggtgagagtaagcgcagtgggccttgatggacagagacagacagacagacagacacacagagagagagagagagggagagagagagagagagagagagagagagagagagagagagagagagagaccccagccatggctaagaggagagaagggggaaaaggagagagagaagaaaggctagagaggaagagggaaagagagggagaggagagaagagaagagagtaaggggagtaagagcaagagagtgaggaggggccaagtagcccctcttatggtatgctgttatctttattgttgctaggtaactggggaggagtttagcatgaaggtcagaagcttgggacattgtctacttgacttctagccatgcttcttttgtgggggctgaggggccagtaacttccacaggagccctggttccaggagacatgagagaactccttccatcccatgtaggtgatctgcatatagctcaatgccccatatgacaggaagtctttaaacttttaaaattcactttatatccaattgctgccccccctttctgatccaccacccacacagtcccttccctatcccccttccccttctcctctgagagggtaaaggcccccctgggtatccctccacccaggcacatcaagtctctgcagggctagagcgtcctctcccactgaggccagataaggcagcacagttaggggaacatattccacagacaggctgcagctttacggacagatcccactccagttgttgggggacccacttgaagaccaagctgctacatatgtatggggccaatacagttcttaatagcagccttataaatttctgtatatcgtgctaggtaactgatacaataaaataataaatttaagaaagctttgtattactttactgaagaacagtaaacccaaagactaagacatttggggctctcaaggggagacttaggagtactatgttacggttagattccactgtcaggtgctgctgagcagtttagtttacccaatacccttttctttatttttcatatgtaaaattgaatgataaaagaacttacatgattgttcttgtgagaagaaactagttaatgcctgtcacactgtggctatttaaaaaaaaaacaaaacaacaacaacaacaacaaaaaaccttgagctaggaatggattttattttatttttcttttaacagggttttttagtgtggccaaggcctgaatctcactatgttgattaagatggcctcaaactctcaagtgctgggaccagctttagtttttatatttatgatattaaaaaaatgggaaggtgagtgacagattaggggtccacaaggcctaatgttgttgctctgtataattatttcccagaaaatgctagtttctgggaatgtttatgctattgtgagtatggtagtttgccaatgaatgttagaatgaaagatagctgttagatgagaactggagttagaaaagaatgattgtggatactactgactagagaaggaagtcacagttgtgactactggtgattacttacaaggggaaaaaaaacaaagccaaacaaaatgaaagtcagtaacattgtagaagtagcaaaaccagtggaatccagaaggacttcctcttttggaaatggggttaggaatgttttagggtcctctatctttctgctgtgtttaaaaagttagactcaagagtgatgttgagctttatagtagctagttattatagtttgctaggataaaaaaatttcaagtactgtcccatgttttcaagattaattttaaaaaatgttttaaaagtgtgtgtgtgtgtgtgtgtgtgtgtgtgtgtgtgtgtaatatgagtacatgtgcgtatgtgggttatggaagtcagaggacagcttttgtgttggtcctcacctttgaccatgttcactgctttgtattgggggccagctgacccatgagcttcttggggtgctgctgtctctgccttccatctctctttaggaattttgaaattacagacacataaaacatgtgtcagttttgcagaagttctgagatttgaactcaggtcttcatgcttgtttggcaagcctttggaccacctttctagtttaatgttctgtatttaagatcagcacatgaataataattctttaacttatgggtattgcacatgcacatatgcttgtatatcacatttgtgcctggggccaatggaagccagaagagagtgtcagacccctaggaacaggagtttcattcagttatttatgagttaccatgaaggtgctgggaattgaacccaggtcttctaagaagagcagctagtgctcttaaccactaaaagacgacctctttggtcccctagtgttatgtagttaaagatcttatttatttacttattttttgtttttctgtgtatgtgagtgcatgcacacatttatacaggcacacaagtgagtttgcaaaggccaaaaggaggttaggttcctcagagtaatgggcatttacatttacagatcactgggcttatacgctgatgctgggatctgaactttggtcctccatttgagcagcaagtgctcttaaccactgagtcatctctgcagcccttttctatagtttgggaagtagtcctccatgctttatgttatgaaggagatttaataaacagtaagaaatgcataagtgcttaattgtatttatttttataataatcagtaaatgcttttaattaaccaacttcacacattctgccgtggaaatttgtggagatagtaaattcttagttacttcaaattcaagccagattcttcagtatttattcctatctgccctccaactatcctgtttttcatttagggcgctagggtaagttttcttctttcatttttatttctttgattaatgatttcacatttctactggttttaaactgtatacatctctaagctaatatctgaattgtagtaaataatgatactttctgtagtaattgaaagttgcttgaatgtttctaatccgaagcggtcctaatctgaagcagtccctggagtgtttaaagcaattcttttatttcataaattggttgtttacttaaaagtgatggaaattattattggttaagtgagaaatggctcaatgctctgacttctgctccttttcttctacatagaccctgttgcatctcctgtaagcagtgtgtaaactctccatcttctggggacagagtaggaaatcctgttcctatagaatacaccttgtgaagattatacatcaataataatagggtcatctaattttgaagagctttatagaaaagaaaaaatggagactactgtgctattttagttttgtatagttttctttcttcaccgtgcattcttattatatgcagtagttgaccttccattttaatattactactagctggtgtttgttttgttttactttctattggtctctttcacagtaagagcaagtagttgcaaggtatttaatctattgaataaataaattgttgggctttgttgaaagtttttttgtgtgttgcagggataaatgagtagttcttatctgtcttatattcaattcatgctcacatttttttctttattcagaggtggtaattaagctattctaaataatctggcagctatggtgttggtataagaaatagtagcgttaagttaaagatgatgtatctttattctgccactaatgtataacatctttatgatagtaatatgccagaatatcattttttcatctataaaacaacgaatgacttctttataggattttgttagtattaaaaaggtaatatttaagcatgtccagcatggtgtctggtacacctaatgttcaataaatggttgtcatattaaaaaccagatagcagtgtattttagctgcctccctagttctccgattaaaggcgtgtgccattacctcccagttttagggtgatcttaataaaactcttgagtcacaaaaacttagaataagagttaggatatcacaatttaaggctcactccccttacaaagtttatcttattctctagtgcccttgtcaggtgtttatatctcagctgctgtggagcttttttctttggacaagacattatgataggttttcaggggacttctgagttgaataaggttcttcagtctagtgcctgtgagaaatggcagtggagatagatcgtgaaggatgacatagaatatgaatatttacagagtttctgataacaggaaccaggtgggacaaaggagaggagctgatttgttgcaggaagtcatgaatatggatactcccatgagactggatgaaggaaagtacaggagtaatgaagtgaaagtttcctacagtgtgactttctgtatccatcaaatgaattgttaaatatctaactgtgatatgatcaaatttgcatcagaaaattataggaaaaaaacagcaatagaatgaaacttcttttcccatgaacttcagattgtagtaagaatgtaatttagtatttaaatcaacttaaaaatactttaaaagtggattggggctgggggtggtgccgcatgcctttaatcccagcgcttgggaggcagaggggcaggcgaatttctgagttcaaggccaacctggtctacagagtgagttccaggacagccagggctacacagagaaaccctgtctcaaaaaacaaacaaacaaaaagtggattggaacacaggcacagaacaagttgcaaaaatgactaggcagatttggcagagtaatttctaaacaggaaaaagtggtccttgaaatttacatttcaaatgcatttgaaaaagaaattttgaagaaactaatagtaggtcttgggaaattaatcagattactactagtgttctagaggtagatatgaagagaaagtaagatacagagaacagaatgagaagtgcagtgcagttggtgttctagagaagacagttcttaatcatcatttctagtgtacatcctctgagaacaccatccagggatatggaaaggcgttcactagaaacagtggaaagctaaggacactgggagaaagcaacctttgagcgtatataaagatgaaatgatggttttagatagataaactgagttgcttaccaccatatcctttactaaaggagcttctaagaaacatttcttaagattgaaggaagctgaactcagaaagactgaagtacaagaaggataaacgaaaaaatggaaatatatgagtaactattagtaaactatattcaatttattttatattaacagagcagttaccaactttcatcgtcaaccgttgcagatagtacaataagaatttttcaagagaagctgtaatcttagctctctctcaagattattttcatcttacaaatgtctctgatataatttgaaatgaatgaatgtctttttaaaaaatgtgtctacttgcaggctgctgagctaattttaaatttgaataagaaaatttaaaatgaatctaatggaactatgttaactgatcttgctccttagttatcagtctttactgtcagtgttttaccatttgaatctggaattgactggtgagaatgctcagctttcattgtacgcattagaagcccgttccaagtgcattgttccaagtgcattgttaagaatatatcctaatcctggagaaacacagacataataaaatggagcttgatgttcttcatatggccaagggcattgcagcagaatatatatcatgtcctttatagctttagcctcagagaggggaagttgctagagagtgttctgtttgcttgcttgtttaactgctgagcccttggtattctgtgagaacaatatatagaattttattagttgcctttattcaaaatcaacagtgagtgttctactcatattctaatctttttaaacaaacctttaattgtgaactaagtctcatgcttgatttaacatttgttgactttcccagaaccattttttcattcatgtacaagtatttggttgagcctctctcaggttctaccacatatgtgaaattgctgttaagtaaataagacataatatcttgtgttcagaaaattttctttctagtgaaaagcagaaatcaaacaagtatacaaattttaaaattatgagttttcagagaaaacaaggtgaagtgatagattaattgatttaaaagattaattgattgtcctcacctgaatgaacataaattgcgaaggccacggggcatatttgactgaatgtggcatccttttccatatgagaggatataatattaaaatgatggggattttcattttataatgatataaaaactacaacagctcttcacaatttaaatgcttatcttccttaactcagggaaatatgtgagaggccctatcctaatttttattttatatttggctctataatgtggagaactcagccccacattaaaacacttggtcacagatgtttgattcatcagctgtgttatgtgctctgtccttatgtatttagacagtggtgccactgtatgtaaaagcagtacttgttaactttagcaagatctttacataagacaaaagataataccaaagaatcttggtgttttagatatacaagataatataaagacagtagctatagccccaagccatgttagagaatttaaacataataatttctttagaataaactgtattttattgatgagctgattatttatataggttttctacacagtaaattcttttttccacaatgaattctttaaaaatgtatgaaaacattgtttgttgttgaaactttagtgtacatatattcttttcgcggaatttttactcctggcttctttgagagtaaagctgtagaaatctctgccatggtttttgtggattgtgaaaacaattgagaagctgtaattacaatagatgggttctctaactgtcttgtggagtcttttcctcagtgtcaccataggtagtaaaatgtgattgcaatgtagaagacttttctctctaaagaagaccagtgatccctttaagaagggtcattgtgaatttcttgttgtaattgcagaatgagtgagtttgaatatgaaggaagaagagcctaaataggagagatgctctggggctgcctttctctacaaaaggtaaatcagaaagcatctgctgtggctgttttaccatttttattttgtttaagaacaaacatagtaggcagttttccttatttgatgagcaatgatatcagtttgaccggatttatgatactgaaagattattggtaggaactcattaaagggcaacattttggaaatttatccaactgttcttttcgaattcacacaaaatgacacaaactgaggccaaatagatagtcagcattatttctaagcaatctagcctttcactgaaaaaaaaaatcttcctgtatttatccatttccttttaactgaaagcctttttgttaacaagtctttaagcttaaaccaaaattgtccttccttgtctaagtcttctctgtcttgaatttttcttatagatctctattaaaccaagctttaatagagaccacaactgctttgttcttttgagtttctttctttgtatcaatatcaaggttacaaaactgattgtataggatttcactcatttagttataggtttgattaataaggtaaaaaatatttagccagacactgggagccaacgaaatatacaaataaataaataaataaacaaacaaacaaatagttcagctaaaaatcttatactcaaaaaatagaaatttgtaacatttcatgtgtttagttaggaaaaaatactccaccaacaggtagataatgaaaatgtggtatatatatacatagtaaaattctactcagttgtaagtagaatttataaaaagggcttgatctgaaaagtatattagatgaagtaacccagactcagacaaaaattacatattctctctcatgaagttccaaactttaaatgtttgcatgtatagaaagaaaggaacgaggaagagttggcttagccatgaaactagataggcggcagtctcaggtagggctttactgctgtgagcagacaccatgaccaaggcaactcttagaagtacaacatataattgggacagtcttataggttcagaggttcagtccgctattatcaaggcaggagcatggcagcatccaggcaggcatggtacaggaggaaccccatgcccatgcccacaatgacacacttactctaacaaggccatacttcctaatagtgccactccctggaccaagcatattcaaaccattacagaggctacaaggtgggaagaagtgctgagcaaaggggataggacaaaagacagaagtgacaggaggcaagtgggaaggaggctactggaggtggagggggcagaagaggagatgggagagaagagaaatagcacagtttgttggaaaacatataaggaaaccagattctttataggctaataaatctttttcaaaagcagaaatataggcctgtggaaacagcacatcaagtgaacaccgttaatacataggctgaaatggctctatgtgaggtgattagtctgaagcgcattctgaatccatttcttattgattctttattgctgtctttgaagacctaggtagggttcattctttcacagttcttttcccataagagtggagtaaatgctgacagtacattaagttgattccttaggaaaacattctttgaataaggtacacctgtggtacaactatcccagctttaaaaaaacaacatggtggctgggcagtggttgcgcacgtctttaatccgagcacttgggaggcagaggcaggtggatttctgagttcgaagccagcctggtctacagagtgagttccaggacagccagagaaaccctgtcttgaaaaacaaacaaacaaacaaaaaacatggcaagcaaaggaaaggaaacaagtgtgtatttttttctttctcctgttgtctgatttgtatgttaagtcacctgtctgaggcttgatatgtgtagctcagggaaccatttacctagtgtcatatgagaccttaggttccatctccagtggcatcttccctcaaacaaaaagtatgcatgcatatatgacctaagaaaatttcaccatattacttacacaaacagatcctgataataaggaaacacttcatttgaatgtctttgtctttctgatttgttttggtttttttctcataaattgtgaccaatctttagatttacttaaagtagttaattgtcatgctggagttgaacccaagacttgtacataataggcaagtgctttactattgagcgtacatctttagtccccaaatttttaaagtacattttatgggatagtactgaaagcacttagcaatttcacaaaatgacctcgttggtgtcttaattagggttattcttggtgtaatgaaacaccatgaccaaaagcaagttggggaagataggggctcacccttccacatcatagtccatcactgaagaaactcaaactgatgcagaaggggtgctgcttagtgacttactcatcatggttttcccagtcatttttatagaacccaggaatgagaccgcccacaatgggtcaggccctcccttatcaatcattaattaagaaaatgaccttcagcagggtgttatggacgcattttctcaactgaggttccctccttcagataattctgtatgtcaagttgacataaaactagccagcgcagcttgttgagtccatcatttttaacatctgatgtgtttgagctaactagaggcttttttctccattaactattttagtatgtctatgatagctttcatgctgctagcctagttctttgaaatgttacccattagaaatatgtttttaaaaagttttagtacatcaagacagtatctaataaattagatactaaagaaatgcatacttttatgtttttaaagaattcagcagtgaaggatgttaaagtttgtggctcagactttatactcttccccatataaacattttctgtcttggaaaatttgtttttatgaaaggataaatggttaaattttctgccctgggtgtgaagacctagatggttggaaatgaatatgaatgatagtgagtgagttagcctgggttcaagactctcctctccttgtataataaagactcttggttaccccttggtaatgttgcatgtaacagaaacagacctgcccaacttgatactctgcatcttctttagacagaggataccagccagcagactcctttcagaaggctagtaagctccttagattttattctattactctcactcggattccaaagagtagaataaatccctgcagtttttcacatatctctctgaagtttgacgctgtaaatcagtgttcacactttacactgttcagaatcttaaagagaattgatttcagaacatatttctggaacctccgcccttagagtttctgatttagtagatctgatgtaggacccaagaatttatattctaagttggtgttgatgatagtgctgacccagctactatctctatgactacaaacactttaattaggccaaagaacagccatagcacattaatttaaggaaacgaggcacattctttaattcagaactttaataaactgttagtctctctgggtgctgtttactacattaagggaaccccacccttactcccataaatattgacttaattttttttctcttttcaacttctttatgtatgtgtgtgtgtatatatatatatatatatatatattaggtattttcctcatttacatttccaatgctatcccaaaagtcccccataccccccccccactcccctacccacccactcccactttttggccctggcattccactgtactggggcatataaagtttgcaagtccaatgggcctctctttccagtgatggccaactaggccatcttttgatacatatgcagctaaagacaagagctccggggtactggttagttcatattgttgttgcacctatagggttgcagatcccttcagctccttgggtactttctctaactcctccattgggggccctgtgatccatccaatagttgactgtgagcatccacttctgtgtttgctaggccccggcctagtctcacaagaaagagctcaacttctttagtcaaaacatttttcctaaatttgatgattgccttcctctaatttaacagacacactagcccctgctgttaggctggaggtcacttttggattagtagaaatttattttacttgaaacttcaagcaaagatagatttttaaaaacaattttgttttttttttttttttttttttttttttttttttactaagataccacaattgcttgcacaattgaaactttttaaatccgtctgaggtcagtacaacttttggggagccattaccagctgtgtctgttgctatggaaactcagcagggactagcagtgttatagttgtaaggaccacacctggcttatttgcatccaatttaagttgagaaaatttctaaaagaataaaaggtctctcctgtgccagtggatagcagaaggagcttgtcagtttgtagccttcagggtgagtgggtttttctcttcctggaggcttttagtgaatatgttaaagctcatgtttgttctgtgtgttcacatgtgtcaatgttttgctaccctttttgtgtaaagtgatcttttttgtttaggattttatctttggtttatacttttaaatttttaaagtgttttccattttcatagagaactgaaaaaagaaatcacattttcaaaaagaaaaatctaatttctcatttgtgctcaacctgtaataacattttagtgagttcttgctgctatacaggcttacaggtgatcataagctgatatctctctttcagcattaaacaacacacaccaacaccaaatctctcatactcaccattctcaccaaatgaccaaaattccaattaaattttggacttaaaaaaactagaaaactacttatttttatgcgtttccagccacacttggggaattcttacacttgactagaaggacactacaggataaaactctggaaaacattctagagagtatgataattaaatccagtcttcatgattcaagcttgaggctcttaccacatgaaaaaataacaagtattcagacttaattgctcagtttagtgtagcctgagttctttatttttagtttcattggcttttataactgttagtgccttggcctccccaagtcaccatgtagctaccttggtagtgtgagacattgtttacataatgagaacattacctagctatagagattttataagaagcaatgaaataactcatcttaaaatattctgaaatatatacacatatgtaactgtcagacatactctagacagataggcaactcaagtagccatattgttcttcttattgctataacataatacctgatagaagcaactttagcaaaaaaagctgtgttttagttcacagtctaagtatatcatggtgatgatgaacagtgaaactagctctaactatggcaagagtatgtgagctcatgtatcacactgtgtccaaagtcaggaggcagaaaggcgggctgctacctgctcagtttgctttccttttcctttagtactcagtccatgataccttcacagatatgctcagagatacaggtgtttcctaggtaactataagtccagtcaaattggtaattaaaaaataactatcatgtagaagcataattagtaggatgtatctaagtaatttttattgaacattctaagctacaaaataaggaaggtagtttgaactaattacatatttggcttttaaattttttagaataaacatgtgtgtgactgtagagtatgtataaatgcatgtttgtgtatgtgtgtgcgtgtccatgcctatggaggccggaggatgatattgagtatcttcctcagtcactttcccctcattttttgaaacagtgcctcactaatttgttagactggcttactagccattgagttccaaattcatccgtcttcatccacctaggtcacaaacggagctaccatttatgtttggtttttgctttttttatgcaggcactagcaatctgaattcagctgccacacttgattttgtgtgcaccattaaactagatttattcagaatttcatgaactaggaatatatgtaaacatatagttaaactaattatgaaagagcttgacattaaaatacatggcaagtgaaagtcagtgcctgtactaatcccttgctggttgaggctgttggtgctctctgctgatgaagattcttgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagttattttatacagtttactcagttttgcctttttctctttttgtattcttagactggaaaagtaagaagagctttcctgcctttttaattaccaaactactctcaattttcattgaaacaattcaaagaaagaatgcagtctttctatacctggtaaatattttctactaagtaaaactattcctttagtagccactgataaacccaggtgttatggtgattgccttttattttatggattgtctattaaaatgacttatcaaataaataatttttcattttagttctgaagtctgtttaagatttggtgatgttttggaatgttacttgggatgcctgtgacctagtgagcaatagaaatggagtcgttaggtttagcatttagtatatcatttgtattttattataatgagagagtagcagtaatccttgatggtagtttaatagaagcactttgttactaatagttttataaaaataaatctaatggccaggcgtggtggcacacacttttaatcccagcactctggaggcagaggcaggtggatttctgagttcgaggacagcctggtctacaaaatgagttccaggccagccagggctatacagagaaatcctgtctcaaaaaccaaaaaataaaattaaataaataaacctaatgagtaaactgttatttaacattcatttaaacaatgatctaagattagagagaacaagtgacttgtttaaagacggtcagctaagtagtagagaactgaaacagactccagatcagaatctgttattggttttttatttttacgattttttttttacttttttcagtttccttaaatatgaagtaatatgtctaaagaataaaaaatttgtagtaacatttcatgtgtttttttttcttttgttataacttagagtctataggagtagagaagacactagtttcatgtgttccttgtaaaatatttcacttacgctaacaacactgttggcaactctttgctgcctggtgtgtgtgtgtgtgtgtgtgtgtatttaaaacttacctacaaacttttgagagtattttgtgcctgtttactgacaacattcccactatatatataaaaagtgtaagattagaggaaatagggagaaagaagagaacgtacataaattatttggtcctttttacaagttacagtcttcatcagtgtttggtaactacatatttgctgattgttgtgatactctgaaatgtgtcttcctgggattgtcatagagtgcacacatggacagagagagatctttgtctttatttatagtttaagtcttccggagaaaatattatttcagtattaaaacgtggagaaaagggaaagaacagcaccttgttcttcagtgatgtgtttcattagttctagcaatctgtagatattttaccatgtacaacaaacattgcttttttgctatggttaaagcctagttggaagacagaaatatccatgagtatctactcttattcttttcatgcattaagagtagcatttattgaatgtttatcaagagattataataatacccgaattatttttataaaccctggttattttaaaataccattctcactttaggaatacccttggatacaatccccttttcttacacaggcaacttaagttcacaagccatattagttcctagggatgccacatggaacaccacagctgcagtatcttaagcagcaggaacttactgcttcatagctctagagaagtggctcttgacccttctgactgagactctttagtacagttcctcatgttgtcgtgacccccccaagtataaaataactatttttaaaattaatgttttcattgctgcttcataactaacttcgctaccgttatgaatttctatgttttgtttttttggaaatagaagtttgccaaagggatcatgacccacatgttgagaaccactgccccagaggctgtcactctaacataaggtgttctcagggttggttcttctgagggctatgagaaagaatctatccatgtttcttaccttccttctgtgttggctctgttcagatttccttgttttataaggacagaaacactaatgacttcatcttatttagttggttttagtatagtactaagttcatgcattctaggcaatctctgtagcactgaacaacctccccaacccaatcatatcatcttaatatcatttccaaaagccatatgtctaaaattaggtcatgtttgctgccagaaataacaatcattccatagcagatagtaagccttccattcagcatttccccccaccctgcctatggtgcccattttagttttatttaaggcattgcttttctactgaggaaacagtgctgtacatgcaatgctctttcttctccctgtgttttatggtaaagtatggagggtacccaaaaacttactgtagtagctctaaatttaaaactgccacagaacttgctaaatttaggcccttcatagctttttctgtggaatgttgtgtctctttttggactgacttaactcagtgatgggccctgagaagtgccacagagggagaagctcccaactcaggaagcgccaggcattcctcctggcatgcagctaaaccctctgttacagcttggaagtgatggggaagttgtgagttgcatactttctcctggtgttcagcttctttctctgcagtctgattcttaccttgctaactgatggtttcattgtatttgtctagaatctgttgtttgtcctcatcattgatcttgcttggaagaatctcattttcaacttttgctgtcatattgaaagcatagaattccagtgaattctttggtaatacgttatttctctgcttctcttcaagcttgtacttccaagcttcctggaccattcatgcattatctttcttactcaagaggcccttgtaagtggtgatggtgatcttgttctcctttgtgctcttgtctacattagaaacattgagggtgccaatggcatcaatgtcaaaagtgacttcagtctgataaatatcacaggctacacaaggtaggcctatgagttaaaattttccatgtaggttgtttttggtcatggctcttttaccttcatatactggaatgagcatagctgcaggttgtaagaacaagtggtgaagatctgtgtctagttggtaggaatgataatattatgcttggtgaggagagtcacgactctaccagcagtttcagtacaaaggagaagagaagtgtcatccaagaggagcaaatccttaaccttctcagaattgtttccagatagagttgtctccagttggccacctggacagcgtattataagcaacagcttcatcagggctaatgctcaatcaagttcagtttttttttttttttccattgaagaaatctcatggaagcttctgaatcctggggattatggtagaaccatccaccaggacattgtgacttgtctagcttgacatctcaaaggggcttttctacagagtccacagtgccacagaaataagtcagcattcagttcttgagcaaaggtaagggtaatggagttaatgaagtcagttcctcagagaaagaatcaatctccctcccagcttaggtgctagaggagagcgtgcccctttgccagcagtacatagacattagatagctctcttgtttttactgatgttctagtgcttgcatttaaacagagcaataaaatggttaccatccagttgtcagtcttctctacccaagtgggtgcttctagctgtaaattagacctcaaaagtgagggttgacatgttaaaaatgtcacctaaatatctcggcacatttctttcaactccagccttcctatctaagctataagcagtagcagtagtagttggctagttgataattttaagtacattgagcccggcatctacatctttggttgcctacttctgagagtcattgaagtcaactggcaccgtgatcatagcattggtaatctttccaacataggcttctccagttttcttcatctttgtcagaaccatagagcacacctcctctgggtagaaagaaactttttgactcccctttgtattctacttggacattagacctgtgtgcatcattcaccaccatgaaggaccaatgcttcagatgagactgaacaacagtgtcattaaacctacacccaatcagacatttgggtgttttgttttgtttgtttgtttgtttgttttaaataaaacaaaactgtagttgaggttcttcacaatccagttcttcacagtgtcctaggttcatcactgtgtcagtgattcagtaaccatggtcaatggcaattccactttccttgcttgaagacacctacacacgggaggcaatgctaagatcaatgccaactgcaggtcctttagatatgtttgcttccatgttggtccagctgtactgacaagaaggccacacaaccctgaaaattgctgatatattcagtgagtcagtttcataaacaggacagtttgagatagtacattgcagtgcaaataaatagtatttttaaataatgtgacatatctaaaatacagatttataattaattttctttttttttcttttttttaattaggtattttctttatatacatttcaaatttcaaatgctatcccgaaagttccctataccctccccccgccctgctctcctacccacccacttccgtttcttggccctggtgttcccctgtactgggcatataaagtttgcaagacaaaggggcttctcttcccagtgatggccgactaggccatcttctgctacatatgcagctagagacatgagctctggggtactggttacttcatattgttgttccacctatagggttacagaccccttcagctccttgggtgcttcaacatccttaatcaccagggaaatgcaaatcaaaacaaccttgagattccacctcacaccagtcagaatggctaagatcagaaactcaggcgacagcagatgctggcaaggatgtggaaaaagaacactcctccattgctggtgggattgcaagcttgtataattaattttctaatactgtctaatgtctgtggagattttattttaaattaactgagtttctaacataatagactttggagctataatatgatgttttcagcaactctttcttcagacaataaatgatgacacagaagctgagactgacttaggtctaagcttaaatatgaactttaatacaattcagaggggctaatgtggacttctcttccataagatactgaaaagtccatcagaattctgtgtaactgattataagtacactcttgacagtaagtaatcactctttcataactctagatttctattatcatcatgttcctatgattagacatttttgagagtttgggatagcaaaactacactggtataaaaaccaccagggtatgacagtactcatgaagttttgttagtagtagatatatttcattcattattgttgctttagtttatgggtatgggtattttgcctgcatatatgtgtgtgcaccttactttgtgcctgcagaagtcacaggacagtgttgggtcccctgagctggagttatggatggttgtgaaacatcgtgtgggttctaggaattgagcctgtatcctctgcaagagcagccaatgctcttatccactgaaccatctctccagcctctcattcattgtcatttttatttagtttgtctaaattatgcaaaatttggtaaggaatcttttaagtctatgtctgtctttttcaccttctttcctagtgcaggactttgttaggcaagcattctgccattgagctacatcctcagagtttttcttcaagtttaaaaacatttcaacaagtttctttggtgccctagattcttttttggatggtagtgacgttaaaaaacaacaacaacaactaatatctgatgtcatatgtcttcattgctgttccatgtgcctaaaaaatacagtgacagagggtggagagagtcttaaagttatacttatctttatgtttctagatttatttttatgtgtatgagtggttttgcctgtattatgtgggtgtctggtgaaggccagaaaagggcatcggatccccatggtggttgtaagctgctgtgatgaacagttcttcctaactactgagccatctctctagatgttaactattgagccatctctctagactctaatgccttttttttaagacttatttacttattttacgtatgtgagtacactgcaactgttttcagacataccagaagagggcattagatcctactacagatggttgtaagccactgtgtggttgctgggaattgaactcaggacctctggaagagcagtcagtgctcttaacagctgagccatctctccagcctatactgtaattctaatatagtattttatagtttattttgttttgttcctttgtttacaggatttaaattctcttttcaacagtgataaacctagctcagtttattagatttaaccttccttatgtaaccaatttcctgatacccgccttgtttttgggctgaattgtgaatgctatcattatttttatgacaaatgttaaactggtcagattggctctaccattgtttcatttgacccctctactgtgtttaatttgaaaaaagaagttggtttcttggtgggagctctctgctattgatggtttccctagaacatgaacagttggccataaatgaattagtcaggaagaatataacataaccttagttcattcaaaccagacaaaggttatttaaaatgtatattataatttggttattattgcttttaatttcttttctgatgaaacttataaggtgtctttgtaatcatgcttaacttaaactttaaatcatgaaagttgttctgtgagtgaaaagatgggaaactaagcattgtattagtttcttttctatttccatgaatacagtaccctgacttgggaggagggaggatacagtccatctctggcaaggcaagcatgatgtcagaacttgaggttgtccagaagtcaggaagcagagcaagaacaagatgtagggattgactataaaacctccccaagtgacacgtagcaaagctccaaccctctagatgtttcacagcctttccagacagtgcggccagttggagagtcaacacatgatcatacttttcacattcaaatccccaagacaccatacctaatccttcccaaactgtttcactaaatgggaattaagcactcaaacatataaactcattctcatttaaaaccacaacaggcataattttgaaatgtataattttaatgttaccttgctaccatatgataaatactatttcctgtcctttccataaatgtgttaccccatctcatatctccagtctagcttaaatctagaaaagaattattgaagtacttattggcctcttctgtcagggtatctataggccactaatcaaatcctaacccaggtgttaaaagaaggagatatagttgaattaactcttgctgatcttacagatttttaaggtgctcttttttggttgagttttatagtatgtacatttaactctgttatagaacttatctgacctttccttttggatataaatggtccatagttgggaagtataagggaagggtgtttcctctcattctttgctactatttgtagaagtctgaacattcttaagagtatttaaacctgttgtttaaagtgtttatttcaaagatggccaaaaggactgccttcttattgcccttttcactgtagcccagtcacctgcccaggtgagatttgtagtagaagggaatattaacctggcaagctaagaccttccttctctacagaggcaacttgggactatcttggcctaaggcaaatgatactaacactgcttaggtagaaccaacaaagattgcttgtctgaggctaaaggtcttacttgcttggatagaaaacaccaaattatcaaagaaaaaggtatcttaaagatgttattgtatagaggttttgtatttgttgttttgttttgtttttttttaaggcaaattacagagctggtataaaagggaaaacaaaatttctatgaatgccgaagaggagaggatgaaccattttattaataccaagtgtattctagtcaaataagtactaagtatgtcatgggaaatggagatgtagatttaggtccatttcatcattgcttctcatccttcccacctatagtagaacttgtccagtccaacacattgttcttaaacattcatttggaattagcatcccataccatattcttgcttattttaatacaaagtgtagtataaaattgatatttttaatgatgtgctgtttatctgatgactccatgtttgtgtggcatctgtggtctctcattcctgtttctgcttcaggtcaaactttctactcttgatccattgtgcccgagataatttaggcaaccataggtatataaatgcataaaatacatgtcaaatattgactgatagtaaatcataatgttactttagaatattttcttggtatgtatattttaccatgttaaaattaaagactaatataaatttgcacactaataagatggacctgcttatttattttacataaatgtcttacttagttgaatatttaatactgcaaaatatagtgccttttaacaacttttagggttgattgatatttttatttttccagtcatcagtgttgagaataccacttcacactttcacatcgtggaaaatggcagaagtaagtttaggcccattttagctattattggaaataatgttctaatgccaagctaaaactcatttaacaaattttttaataaaacttggatcataaagctacacagccattcttaaaataaaaccttttttaatacaatcaaagatacagggtgtgtgtgtgtgcgcgcgcgcacgtgcttacatatatttatatacaccatgtgtatacaggtgtctgagaagaccagaagaggacatttgatcctcttgaactggatttatagataattacgagccacatgatgcagattcttagaccagaacctggctcctttgtcagagcagcatctgctattaactgctaagttatctctttagccataaagatgctgtagtttgatacttatgtactcggaatgataggaaaataccagtcctatatgtctctataagagcagaaaaccttgtttgtaagtacagttatcatactttataacacacagtgatgttgagtctgaactgagggacctgaagcagcatggctggcagcgggaagtatggcagcatgtaaggttcatattgtatgttcagaccccgggctgcagggaagggcatagtataacactggacaaatactgactggagcaccctgtttattacatgtatatttattgcacacattttatttcataacctattttaaaaatcagacattggaatgcttgaagacaagtataagtaaaaggttattaatgagagggtgggtaccctactttcagcaactgtattatctgtatgcactttaaacatgatgcctttgctaccaattattagtctctttcctcagtactgaaacatgcctgcctgcttgctttagtctcttcccccctcactctcactctcttcctcaccctccctcctcccttcccaccctctagttctctgacagtgtaacttagccttaagttgtgtaggtcttgcaagaacttggatcttgatgtcagtaaaatctcctttgaaatcctgacctggaattattaatatgccattgagtggaaggtgctttagttttctgtactttggtttctttattcctaagaacttaataatgtttgtataagtgtcctgaattctttataatatctgaaacgttataacttaatttcaaactttaataaacatgtttaatgaggctatatatgtacagaacgtttttctcaaacacgcagaggtccattaagtggtattgcttgaaaaaatagttatttggcatttccgtggcccatttgaggacgatgcacattctaagtaagaaactgtcttcctcgagagnnnnnnnnnnnnnnnnnnnnaatcttctgttaatttggtagtataaaaagattcacatataatgaatatctgctctcaaagatgcttttgtacactcttgcctgcttctgcatttatacagttgtcttgttttaagtaggactttctcttgacggtgtgcgttaataactggaaaattccctatcagtagactagcaccatcttgacaagcctgtgttctgctcctaccttgctaattgtttccttgggattatttggattgtgtagaaagccttttgcaaatcctcttattactgaagtcattgttgccagcaggaataagattaaaggtgcttaagtctgtagagttgtttctaatttgtccatgtcatttcagtggcattttaacagaactctgcctcttgcccctcccttctcccctggtactatctcaagttaggtccaagatgccaggccattggaagaaatctcattttatcctcctaattattatgctggcactcaggagataatttttcccttcatgcactgccaattaatatgcaaatgtgctgataaatatttatgtattcatttaaattatgcagggagtgctttcagtgtattctgtaaatgaattgttcctggacttcaaagtgctggctgctgtgctaacgaggagagatttgcataaggccctaatcacacgcatactgattaagcttcattatggaaactgccagctgcaatctttgtttctattttattacaaaaagaggaacttttcatgcttcagttgccttgacaatgtcagtcctcgctggtagaagagactaaaactcctcagagcaactgaagtttccttattcagttgaagattgctatggtgtaactgaagttgtagtttgcttctcttgttaattcactttccactcttcccacccttgttctcttaagaacatagtacagatttgttagaaatagtagtttttccccctccccaaacgctacctgttccttcttgctttggactgtctgcacctcttgaagattttacagccatgctggactgcagtgactgtgttctaggtgggtaccagcacagttcttttttacagcgttaatatggaaatagcatgtgtgggattgactatgcataaacgctcaatcatatatgcgaccaacatgggggaggggagggcttgaacagagaaggaggaaagcatttgcaaggcaacagcatgcttgagtttgctgtaggtccctccttaggaccagcttttctggttcagagtgtattttcagcaaataatgtatttgaatttgccttgcatggaggaaatttttgcttttgggaaatttccagctcttcaagtgtattttcagcaaatagtgtatttgaatttgtcttgcatggaggaaatttttgcttttgggaaatttctatagaaagtagtatatataatttaaaatacattttaaatcagaaacaaaataaatgctatatcaaaataatatatacatattaataaaatagtttacctatctaataagaatccctcatacaaaaccaaaaatcctaaatgaaaaattaaggtggttcatggtacagaattaatattataactactactattgtgggaaattacagaggttcctgatcagtttacaaagttactggccattctcaaaatttgtcactttgatttcttaaatccagctttatcttaggaaattacagttttatgtgtttttgcaaggctgttaatagtaagtttcctacagacccaggagcctttgggaggtagaggctctgcttgagtaagtgaagcgttttgggtgactaaagatgggtcgaataaatcatggcttagataagtcatgccgcacggtggccatattttgtgaggccttcctctgtttacatgaggatgactgcagcctttttaagtcgtctgatacaaagtacaagaattggatatcttaaacttagaacttcagcagatgagttttatttcctgtgtgttattttctattttggaaattaaagcagttaatgaaaaagtaaattggtacatccaaaatatctgaattcttatacagaaaacatggttaaactcaagttaaccatatacttgtccatcagagtgaaaactgctatgtcaggggtgcacatgatacaaacaacaaactgatgttagaagttcagcccagcagtaatttatagactgcaaattagactcatgatcagttaagtgacacatgcttctgttttttctattactaataaacaaaagtatcagtgaataactacttgtatattttcttctaacttaccaagtttgaaattccagaaatgaaagaaaaatgtcttttcagctatatttaccatttatttttgaatatcagaaattaaataactacttagagtcattaaaacagacttcccatcgttaaatcagaattttatctattcatattttatttatttataaaagattattctgtttgtgtttgaagtaattttgtaaaatgcctttgaaggtcttgacagttcaataaaggtccttagaaaagtcatgtaaaatacctgtggcataattttcaaattcataggtgtggaaattaggtattgactgcaaggccaggctcatgatttgccgagacttggggtttttggttactgtagtgtctgtgcatgagaaaattgttaattctgtttatatgtgtttactgattgttttttgcactttgctttaaaataaatcctttttaaggaaaacattgagtgtacatacaatgatatgttttgagttttgtgatacgttaacttttctaagattttagttaagtcatacagaaagctgatttttactaagttgtgcacctggttctttcaaaccttagtgtgctttcaggtggtatttaaaattttctggacagtgaggaaggaagttgtagaacaacctcatttatgaccacaaacatacatgtctaagacccataagatatgtatcagttacaaaaatttactatattagaaaagatattgttcagagtctagaaaacaagctgcccaatttctaggttatgaaatatgaaaagttcctaatatttttccccatttcttatacatgtaggtaatgcaactatgggcaatatggttgggacttacaatgattgtcttgtcttcttaattaaacattttctgcagatgatttttcaaagttgttataatatggtttgatttgttcgcttataataacttggttaatggtcctttataatggagtagagatagaacttacttggtaatagtcttattttataacaaacattaagtctgtagtgaatgtagagccaagtgtctattttgtctattctgttgacccttgggaagaagtagcagggcataagttgttcttgtctcctttcctacataatttttggaattgctaatagtggttgacaatattttactatggaaaccacaacttaataaactagaaataataaccctaaattaactggttcatttgtaggtggttgtgactcttagaactatagagattcctgttagaccttctggtgcagtttgttatgcttgtttttaatgaggcatatgtttggcctaccaccttattggctctagtttggctaaggaagtcaaatggatgtgttcagacaagtttcttttcatctgttagattattatttactgaatttgtcttagttgtagttaactaatatctttgcttttagaaaaacaatcatttgagaataacagttcttactttctgagatacttccagcttcccagtttattttaaaagtgtattacacatgcctcttataaagaattgattttttagcatgtcagactgtaatataatatttttttaccttaaatttttctcttagaagaatcttaaattttattaatttatttatgagttcctctatgatttaggaactcctgaatatttgtcaggtaacctttttactcaatttgtaatgttgtagcctgccgtatgctatgcatggccttcttgaaatgaaccactgtgatattagctaaccctggccttggccatcgttttgcctccttaacttaaccttaaccgctgtttttttaaacaccttctttacctttgtcttattgcagactcaagaatgaataatccatcagaaaccaataaatcatctatggagagtgaagatgccagcacaggtaagaaaacattctcttatccatcttttgcatttgttcatagagctgaaatgagaatgtccacttagcttggatacatagttgacaaatacagagaaatttgtgtatctgcttatgaagtatgatgtagtacttgtagggactgcaattgtatttaacattatctaactcctgaggagtgcatcctttttcagattctatccatcagagaaactagaggtagttatgggaatggtcctttgggacacatagtcctaggtctggattatggatcttcatttactgtgtcatatgtgccagaagctgtcagattcttggttataggtataatcagaatagtagatgtggtctaccctgcatttgatataaattatgctaaagttttgattgtgtcagaagttataaacttgtctagtatatcctttcattttattttaataaaatgtatacttaacccaaaccttttaacaagagaaaaactaagtaccatataaatttaaaaaatgaaactctttgagagaaaggtaaatctataaatatatattcagcccatccttgtaagtcagtcagctcataggacatttgacagtctaactatcatctgacagatacgatacaaaatttcctcagtttctgctagaggcaaaaattaaaacaataaaccatatgaaggaaattatgggcaaggagttatagaaagtcattatcaggcaaactagactctgcttactaaagggtttaacttctctgactaacatttcacgacatgtctacctatgggaggtagtaagaaggacagtctctcttgaacctttgttttccactactcctgatcatagatagaaactttaattacagtagaagattgggttgactcagtggaagtcttgtgtctgcacctgtgtcattgtaaactgtcctgtatttggaaaaacacggaagtactttttaaaaataggtacttctttacgggagactaaggctttcatgttcagctttgcatattcagtatgtccctgcttgtcttgttgaagcttgctgaatagctacagtggcatctcttccccaagatgagggaaaggagcattgcattctgtccagccagctttcttgtttctcttccctgtctggaccccttgtttatcttatcactgccttatgctgatataagtggcctttctaaaggagtgggatttgtttgcagagagtaactaggcaatcagacctatgaataggctcggaagtatgggtaggactcccacatctaaagagtacctcccaaatttctcgaaaggaaaaaaaaaaactcagaatgattacagaatgttgaaaatatccatgatgtcagaccccttgaaaatctatatttacttttaatactacaatttctctactatttattgggtgcctacaatatttaatttcaacctttggtttttttttgtaaacattagtgctatgcatattatctgatttcatttaaattcatatgacaagttagatattatttcaaagactagggagttaaagtataaaaccagagaagaaataaaggcaagtttagactagcacctgtgtaaggtttttctcatgaactataatacataaaattgaaaatttaagcaacatattatgtgttcaaacccaaagtcatttctagaactgtataaaatacattcttgctgggacacttggtgaactttgtgaattactcgccttgtgagaatatgggatgtgtaatagatccttctcatagagctgagaactgtcagtttacacagtcactttctgtgttgtgtccttgtttgttttaagaaacagtgattggcctggaacactttatataaatttaaaaaaaaaaaaaaaaaaagctggccttgaactcctaaagatcctggggcttctccctgaattcagaggcgcggtgacaattcagatagatacttattacgaccagtaactcattttcctagacttctttgcttctccatcaccagtggtagtgattaatattctcttttctctacaaagagaaaattaattgcttttctgtaagatctctgctaatatagtaccatctagctagatcaaatatgagcaggttactaccctgagaggcatagagctcacttcttgtttatttgctgcaatgtgccctatcttcatagacacagattgtttccacattttggaccatttcagaatcaaagcacactttattgatttcttagtgttaagggtatgccgctatgctcttagcgctctctgctggtattaatttattagtttagaaatatagatatgtttgagttctgtgttgtacattagattattactattatatatattagaaataaaattacgggtttttgttctgttttgttttcttttgttttgttttaaagtaggatgtaatgggttatgcccagcagttggaaaattaaagcaggaagattatcttgagtttcaggccaggctagactacataacaagaccttgcttgcctcaagaaaagaaaacgtgaaacacagtgacaccatttgtgccatgataaagaaaatagtagcttatttagatcatgttatgcctgttttagttttcattttaaaattcagtgaactatatagactgtttgctctttttcatttgtttagtaatttgtgtgtgtgggggggttgtttgtttgtttttgtagttcatgaaaaagtccagattttaaagaaaggagccctgaatattatataaaaccaaagtctaaaactttataggttcaggagacagttgtgtcgacctctttttcctaaaatgatcacagctaagagtttgctttataagattttaagggtaatgagaggtatgaaggtcaggcattctgaccatgcattttagacagacaatcttcatatgcacacagaaaatttgtgattcaggtttgttcaggattctgtcttatatgtaaaatgttataggtgttattactagatttggtacaaacagatgagactcacagtcttcttaacaatctaccaaaagccaagacattaacaaaactggttctggatagtttatggtgagttatccaagatcaagcatagaagagcaacataatgttattaaatggcctgcctacctgtctccctccctccctccctcccttccttccttccttccttcgtaaattattttttaagtggggtatagtgtggtacatgactttagaatcagcacttgggaggagttgcaaagaaataaatacaacacaccaaaatagattcaaaagactgtacaactcaaggaacttctttctatcccattagattatacattcagaacagaagctattaagcttccttcacgttgaattttatacttcactatctaatatatttttatgcggtatcagctatcaaaaccaaaaaaaaatccgtggcagagttagaaaagaaattagcttcgtatcccttgtatttgtatctgtttcctacattcagtcagtccttccctcacccccataacctttcttcttcttttttctacatgtggtatcatggcccatgtacatttatttgcatataactggctagtttccacatgagggagatgatgtatttttttctttctgaggttaggtaacgtcatttaatattacacaatcaaagtccatcaatttttctgcacattttgtgattacatttttcgttagaactttatagaatttcgttttatatatcatattttcattggccattcatctgttgacagaccagattccaatttcttgctttagtgaataaagcagcaaggggtgtaaatatctctatgatagattgtggagttgtgggtatgggcccaggagtgacagagtaagatcatgtagtagttctatttttaattatttgagaaatttccaagctgatttccacaatgactacactaatttgcatatctcccaacagtagtgtcaccacatcttctatcacatttgtcgtacttactgatggcagccattctcactggggtgaggtcttatctcagagtagtttaaattcttatttccctgttggctagggatattaacacattaaaaatagttattggccatttttgtttgtttgtttcttttcttaagttatctatttagcttatctgcccatttgttaattggcagttttatttccttggtatttgacttctgcagctctttgtaaattctgaacattagccctctgtctgaagtgtgatataaagatgttctgccattctgtatgtagggtgtcagtttgttctgttgattatttcttttaatgaatttttaaatacacttataggcaaggtaaaatgaaccaccattgagggagaaagtgtacaaattaaaacaagtgggttgggggagaaaccagagttctcatttcaagaagccacatgaatgttgatggttgttgtggcttgcctgtaagtccagccttgaaaagcagtggtagagctttctctaagcaagctggctagcaagactactcagtgaatatggaggaagtgatcaagtatgattcctaacatcaatctcatgtgcagtgaactatgcacatatagaaacatgcatacacaccacacacatgatggcagcagtacacagaacagatggttagctttgtaagaaagttgagaagaagacaggagaactgcatttgtggtctccagtactccaggtgcctactgcacccagaggactcactgcagtgcagtaagataatgattttgatatcaaattcattttacagaaaaatacatataaaaaataagcagtcaacattgagactattccttaagaagtatgtgattcatgagaattcagtataaggaaaaatgtatttccaagttggaaagaaagtgttatggaagacatcattagaggaggtagagtttatgctgcccattgaagaatgggttacagttaaacataatggtggttggcattttaccctcagcatgaagaagcaataaaagctaagatgaagttaaagaaagatgtaccaagtctctctctctctctctctctctctctctctctctctctctctctctctctctctctctctctctctctctctcaaattatggtatgttgtatgatctccagacccttttctgtttagtcattcccaaaattacagaattacattcttgtagagactttaatttagccagtattactacattggctttctttttcattggaattggaattgatcttctatcttgctttgtgtgttgcatgcacactagtgtgatgtgggattctcatacatgctcatgtaaagatcagagcaggacatcaggtttcttcctcagctgctttcccccttgttacaatgggaaaggcttctcactgcacttgttgttttggccaggttggctgtccagccaactctcctgatctatctacctctaccttcagtgctaaggttttaagcacacagaaggctttaacacttatgtcatgtttatgtcatggctcttgcctgtaattccaacccttcagaagtagaggctagaaggaattcaagggcatcctcaactgtagcaggcttcaggacagcctgaactacaagagactttgtttcacaaacaaaccagaaagccactttatttttttagtacttgtagttggcatagtttttcttgctgtgagttgttttatttcagttttatcagataagacacaataaattactttagtctcctttttttatttgttaaggcttacttttttgacctaaggctactgttggaatattctgtacatatttgttaagcccattcgatttatgatgtagtttaagtctgtttgaccttttagattagacaacctatttaaagatgagaattgtcttatttatgtgggtttgattacaaaaactaataaagtattctctaaattaaaaaaaaataaagatgagaattgagtattaaagtaaccaatatttattttgtcatagccaatcagcccttttatacccattagtgtttatttgatacatttgggagttcctttattctatgcatgtatgtttacaattgttgtatcttcttggtggaatgttcctttaactagcatgtaatggccctatttggaattctggcttgaagtctactttatcagatgtcagaacagctccaccaagcttagttttttattctgactagttaacttccctcctataactctcagtctctatctaggtgtaccaggatgcttcttggcaacaaaagttagtctggtctatttttataatcagccagtcagttggcgagttgaggccatttacatgtaaggttgatacacgtttactaatttaattggttgtttttctagttggttggattgtttgccttgtcttgtctttcttccacgctagtaggggttttctggattattgtgtatttttcttctctgtataacattcctctaagtatcttctacagtgctagcttggttgacactgccttagcttctgcttaaactaaaatgtccttatagtttgcctgtcttaaagaatagcttgctctacagaacagtctcagctgcagttcatggactctcagtagttgtgccattccatccttccctgaattttaggttgctgacaagatgtcagatattattctgatgtctttgactttgtaggtaagttagcattttcacgcttaattttgaaatactgtttgttttcttggtattctagacatctgactataaaagttgtgtatttcttcatttctgtttcagattctaagtatctcaacatctgagggcttctttctttctcttgatttgagaaatttccgctataattttgtagatgagattctctgcctttatttttttaatttaattttattttattttttgtttttcaagacagggtttctctgtgtagtcctggctgtcctgggactcattctgtagaccaggctggccttgaactcagaaatccgcctgcctcctgagtgctgggatcaaaggcgtgcaccaccaattctgcctttaatttttaatctcagttcctccctctaaatttggtgtcttactagttgcccagggttgttggctattggattattgtgtggggtctgtctgtccatcattctgttttgtcaccctcctccaacccctgcctcccacatacacacgccacattggtgtttaaacatagtgtttcttcagtcttgtccttcattccttgtcttccttctacttggttgagtctactggtaatgtttggttcattgggtttttcacttttgacatttttttttctctcgattttttttttcctgaactgtttcccacacactccctttctctcctgtgctactcaccttctactgtgttttgttgaggttttatgtcgccagctctctggagatgggacttgattgtgtcttccttgaagtcatggcaatttaactagtgaacttttgaaattgtacttatttcactatctttgaattcagtcattgagttagttaagatgttttagaggagtaatattgccttgcttttttctactttttgtgtttctaggttgtgatttatgtatgttgttttagacatctcttcaagttttattacagagtcttgctgtgcagcccactcttagaaatgaatccccagtgtcgttcagtaaggagaaaactgacttgtaatagcaacagcatcagactgtataaaacacagaaatactctcaaaactcagttaaagcccaccagtctgtaacctatgtactaagaattattcaggataaatgtggggatgattaagataaggaaaggggaaaaagaattgaagaagaatgttgtgggcagggaagatcagaaaagataaaatgagaaatgaacaacaaaaatccccaaaataaaaaattcgacttaaagtgtagtaaagagagggaaatggaaacttgggacaaaggaagaaggaattaagttaaagaaaaatgttgtcttttaagtgctcacctttcttactctctagccttctttttctctctcccttcccccttctctccacgtagctatggctggtctccctctttctaccttctctctttctcttagcctttctacaataaagctctaaaaccaaaaaaaaaaagaaagaaaaaaagaagaaagagaaaaaagaaaactgtttacccagcagtgaaagaaaccataaagaaaatattagaagagcgtgcaatgtaaaatacaaagtaaaacattcagaattcgataacataaagagtgtaataaaatgaaggtactaggtactctaaaattgaaggtgactgattatatggggggggtgctgtggaggggtcagtcatgacgtggtttgtccttatcttctgtttggcttacactggtgctgagcaggctggaagctatctgctagagtaccttctcttccatactttcccttgtttcttacccatgtccccatagggttcatacttagctttgtaatctgtggctgggcgagttctaccaccttctagaaacttagcagttcatactcccaggtgagcactgctctgttctgaagcatctcccagttgatgtggtggtgtggaaagccttaacagaaatgaacctgcctttatactttgaagacctaggtagtaatcacttgctcgaagcatgcagttgtggatatcaggtaaaacctctagaactttagagttttggggatgtacaataatgactggaggatgggtggccccagaaattggacacatccccttgtggacctcaggctcagggctgtgttaagatatgtgatggactttaaacagtggaggtcagcattacctttcccaggcactttgctgtctgagctgagcctccttccacctacatcttttggcttgttagtattgcttctttccactaatgccccacagggatgtgtctggccctgggagttgtggcagattacatctttgtcccaatgccaggcacctggtttatcttttgaagaagccatgcgttttccctcctcttcaagggattaacatttaatgatggttaagattttaggaaaatagctgaataattctcttgtcagtatttgttacatttagccctcattacattattaacctctattaaataaagattaatatagcattttaggtggcctccaatttcacataaaaaagagatctcataactgaaaggtagattaaatttccaattttaaaactatatttttgttactagaagcaaagaagtttctatgtataatatgctcaatatatacccatatgttcctagagtttctgacaggatggggtgggaacaagcagctgcactgcacctgtagcacctttagtcctgagaataggaagggcgtcttgttcttaatagatactttttcccagggcttgggccttttgaacaaattatttttggtctattgaaaatggagaattttttcaaatatttctaggtttgtgtgattctgatgttgcatctgacacagtaacaaatgcatttttatatttgtagaaaaataatctggggcccctaactttgtgggaaaaaaacaaaacaaaacaaaaatgaattgaattagagtctaatttctcaaaggactgatcagtttggaagctactgatgttgtctggtaagtggtaattgtgtgctaagacaaaacaggtttaaatgtagttagaatttggaaaagattatttatagttagtcaggcccttaagttatcccagagaaagtaaatcccactatttaatagtaactgactttgagagctagagaagatggtagcatttaccatctgttcctagttaaggttctctcaagcatggcttttatctcacccacatatatggcatgctgatattctgattcacacagttttaggtcatgttcataggctacagattttcattctagtggagaaatggcaacaggagtggaataaacaagagtgttgtctgcctcctaccaaaaaaaaataatagtaataataataagtggggaaaagtaaatctcctttaaaaagtggatttgagcaggaggaaaaaagtgaaaggaaatacatgtcaggcagaccaacactgaacaaaaatttaagtgatctctgaatataatactcatgatagagatgtgaaaatactgaataatctttcctttagagacaatttgccaaagtttgtcattattaaattaatatttctcaatacagttataaaatttgattctttctttacaaatttgttttgatttaaaagaaatagtgaatgagggctggagagctgctcagtggttaagagcacatgctgttcttgcagaggccctgagttgggttcccagcactcaaataacagttcacggctatctgtagctccagtttcagggctccagcgccctcttctggcctgtatgggcactatatgcacatagtaccgtatatacatgcagtcaagcactcctagacataacatgaaaaataaataaatcttcaagtagtgtaactgggataacctctgacacagaatccaaaagcccctatttctcataccttatgtctccttgtgaccccagtttgctctggttactgattaatcacttagataatattttgcaaataagcattgacttggattccttggtaattggatataggaggcttagttactatgcagttatccagttgaaatgtttctatacattttccgctcatttctacagcaagatcagtcaggttcaggttctttttttttttttttttttttttttcctttaatgatccctttccattttacttttatctaaaatgttgcataaatgaaatcatcctaatgtagctagccttggagtctctctttgaccaagcatagcagagttgagaatcagctgtattgtgtgtttgttggttcagtttcatttcttgtgttgcccaccaaatgttagagacatataaaatatagttttgtagtaaagaggaggtatagatttattggttctatgcttaaatgcagtcagagcttagtactgaagtctggggaggaatccattgtatattgatcttccccttgctgcctctgaagggaaaaacagaactttgtatgagaccactcttcgatccttaaacctcacaaaaattcaaatctttcttagctgggcctgtaccttgtaactggtgctgtccttgggctcatctctcatggtcttcattctgtacccaaaaatattttttccttttcccgtcttttttttttaaggtaactgtgtttatgaatgaagcttgcttgtatttttttatacttatctttgtcaggttatggtatcaaagttatgctgactttacttaatgagataggaagttttgttttgttagtactgttctctggggaaatatgtaaatgatttgaattaattgttcattgaaattttggaagcatttcttggtaaagttatctagggagaagcattctctttgggagagattttttttttaaatctactaatccaatttctttaaatgttgtaagactcttgtattttctatttcttcttgagtcagtcttgaaaaatgctgttttttagagagttttctcaatttcattaagttttggtcttttatcactgttttctttttcttcagattaatttttcagtggtttgatattttcctatagaatttgacagattaaactaccctgttcttcccttagctcttggaaatactagaatcaagagtttcctgcccacttgcttctctatgcattatttctctgtatgcattgtttctctgtatgtatttggatacaagattccagagatccgacctggtagtgctagtctgcagagtctttggctctggccagccatttcttgatgtactctagactcctttggtgcttttcagggtctttagaccttcatgtgtctaatattaatcttcttacatgattcattggccaagagcccagtgaataaactcctggttcctttttccgatgttccagttcttcaagcatgtaaactgaagtattattttgcctctgaacatcgctctctcctcataacagctcatatcaagttcagttgggttgtttgtgtcagaccacctttgtttgttagcctagtttagcaatagtttgtctgtgtaatatatttctgctctcatctcacaatgtctcaaatatcttattaagagaaattatctgcttttgcatcttacattttgtatatatcttagtggttatcttagtgttctttgtacactagtggtcagtcagttataggtacaaaaatccacaagttgaaggctcaggaaagccaagtttgttatactcacaggtccaggagacagggaacatttgtgacacccctggaaaaagcggatagttagaagttaaaaaaaaaactaacagacaaaaaaccaggagggaaaagcttagaccacagagtattcactgatcctaggagaggctgtcgctcctcagccagagggggttttgaggtgccaatatatcataatatttttatggattcagatatttacagtataactactatcctacatcccaacccctaaaagacagagtcatatcaattagacagtattaagtgctgatactattaacagtagtcaactgtactcagatgctggaactcagttctcgttattttagtgccttgtaatttataaggagcttgctatcattttatatggaaactgaatgtagaatcaatatgtgaatttgaatggactctatgcaaattggatatgtaatgttaaacactggcactgttttagaaatactgtagctggttctgatggcacacatttgttatcctagcacttgggaaactaaggaaggagagtcatgagtttgaggccagtctgggttctttgtgagaccctgtcaggggttgggcgtggagtgaaagatatgaatctctacttttatattgaggaaatcattacaacaaaaaaaaacagaattttttaatataaagtgtgatttaactatcagacagcctcttattaaagtgtttccatcagtagtaagtccttcttgctcctcacaaagtcaccagtgaatttcttctgtgcaagtaaaatactcaactaagtagaacaagagtagaagacagcctgagaccctctctcgggatagtctgtatcatcctttccaacattaaaaatgatctcttcctaaaaaccaccataaatgccatgccagttttaacctgcttgttccaatcactgtatctcatactgtgatcagtaacacttcttctcccacccatccccatctcaaacaaggtttctttgtatagccttggctgtactagaagtcactttgtaaaccaggctggccttaaactcacagaggtctgcctgacaaagtcctccaaagcactaggcgtgtgacattgctgcccagctcagaaactcttagagtggccactgtttcagttttgacctgcttttaaagcattgttggtgttctacttgttctaccttttgaagagaaatcacttgtcttagttacttctctactgccatgctaagacactacggccaagacaacttactggagaaagtttatcggggtcttatagtttcagaatatgagttgtggccattgtgagcagacaggcatgatgctgtagaagcggagagctcacatcttgaaacaataacaataaccatgagctgaagggctaaaagagactggcatgggattttgaaacttcagagctcaccccagtgggtcacatatctcctccaaaaaggccatacttcctaaaagagttttcaccaactagggaccaagtattcaaatacataggcctatggggcccttctcatccaaactagcactctctttactgtatctcctttttagttaaaatttttctttattctagagaaataatacatgtatattataaaatatcatcatatccacttcctattttcctccgtctactcctctcctaactccatggcttcttggcaggtgtgtgtgtgtgtgtgtgtgtgtgtgtgtgtgtgtgtgtgtgtgtgtgtgtgtgtgtgtgtgtgtaaaggtggtggtggtggtggtggtgtggtgtgtgtgtgtgtgtgtgtaaaggtggtggtggtggtggtggtggtggtggtggtggtggtggtggtggtggtggttttggtaagtacaattagtgttgcccatatgtatatgggtttggggcacagaaaatttactagtaggcacaccctcaaaatagattgatcctccctcctacagcaactatcaactaccagtggctcctcattagagggatggagcctgaataattcttctctattgtgctagaattttgactggcttgaccttgtggatcttaagcaggtcactacaggtacaagttcatggccatttcacacacggaaaacctttcatagcacttctccccccttctttctatctcttctgttctttctgtctcctgccctcagagtttctggatcccctcccatggtgtccagtttccatttttccaaatctcttcatctctttgaagatttagaaaagtaattgttcaagacaagttcctactgatgttggtaactgtagttgaatactttacttcatttgaatgtactttatttaatagttattttgcttgctttccaggcacacaaaccaatggtctggactttcagaaacagcccgtgcccgttggaggagcgatctccacagcccaggcccaggccttcctcggacatcttcaccaggtagactgttgaccagcagccataactgagaatgctgttaaacaaggaggcatgacatgctagggaggttatttcaaatcctgtgtaactcttctgctcaatgattcatgtggaattaatacgttctgcataactagctattgattctataactgtgtgaacaaaagatttttttgttgcatgggacataatataacagcgaggtcactttttcctatgagcatgagcttgagtctgtgatggcttagtgcggctagtaaaacaccagagtcacttgaaattaagtggtgactaccactaccatgaaactattgtcatttaggtagctactgataccgaccacatgccccccctcccccagtctaaatcagagcatgaattctgttcatttatgttttcactcttttcacaaaaatgtcattagactaccttttttttttttggaaaaaaattttattttttatttttttgttcttcttgaaaataggtgaaattctaggaaactatcctcaaatttgttttttaagcgaagtcaaattggaatgaagaatgtagtttcattttaatcccaggcacgggaatgtggggctgcttcagactgtctgcagcaggtgattatgatttgccttgtgcttgaacagaggcgtggttttgccagctgcaaatagttgtatagactgtatgatgtttgaaatcctggaaatttttcagaggatatatgaatgttagaatccctataggtgggttggtggttgttgttcaggggggttgattgtggcttgttaatagttctgctcaaagaagaaacaagaggaaagatattaaattcaggaatcaatctctttgtctctctctctctctctctctctctctctctctctctctctctctctctctcatcttgtgattggggtaaaaccacgagggtaggcaaagggtgggaaaaagaacccacaaagcaacaaagaccaaccacaccattttgtttcaccttccatttattctagtttatagtcttctccctttttagtctttcaagacattaacctttgaggggctgcaagatagaagaaaacaaactccctcaataaataaataaacgaatgaataaatatttaatttttaaaaagactaacaatctcagcatctgtggagagagagtggtgcacatgtaaattcttattctcattttgtccttacttagatgatctgatggtgactcttttctaaatcaggttgctatcatgattgcaaaatgatagttttctaattgcctgtctgtcccttaatatgaccatgatttgaacttttaaaaatatgcattaaatattgagacagattttttttcccctgtggctcataggataaattctcttaactaattcttttgttcataataatagaaaacatgcacgggcatagtttgtttgggagatatgttatgttttagaccctaagcaacttataactacgaatagagtgtaaaataaagagcagccacccggagagaatggcatgctgactgatggtgcgcgtttagtgatggtgctaattcaaaagaagttcctgtggttttcagttggaggggaattatgagcttgtatgtaaagttttaaccccataaaataatatctttcaatgttcaattctaagttggtggtatatcttagtatctaaagtatttcttgataacacctctagtgataaatgagaatactttagtttattaggtccattattaactactttcctcttaggtccagctagctgggacaagtttacaggctgctgctcagtctttaaatgtacaggtaagttggaatatgagcaaataggtcatattttctatttatttttccataatttcctgtaatgagcacataatttagaaaagaaactacttgcaattgttactttttattaattttattgtttttacaatttttattgctaaatccaggtggtaatagttattaatggaaatcagtttaatctgctgtgtgtgtgagccaaaggtggacaaagaagttgagaatgaagttcaggaacacacactaaacccaaaatgaaacagcttctcaagtattactctattttcccagactgtgtatcattattcaggaaacactggctagagaatcagggaccttgagttcaagtctcaataacctttggcaagttacagcctgctggaggctttgtgtacctgtatttaaataaagacagcaatagcatcttctctgctctgaacagaagtaaagttaaagggcactggagtcatcacccagtggttaagagcagtgtacattgattgatcttacggaggactccaattcagttctcacgtcagggtaatttgcacaactccataacacttcagtcagcttttccttatagtgtttgggaaactaactgtcaagaaggaaacacagtattctagaagattgatctcagtgatgctgatgactaaagatttggggttgaacattctctgaaatcttgtggaatatggacctagtaacacatggaaacaaggagagaaaaagagataatgtggtcttcctttctgagagagaggaggcagaaaattgccttggttgccatggtaaacttaacatcccttagagagatgttggcaaacaggctatatctccagtgcagaatgtttacagtcctgcactgtaattatctttcagtgactggcagaattaatcagagcttttatgttaattagcttcgctgtagttccccaaacaggtggtggaaaatatgcaaatctatgcagaattttgatactctgcataaccagttttaattaccataaaaaatttctttctagccctttaagacctatatttcttgactgtattgttttattttgttttgtttttattttgtttgtttgtttgtttgcttgttttttgagaaaggatttctttagcctgactgtcctggaactcaaaaactctgtagaccaggctggccttgaactcgagtgattagctgcctctgcctgggtcttcccagtgctgagattaaaagaatgcatcaccactgtgtttgtattattttctttcaatcttgtacattacttggtgggaaatgttgcacttaagagttctttaaaataaaatttaaaagttctgtgggtcaagtaattgaattgtaagatggtatataaaaaggtttgagacttgccacaaagtatattcaaagtgttagtttgaagggtctaataatagaaatgaattgaaaatgcaccctttcttttattcttattgcttgaactagggattttgaggttattaaaggtttttttaatttgtgtaggaccaatttagtttttcttttaaaaatttataattgcaatttttctgaggttagaataaaatttaagagtgcaccagtagacaaaaaggcataggagagagaaaggaaaaagagaaaaccccaaactcaaaattgaatagcacatatttaaataattttttaataacagagttagaagtacatttcttttaatcacctatttgagatactttatttcatttcctacccaactccatttcagtctaaatccagtgaagagtcgggagattcgcagcagtcgagccagccttcttcccagccgccttcagtgcagtcagccattccccagacccagctaatgctggctgggggacagataactggggtaagttttccttgagaatgttgtaatgaacttcctatgtctgaacagccactggttgcatctcattaaaatggttcactacatccggccctagcatgcactactgtccataaggagctgacggctagatgtggagtgctcctctggaagaggagttacttttgccattctttacaagatgtctttttgttacagctgcaggcattcaaaataaactactaactttttaacccacattaaaaaatagtgttgcttcattgtgcaagggagttgttgccatacgcagggtgaaattccagttgtgtcatggcaggacaattaaagagtggattcataaagaaacatgtcttgaactaccctgaaatagaatatcctgtgtgtgtaatcactaatcactcagggtgagttactttctctctccatacctcactttccccttttctaagtggaggtattaataatatctcttttaagtaccattgtaatttatgcaaagctcttaaaacagtgcttggcatgtagccttcagtaaatggtagttattttgacttgtaacaaattgtcctccatgactgttaagcttttacatgtttagcgatttctgttctagactattatttgggatggtgtttcagtgttgaacgcgtatgtgacgaggagaagggagagaaggaaggagctaatcaggtcccagcgcaccaaccttccgagcttccgtagttaatttcagctgctgtgactgcgctgtcgatgcttcttctaagagtgatgcacacttatgtgcagtatttcatcactagagattattaatatatgtacttatttaaaaatataaatatacatacacacattttaaagagtagggaattttttaatagttttgctcaggttcgtgtgtttctaataaaattgattggttaaattagaccctgttagtttagagggcaggctgtgatgctaaatgattgttcatgagactagatatataacatggtcctttcctgtttgatcagaccatgtcaccaaaagaaaggcccagcacacttactactttgatgtaagcatatttgaaatgatgtgttatggaagtttatgtttgttctaaatacatttcttgctttattgtcagggtttgggttttggtgattagtgtctaggatagatagatagatgggaacttggaattccaggttcatgtaccttgaagactattaattctgggtgtttagattcatttgcatttaagagggtggctcttaccacctgtttcctagagataataagttggaaaaaaatgtaaacttgcaaaccaatgcttttcaagggcaggagattgggtaagggagggtcctggaggaagatttttaaaggaaacaagtgtggctcctgatttttagtcacatgtgaagatgtgatggaagtagtgaaatacgatggggattcaagcagctgggccttaccagttctcttcctgcacctgccagcatccttttgtccctcattcatcacctgctgttggatataaatgtctttgcatcctgtcagcatcagtcctttgttttcattccttgtctaaatgattgttcaagtctgaagtgcagactactttaagttaaatgctgtggtagaacaggtagtttgttcattggtggacaggttagctgtacattgaccagtagtgagaacctaatcccacttgagttacctatttaaaggcactcaatctttcccttcattgttcttactctagctcacgttgaccccagcccagcaacagttactgctacagcaggcgcaggcccaggcccagctcctggccgctgcagtgcagcaacactccgccagccaacagcacagtgctgctggggccaccatctcagcctccgccgccacacccatgacgcagatccccctgtctcagcccatacagattgcacaggtgaggaagggaagagcaaggttactgggacagcaaacagccaataaaatgggaaattctcttccatattgttagccttctggttgctgctgtgggtctttaaacacccaaggaactctggttcaaggtggcattatcgcttcttcccttttgcttatttgagttgatattataaacatctagctggttatttgaataagtgaatgtttatgttaaatgaaattcttgagtaagtagctggcatatttctgaggcaaggggtttcagtattcatcttaattcatcttattagccaatcatagcaggcaaaaattcttccatgtgctctatagtaagtgttgccaccttgtaaaaaaagacagcaagtcatctttctgctgtggagtgactaggaccatggagaactgcattaaaatgttacagggtttcagtttttacgttttcaaataaaatatccaaaggtagtttaaaaattacttagagtcataaagaattataacaaaagagaaaatatgtgaccttgtttctctcaagggagggacagggagcctgagaagttgatgtagcagaagcagggtaacagtctaagcagagtaactcctccttctgtccccagggagggggtgctgaaggtgtgacacagtttgacgagatacttgaaatagactcagactgatttttattattactgtgtggacatctgtatcaagatagtgttttgatttgggccattttcttcatcaaataaattatgttagtgcctaaactttgagactttacctgaaattaatataaatagaatgatttatatgaaggcattgaaaaatgtaagatactagagccaatataaagctgtattgttttgttatatctgacttttatgtgaatttttaaaataacttaacatcaattcctaaattgaattggataagctggtgtcaaatttcaggaatcaaatcttttattttattgatggaaattttgttatatcactcaatttttactttagaaaaaaaaatggaagccaggtggcacacgcctttaatcccagcacttgggaggcagagacaggcggatttctgagtttgaggccagcctggtctacagagtgagttccagggcagccagggctacacagagaaaccctgtcttgaaaaaataaacaaaaacaaaataaaaaacaaaataaaaaaaaatgggtcaaatattcaaatccctttttcctcacttaatttttcaggaacatttagtctttgtttagatcagagctaaatgaacagaacttatagaatgaatgcatattaatttattagcatttattagagtagtttacaggctatggtctggctagtccaatgatggtggtctttcagttcatgcagctggatgtcttagctagtctttattccgtcttgaactcttctattaccagcagaggaattcctcagcaacaggatagatgaatataaccagagggaaagagcacagagacaggaagcaaaagggtccttcttccctgttcctttatgtgggctatcagcagaaggcacaggccagattgagcatgggtcttcccagctcagatgagccgatcaagaagagctctcagaggcatgcacagatgctcgcattttagttgatgccagaggcgggcaggttgccatccaaggttacctatctcagtggtggcaggtggaagtagagagttaactccagacttgtcttctgatttccacatgcatgtgtggcttacacaaacctcatcacacactaataacaataaaactaaaattgaaaactgcctcccccagaacatttattctctattcatttattctgaaagtattttaggtaaccattgaaaattgggcttaacacaatcatgattctatataatatacatcataacctcaaaaataacttcttgcagaggccctaagttttttcagttttgtttttgataattgctgtttgtgtgtgtaaatcaaaacaattctcaggagtcagttctctccttccaccgtgggtctgaagatcacacttaggtcttcagtcttgcacagcgagcactcctacctactgagccttctctggcctgaggcctgagcatttctcacacactgacactgttggaagccacactgttgggacatgaaaaaaagctgagtattgtctcattgttatttgatgtgacacaagtctttgcctaggaaccttacgactaatccagctttcatttcaggatctctctctaatctgtgttttgcttctgagcctttaggatcttcaacaattgcaacagcttcagcagcaaaatctcaacttgcaacagtttgtgttggtgcacccaaccaccaacctgcaaccagcacagtttatcatctcacagaccccccagggccagcagggtaagcgtctctctaaagctcctcagtggtgcaacagggctgtgcactttgacctaacagtgtccattcgagcagtgctttcattcagtgtggtttcaaactaccagtattgatgagaactataacagtgccttaaatcaggaacatggttacatataagaataaaagacctgaaaaaccagtaaaggctagcttactaaaggaaatttccaggactttaacctgaaatcatgcaacttaattgtttccaaggctcagtttatttgcaaatcactggataaatgagaaaggtagttttctgagtctcattccaaaattttaactagttctttgtgaagatgcatttgaatgtctgatatcttccaatgttttctgtgggatatttgaaaacaaaacactaaagtaaaaaagtggcattagccatttgtattaagaaagcttgtttacactggaacttggggaggttagaatagtcaagagtagatttagtaatacttgtcagcagagttttgcaaggtcgtgttgagatgctgagctatgattatgagagcaggagagagaagatgatatcgcagatagacaagacttgggcaaggcatggtagaactggcctttaatcctagcatttggaagtcaatcagaggcaggaggatctctgagcttaaggccagcttggtttatatagtgaaagcctatctcaaaataaacaaaataatataagaaaggacttggtggccagttacgtttggtcaatggtaaggactgggtgtctaggtgattaagtttttaggaaactataagtgttggtaggtcatagaaagatgtattcatgataatgagcaagcttcagtaagcccagcactttgaaatagcagggatacatagagtctgaagataatactgttttggtttgtggatcagaaccaataaattgttttgtcttgtcacaagctcatatgcaatgtttcaacaacatttgaaactaagtacatagattaagttcttcaatgcaaatatattctgggttgcccctgtttttataacattgcaaaaaaaaaaccaaactagacaatagcaaaaccctatagagttcaaacatcaactgagtacatactacaaatgcttccagggctcaagacaaagtctcactatgttgtccagcctgacctctaactttggggctcgagtaaccctcatgcctcagagcagctgggactgtaggtgtatgcctttacatccattttacttattgaaaacttttaaactaggattgtccagtatggagagttgctaacatgtcaactttcatcaatgaagagacatgtcctaaaaacttgaaaatagcatctcccacttagaggattgcctgcttctttcagaaatggtttctcttattcccagattcattaaagcagtagttctcaacctgtgggtcgtggcccctttgggtttcaaatgaccttttcacagggttcacacattagatatgctgtatatcagatatttacattacagctcttttttttttggggggggtgtttgagacagggtttctctgtatagtcttggctgtcctggaactcactttgtagaccaggctggcctcaaactcagaaatctgcctgcctctgcctcccaagtgctgggattaaaggcgtgcgccaccacgcccggcattacagctcataacagaagcaaaattacagttatgaggtaggaacaaaataattttatggctggggtcacagctttgggaaggctgagaagcatgtcttagaggatttcagtgagttctgggttaagaagttgaactcatcttgaaatttccagatgctttgatttcaagtagttcctcacattcttcctctccttgggaaataagggcctttcaaagagtttattcagattatactaaagacacacaagctttgatttaatgttatggattttcatgccatgttgtatttaacacaattaacaatattaaattttaggaaaagaaactagacaattcggaagacaaacaaaactaccaggaaattggttgggaactgtttatattcttttttttaatccccctgaaatgtttgattttcacaggtctcctgcaagcgcaaaatcttttaacgcaactacctcagcaaagccaagccaacctcctacagccacagccaagcatcaccctcacgtcccaggtccgtgttcttactcaattgttttgctaattgaaaaatgatacaaaaacaccccagcaataacaatctccagtgttcagaaactgacccaaaacccaatgttgggcttattagcttcataacacagcattgccaaattgatggaaacgaaatttttcataattctttttaagttaaaacaaaaacctatgttagtaataagtggggatgaattaaagctctctgatgctgatagatagtaacactgaaatggaagacctaggaaatgagttaaaacctgccattgatcctttgcccttgctaaaacagtacaggagcttggatttctgtgtcacctcagtacttaaatgtggtgttgtgtcatttcctctacaagacataacagtcataatccacagaaagcacaattcttaggcatttgaaatttttaagttgcatatttgtgttcttaaggagtgataattgtgactatgcatatcagtttgcagctccggttttcagtctggtcatccttactgtctgaccttgattcctcacttgctttttacactttctaaatagaaagaagttggggatgaagaagtgaatggcttagtggttcttgccacgcatgcaataggaccagaatttatatcctaagaacccgtttaaatacctgggtggacatggcggctcatctgtacttttaattgcaggatctcctagcctattggcaggctctgggaagagagtgatcaaggcaggtgaatttcctacatcaacctctgccctctgcatgcacatgtatacacatgcgtgtatatatatgtatacacatgcacaaacatgaaaagaatgtgtagtaattaaaacttaattcttaatatattactacatttcttaggctgaaaatacagaaggtctgctttgattggcagctgtagtaactatagttacttgccctttgccactgagccctccgtctaggccccggtaaccaaagaagagagtataggtagaaaactagaaggaccagctaatggcaagaattagtaccaaactataataatgaatatgtggtattgtcatatagagaaaaatgttggccaatgggataagagaaaatccaatagacagaaatgtaaatagccagctaatttttcaaagggaccaaaggattccaatgggaaaaatctttttaactacctgataactaacaattggctattcattagcaaaaggggatgcagaacacccgtatttcatactttacacaaagattaatttgaaatgagtcataaacctaaacatccaggaagaaatgcatatccattgggtttcttaaacaggacacaagaagccttaactgtcaaagaaacaatgaacttcaggaaaatttaaagctcattttaataggaagaaaaaccacagttaagaagaaaacagtctttttttttttttaattgataaatgattttgttttaagatttatttttaattgatgtggggaaggggaatatttgtgcaggtactctgggaaaccagaagaacacattgaatcgcttggtgggtgctctccactagcagaatacactcagtcactgagctatctctcctgccagggtaagagaattgtaactagaataaagagcaatacagctcagccgtgagacaaccagataagctaatgagaggcaagaaaacttaattgccagtgaagatatgttaatacccagtaagcaagtgaaaccatgctcggagcattagttattaggaaatatcagtgtccgttcactggagtgggtgcagttctgaagaagcatctgatacaagtattgataagaaagcagcagatagctccgaaattactagtagtaaaaagttgcaaaaaggtactcacactttgtaaattagtttgacattgacttagaaattaaatataactacatagtacagctcagtagttttgctctttaaaaggaaagcacaaagatatgtctatgaatgcttataaaagattatcaccgcaaactatcagatagtaagttacataaatttctgaatagtcatgtgacagacttactctgcagtaagaagtaatgtccttctgatacctgcagtgacatgaatgactttcaaaagcctcacactaagtgacagaagctgggcttaaaagattgagtatcaaatgatttcagtttgcataacattccagaaaggacagaactgtacacatagaaatcctattagtccttgtcaggaagtaaggattaatgatgaagaggaggaggacaggacaaggaggaagaagtggagtgagtggcaaagggttcagaagaaattcggggaggattagtaaagatatactatttcttgtgttagtaattacacaactatatacagttgcaaaagcatcaaactatactgcagttttaagtttagtttttttaatatgctgactgtaaaataaataaaattggtgttttgatatatataccacagacctctttctggcctacgtgctatgcacatggaggacttcatcctttctcctgctaattaaatgctatactaccattagctctgtcccagctcagacaggtattttagagtaagataccagctgtctaaaggtacccaggctatttttagtccattattatttgacaaagagtctacttgatgctgaagatgaagtaacagattgatagttgaaactgacctccacctatcagccatggtcactttggtaagttttcagcaacacaggattctaatatagttggtaccctgggtagctcctccaaaagctgaagttaaaattgctcaatgtcaggatgtcatagagacctgctttattgtctttattgaagcaggatagcagaaggatttgccccaattatgatgtcacgcctattatgtacttttctgggtcagttagttccctaggagcaagccttattaatgagatgaaggtcaggttaggattttctttttaaaaaaaagaaagggggctggaggaatggctcagtggctagaacttctgactgccttgtaaaggacctgggtttgttttctaatataacttgtctctaactccagttccaggagatccaatccccttttctggactctgcaggcactgcacacacatggtgcacagacatgcattttatggacatacataaagtaaaattttaaacaagaaaggagagccctgggctcagtctttagtataaggaatagtgtggtggggtgtttaaaaaaggtttcacaataaaactctagatagatttaaagttaaaatgcagaaaataaggtatcaccaggaaggacttttctcttttttccagaaggaatttgattactaagaaataactaaagttttctttctcaaagatataatagaaatggggggaaattcataaaaatatagtttaaagtttatatatactgaaaaaatgtttaaagactggttaaaaaaaattatttgtactactatgataagaaaatagtttatataccataatattgaagaaatgataaggatgagaataaagatattattaatgtataattgtgatctgaatctggtacaaggaaatataggcaataagtgacacataggaagtctcttgctttgagtagtaagaaaagtattatgtcaaaatgatataccacttgctccctggtatagtggggcacagcatagcttattagaagcatgacactgtttattaagttgctagaaaaagactttgtgaatttatcttaactttttgctggtgttggtggcacctatttaccctaagttctgtgaaagttgaggcagtgggattatatactgaattaaaaactaatctgggctacagagtaagaacttctcttttaagaaaaagaaaatggcggtagttggggaacgggtatttctttgtcctggttttcttgagacgttcttcttctaaatgcatttatttatcatacggtgtatttttatcatcttccccatcatcctcccagacccctccccaggtcatgtctccagtgcaccctgcttgtgatctcacccacctagtctcttgctctttgtctctcgtccttgcttgttttttaattaaaaaatctcatggagcccaacttgtattggctgatccaggggcctcccctggaatgtgactagtataccaggtgtcacctcattgaagaaaagggatttttcctttcctggcattaaatgcctgtaactcctcagctaggggtggacctcatacccaccttctctcctccgtgctagagttttgtctgacttgagctcgtgtgagtctgtttccttaagacgccagcacgttacattagaaactaaagtgtctgctctctgtcccttctccaacagcctaccaccccaactcgcacaatagcagcagcctcagttcagacacttccacagagccagtcaacaccaaagcgaattgacactcccagcttggaggagcccagtgaccttgaggagcttgagcagtttgccaagactttcaaacaaagacgaatcaaacttggattcactcaggtaggatgaagttcactttcttttactgtgataaaacactgactaaaaccaacttgtgaagaaacaggctttattcagctcacaagttctagcctcttgctgagggagtcaaagaaggaacttggtggaaggcactgaagtggaagcatagaagaactctgcttcttggcttgttccaatattcttaacagcctgggtcctccaccatcaatcagcaattaagaagtactcacccgcagacatacccacaagccatcctgacaggtgacaactcaattaagattctctctttccaggcctgtcaacaagtgtagccatcacgatgtttgttctcttacatatcctttcttggctagctatggatgctttgtaaatactttgtaaggaacagaatgtttcttggtcatattgactttgggtttagctatagttgtttttctttttcttttttcttttttttaagatttattttatttatatgagtctactgtagctgtttccagacacatcagaagagggcatcaaatacctttacagatggttgtgagccaccatgtggttgctgggaattgaactcagaacctttggaagagcagtcagtgctttccacctctccagctcctgtagttgattttcttatagtcatttagcacttaaaattttggaatattgtgcattcacttacgctatgctcatacatttactcatgatataatattaggttaaaaacttgcaaatatgtttcacaaaacaggcctctgaaaatctgtcagtaagctgtgttttagtagattgtgttggtgacaggactgctaaagagcatgtggaagagctaactactgcaggtgaaagtcgagaaaatatgaatcccagagtctgttggagactgacttgaagcttgtttgcaagagactgtgctccctcctttcttagtctactgagattagtcaagtaaggatttagtgaagattttttaagtaaattaatcaaaatcaaatcttttaatgtcagctaccagagggcttgaaaagtgaaatgaatatgcttgctggtttaagcaagcatttgggtgcacagcatggtttttttcctaagcactgccactggctgtactccctgattagcctgtcaaaaataatgctttgaaagcaggaaaggaattaaacttataatggcaaaagatcattagctgaaagagaaaaaactgaagtatggattgagttgtgtatttatagaataagggaaaaaaaccaatctgatgttttctttccagaaacgctcgcactcacagagtttccaaagtaggttgtgttgaaagtgcacagcgcacctcctgcacttcctgtggatcagaggcaaggtcccatcgctgtctgctgtattctgcatgtcattagggacttcaatttattttattccttatatctgaggatttatttttgctcaaagaaactccatattaggaatttacaatagatacaattatagatgaattgcagttacattttgaggagttttagatataaagaaacaaattaaggggctgatgcttaccaccaagcctgataatctgagcttgatcctccagaacctgcatagtgtatccacacatagatgcagctgcatatatacacatacaaagtaaattaatgtaaaaaatttaattacagtccagaaatattttagtaattttgaaagaaataatatgatttgttttaaacataaaaataaagataaactagattgatacagataagttaatagactaagaagacagtttaaggctagcacattaacagtgctaggttttggttggctgttagcacattatgctctggagttctctggtaaatggtttcataaatgctaagtcaaaggtgttagcctttcaaagtccaccttttaaccaaacattggttccctttccctttcttttgcatttgatccaaaatattaccaatgtggataatcatttcctctctcctcctcttcctccctcctcccctccctttttctcttgtccccacttctcacccttctcttccacctccctcatacacatcacaccttcatcccagcatcttattctactttatgatttattttgttttgttcttggcatgactgctatgtattcttcaaaatggccagacagatctggaatggtttgtaaatcttacctatctggatcaaagtatttactactggtacaggatgggaaaatcagctatctttttttaaattcatttgtgaaaattttttaatgaattgtgcagttccaatgtcagtaaacatttattgccacgtaatatcatatgctcaaaaaatgttttatttggattcagatttctagaaagctatagtctaaacgaataaaatggtgccatgattatgtgtggtttgtaaaacctgagtggagtccctggtgtgcggtggcggtgatagaaaggggaaggttagtgctcctgcctcgccatagctttaggcacatttgtataaagcataataatccacatcagtcttagttagaggtcattcatttgcttttctgcaatttaaatataagtcttcacatgaggggcaactaatgagaggcatagtgtatatctctcttgtcttggggttaaatatttagtatatttcattttattttgtagttccacatttgttctattttcaacttcttagtgagagttgttcatagttggcatcttggcacatgcttagattcttagcacttgagaagccaggttttcacaagttcaagaccaggcacaactacataacaaatttgagaccattctgggctacatgagaccctctatatcctcataatagtaaattaaaatgagcaaaacatgtttacacatacttttaaatatatctttttcatgaccccacatataatagacaatgtaatctcaaaaagatgaacctgtggaattaaaaaaaactcagataatcccaactcaaaattgtgttcctaaagcagggcataataggcacaaactcagagtcctggcccttgggaaatagagacaggaagatgacaaattcaaagtaagtctgggctgcataatgaatcctggtctcaacagattggagctagagaaatgaccacttgctcttcttgcagagggtctgggttcagttcccaggttctttatgctgacccacagggattataactctagttccaagggatgcaatgccctcttctgtggacattatacacatgtgttgtttatacatgcatataggcaaaacattcttatacatgaaataaataaaaatctaaaaataataataaaataacattgccaggtttgttgagaattgactctcacaatagatagagaattttggaatctgtggaattttgaaggagaaatgctatacttttctgtcgtgtcactaatctagttgaagtgagtgtgaaccatttaaactccaggagttcctcctgttatctataaaataactattaagatacatctttttcaaactagaacaaaagcgatccagctggaagaaaagcactgtgtacatttcaaaggtgataggctcgtggagaaaggcatcttttgtaatatattcagaggatcattgttctgtttcagtaaggttaccaactttccagtgcccatgaaggttttactaagtgggtcaaacctctctactgtgaatttctactctataatggctacaaatgtggtcctttagaatacctggttttgtgatcaactttgaaatcaaaactaagggtgaaaatagattttttttcacagcttccagaaatacttatgagaaaaactataaagaatgtgggagcattctaaagtttaacgtaatttatgtgaaatttggttggttcagaagtccttgatttaggggcacttgccactaagcctgatgatttggggctcaatccccagaacctacatctacctacagttaagggagagagagccagctccctcagttgtcctcggaccgccacttaggcaccatggccctcctggattctcatacacattaaataaataaataaacaaacaaataaataaaggtgaaatgataaataaattgctgggctttctgaacatctatgttgcttgtattactggaagggctttagcgtatcagcactatctttgaagacttagaaatgttggtatgatggctgagctctccctatggtcctaggctctacttgtaggtgaagttggtgggagaatggagtaaatagaacgacagccagttttctgtctagagcaacacttactgaagtagcctttcaaaatagaagttagagacattaataacatgagtctcttttcctcattcccctttcctgttctatattattcagggtgatgttgggctcgctatggggaaattatatggaaatgacttcagccaaaccaccatctctcgctttgaagccttgaacctcagctttaagaacatgtgcaagttaaagccccttttagagaagtggctaaatgatgcaggtgagtgaacatagaaagaaatctcttcattgtccatggggtttcctaggagggattagtctgcaaactgggtgcttactgtattgctgatactacaaagtgttggatccactaaatctatggaaatcatttgagctaggtctaaggatggacatagattttttttttgaggataagggttagaaggcctgtgtgtgtgtagaaaatcttaaaggacagacagattattccttccttgagtagattgccatagaatttgttcctggtaatatttctgcttttgttaaaaatgaccagctatttcatacaaaattagatttctggtcttgaattatttatttaactttgagacatccttttaaaaactttgaattttgagccacaaaatcagacttcaggagctaaaaggaaccacaaagnnnnnnnnnnnnnnnnnnnnttgcaaaaggcatcaaactatactgcagtttttaagtttagttttttttaatatgctgactgtaaaaataaaataaaattggtgttttgatatatataccacagacctctttctggcctacgtgctatgcacatggaggacttcatccttactcctgctaattaaatgctatactaccattagctctgtcccagctcagacaggtattttagagtaagataccagctgtctaaaggtacccaggctatttttagtccattattatttgacaaagagtctacttgatgctgaagatgaagtaacagattgatagttgaaactgacctccacctatcagccatggtcactttggtaagttttcagcaacacaggattctaatatagttggtaccctgggtagctcctccaaaagctgaagttaaaattgctcaatgtcaggatgtcatagagacctgctttattgtctttattgaagcaggatagcagaaggatttgccccaattatgatgtcacgcctattatgtacttttctgggtcagttagttccctaggagcaaaccttattaatgagatgaaggtcaggtaatagaaggcctatctaaattacaagaagaaaatcctggttcatagtctgtcacctggggctgctgttgatagaaggaagggttcacctgagtaattaggatgcagtattagtgagcatccagaaagaaggcctactcagtgcttgtgagtaccactacagagcagcctggtgttggaataataagaaaatttaggattttctttttaaaaaaaagaaagggggctggaggaatggctcagtggctagaacttctgactgccttgtaaaggacctgggtttgttttctaatataacttgtctctaactccagttccaggagacccaatccccttttctggactctgcaggcactgcacacacatggtgcacagacatgcattttatggacatacataaagtaaaattttaaacaagaaaggagagccctgggctcagtctttagtataaggaatagtgtggtggggtgtttaaaaaaggtttcacaataaaactctagatagatttaaagttaaaatgcagaaaataaggtatcaccaggaaggacttttctcttttttccagaaggaatttgattactaagaaataactaaagttttcctttcctcaaagatataatagaaatggggggaaattcataaaaatatagtttaaagtttatatatactgaaaaannnnnnnnnnnnnnnnnnnnttccatcttgttttcatacagtagaaagaaagccattgaaacatgcccaggcttattcagtgtttcctaagcttaaagaattccaaagtaccctctctcaactcttgtgctaagaaactgaaaaaaccatctttaaattaaacattaaataatccaatgaattttaagaaacattgttcctttttatcctcagcttataaacaagcaaatgtaccgaactgagggaagtgtaagtggaggaatagaacctttgtattctcagaaacaaaccaaaaatgagtggtgacaaagttaaccgccctgggataaaggttgccagtaaggacagtgggaagtcaacagtcctgagcaatgcttccatggaatctcacattactaaacattttaccagttttcttgttcttatgtattctgatatgaatccttaagctcagctgtttgtgttttcttcatttctgtagagaacctctcatctgattctacagcatctagcccaagtgctttgaattctccaggattgggggctgagggcttgaatcgtaggaggaaaaaacgcaccagcatagagaccaacatccgtgtggccttagagaagagtttcatggaggtgggtgtgacttttcatgtgtacggcactgttggggactgcagagattaaagcatatccttgtcttcctccgccctgtgggcatttaacagggagaaaggaggataccaggtgctactgcacttcagcgctgcagaactcgagagagacaatggtttgaatcatgtgagcttttgggagggagctaatcttgcagactggaaaagatagaagagtacctcacacagagccatctcataagcataggcctccagaggaaaccatgcctgttcagacaaaacactggtggtttggctggctaaattttagtgtctttatgcctagaatggtagtttgggggcacaacactagagacctcgaatatcctattctggagttcaaattaattcaacagatatttggctttaaaacaaatgaactttctacttaaggaaacattgaatcaggagtctttcttgtctttgcctcttattaaaggcacatcacgtctcttgatttcaagatgttcctgcgcctataaaactgccttccattcctgtctcagaagcatagtgtgaggtccgagttagtatgaatgaagcactgaaaactcaggcattcctagtagtccataaagttgtatcactttgataactttcagattaatagactttagccaggcatgagacagctaatcccagtgcctgggaagcaaaggtaggtggatctttgtaattttgaggccaacctggtctacatgcagagtcccagggcagccagagcgacacactaagaccctgtctttaaaaaaaaaatagacctttacagtaaggatcacttattctgttcataaaattttagataagtgtagtatgtattaaaacacttttgtagaagttgttgctaaagtcttaatgtggtcataaatattctaccatgcttttctagctggcttcttcctatgggtatactagttcataaagttatttcataaagttggttatggtggcacgtgcctttaattgcagtactcaggaggcagaggcaggcagatctctgtaacttgaggtcatcctggtctacatagactgaggtttgattcctaaaaccccacatagtggctcagaaccatctgtaattctaggtccaggagattgaacactatgtcttctgacctctggggtcagtgtacatacatgcaggcaaaatacacatacacgtaataaataaatcttaaaagaaacaaagtgttctaaagctaggatataattcaaatgtagagccattatccctggattcaatctccagcatggcaaatatataacatgaaatttttaaaattttaaaagatgggctttttttccctctcttagaatcaaaagcctacctcggaagacatcaccttgattgctgaacagctcaatatggaaaaggaggtgattcgtgtttggttttgtaaccgccgccagaaggagaaaagaatcaacccgcccagcagtggtgggaccagcagctcacctatcaaagcaattttccccagcccagcctcattggtaagagtggatgtggaagagatacacacttcaaggactcatttttagtgttacagatgtcctggaagtaaattcacttcctaacagttgtcttagttactgttctattgctgtgataaagtaccatgaatgatcacagtaacttagaaaagaacacatttcatttcagcttagggtttcagaggctgggttcatggtagtgatgcaaaggaacagcagcgagctcacatttagatcttcaagtggtagcaaaaattctgggaatggaataagcttttgaattctcaaagcccaccccccagtgacacacctcctccaacaaggccacacctcctcatccttcccaaccgtccatcaactggatttaaacatatatgcctttgcaattatcctgattcaagctacaactttgaaggaagtgtgtgtgtgtgtgtgtgtgtgtgtgtgtgtgagagagagagagagagagagatacatgttaaataaatacataaaaatgtctactttaaatattttcaaaattataaaatctgtcattgtgaactgaagaatttactgctttcctttatttctggaagtaaacaatttgaagtcttttgtgttcttttggattttcatctgtggctaataaggttccactgtagctataatgactcctgaaaataatgtgtccctttattaccgttcagtcctgaaacccattttagtaaacttacatgattaagtgacagtaaattttcaaggatgaatagtcaatctcaaatcttcactcttggacagtaggtcagccttcatatagacccttatttagtcacttctgccatttgcattagaacattattcctacatggaagagacatgctgtggtcatgggacttaacttttcttccttttagaataattgtagatcactgtcatgctgccagacaggcttcaaaagaaggctaataatgcacttatgttccttttgttcttgttgctctgcttctattttattttaatgttattccatgctgcaacctctttccctttccacttagttctttgagaaaggttttctctgtgtatccttagctgatctgaaactcactatgtacacccaactagtctggaactcacagaaatctcatggcctctgcttcccaagtgctggaattagaggcatgtagtgccatacctggctctacaaagttgtttatttttaataattaattttattttatgtacattagtagtctacctactgcatgtctgtctgtgtgagggtgtcagaacccttgatactagaattacagttgtgagctgccttgtgagtgctgggaattgaacccaggtcctttggttaagaatattcagtgctcttcatcaccgagccatctctctagcccctcacaaaggttttctttaaactaaaaggttatgggttattaagtgggaatgctttaatcataaaatttatgtcgtaacaaatcatagccattagataacagttctgtgtaggtgattgttttgttttggaggcttaactgtcatagaaagagggcagggtcttataaaactgtaaaatatttattacaatagttcaaaaaatgcaagattgtttttaaaatctttttcactagagcttggaagtattggggcacatactctcttttttattagttctttgagaacgtgaatatattttagttgtattttcccctttcccaactcctgcagctccaagtacacacgtacacacacacacacacacacacacacacacaaacacacaaacttgtcccttttttattttttacccatcaagcccacattcctgcatgtgtggccatccactaaggtgtgactgacttaccaatggccacaacctaaaactgactctcctgctcccagcaggttccagtgccaataattccacagctaaggcgtgaacaccacctccccgcttcatgctgggattctgactggctggagcttgtgtgggttatgcgtactgtcataatcactgtcaggtcctatgtgcgtgctctgctgggtcagaaaaactgctcatctaccttccctagctcttaaaaccattcctccccatcttctgcagtgattcctaaacctgagggaaaatgggtatgatagagagtccccttttagggctgagcattccttagtcccctgttctatgcaccataaacagttgtgagcctatgttaaccgcttcaaaaaggagcttctctgatgaaagtcgagaggtgcactaatctacaatgttgaatctttagagctagtttaacatgtccatttagcagagtaatactaagttctcgccttgggcttatgatctgtctagccacaggtccctggccccagtaacggtacacacttttaatctcaggtctcaggaggaagaagcaggtagatgtttgtattggagaccagcctggttaaaactgagttctagaccggccatagctacatagtaaggttgtctttttgtttggtttggtttggttttcgaaacagtttctctgtgtagcactggctttcctgaaacgctctgtagaccaggctgcccttaagttcaaagattgtctgcctttgcctcccaagtgttaggattaaatggtagtaccactacacctagctataagagtgtaagtcagccagttggtggtggcacacaaccaccagcacttgggaggctgaggcaggcagatctctgaactcaaggatatccagggctacccagagcagccctgtttctaaaaaaccaataaataaatggatgggtgggtgggtgggtaggtgggtagattctcccacaaaatcaaaaataaaaacaatataagctctaatgctatcagatagttgtcttgtttaggtgatatttatgtttaggtattgttctagcttatttatagtctgtctgactaaacattattcaaatttaaaaactattcaagttctgattattgctatgtacattttttcttgtctcacctctaggtggcaaccactccaagccttgtgacaagcagtacggcaactaccctcacagtcaaccctgtcctccctttaaccagtgctgctgtgactaatctctctcttacaggtaagcagcaaccagcttacaggctagtaagcacagtgccagtcaggtttctgtggagaactgctaggtcatgaaggttctacgacctaagatgtgagttggttgtggggtgttgtttgtttgtttgtttgcttactgtatgactatggctctagggaggttgctgtgtgaacataatcataaggactagagttcatatacaaagtacacatttagacccaagtgggcttagcagcccatccataacccagtgctagggaagcagaggaaggggctccccagaacaaactgggctaaccagattggcatgttccagattcagtaagagaccctgccttgataacagggaataagcaaggaggacacttatatcaatttcaggcctccacatggaccttactacatacatggcaacatatatgctccaactccatcacttcgtgttcattcgttctctctctctctctctctctctctctctctctctctctctctctctctctctctctctctctctctctccttccctcccccctcccccttcgtgtgtgtgtgtgtgtgtgtgtgtgtgtgtgtgtgtgtgtacctgaccttgagctgggcacgttagtattcactttttttttttttttaagactgagccctggctgacctcctgagtggaccactcactatgcagaccagcctggctttgaacttagatcccatctgcttctaccttctgagtgctagaattaaaggtgtgtgtcacaacacccaaacccagctaaaaaaaaagtataaaaagttttaaatctgttaccaaacttttaaaacacctccttggggctggagagctggctcagcagttaagagctctagctgctctttagaggacctgagttcaattcccagcaaccatgtggtggctcacaaccatctataaggggatctgatgccctcttctgccctgcggatgtatatgcagcagagcactcatacattaaataaagtagagaacttcagaccaatttcccttatgaatatcgatgcaaaaatcctcactaaagttctcgctaactgaatccaagaacacatcaaaacaatcatccatcctaaccaagtaggtttcatctcagggatgcagagatggttcaatatatggaaatccatcaacgtaatccagtatataaacaaactcaaagacaaaaaccacatgatcatctcgttagatgctgagaaaaacatttgacaaaatccaacacccattcatgataaaagtcttggaaagatcaggaattcaaggcccatacctaaacatgataaaagcaatctacagcaaaccagtagccaacatcaaagtaaatggtgagaagctggaagcaatcccactaaaatcagggactagacaaggctgcccactttctccctacctattcaacattgtacttgaagtcctagccagagagcaattagacaacaaaaggagatcagggggatacaaattggaaaggaagaagtcaaaatatcactttttgcagatgatatgatagtatatataagtgaccctaaaaattccaccaaagaactcctaagcctgataaacagcttcaatgaagtagctggatataaaattaactcaaacaagtcaatggcctttctgtacacaaaggataaacaggctgagaaagaaattagggaaacaacacccttctcaatagtcagtcacaaataatataaaataccttggcaagactctaaggaagtgaaagatctgtatgataagaacttcaagtctctgaagaaagaaattaaagaagatctcagaagatggaaagatctcccatgttcatgaattggcaggatcaacattgtaaaaatggctatcttgccaaaagcaatctacagattcaatgcaatccccatcaaaattccaactcaattcttcaacgaattagaaagagcaatctgcaaattcatctggaataataaaaaacctaggatagcaaaaactcttctcaaggataaaagaacctctggtggaatcaccatgcctgacctaaagctgtactacagagcaattgtttttgtttttgtttttgttttttttaaaaaaactattcacatgacttttttcttcacaaaacttgaatagtggctttttacattcatagaaacatacagatttgtcaggtacattgagtactttttatgctagaccattgccaccccacccaacacatgggcaagctctatccatgtcattgtaaataataccattttagtgctcggttcttagtctgatagttcttggtgtgatattgataagccactccacattgtatatctgttcctcttgggaatattttaacttctccaggaagttaaggttgccatttactcatattataaatctatttttataattctatctttcccaatagcctttgtacttataaaaagctaaatactatattctttctgatgtgcagcttattgcctgatacactcattataaaattaataaataagagccagacatggcatacacctttaatcccagcacttcagaggcagaggcaggttatacccgatgtctgcctttggacatctattatttttctgtgtgtctttcctgccatttggaatggggtttcagaaacaaggaaatatattttctcagtctattgtcttataataaaatacttgataattgacatgtttgtcttcgttttctcctgtgcttggcacatatagggtcctggcaaacatttctagagggcctagaaatacactcctccaggagacacggtgctcttaaacgccttggagccgtgctcaaccacagggttctgtctccactttgccaaaatgatgcagatgtatttctcagaaagacaatagcaatttgaattagttatcaaacaatggaagctcgagattcaggtaggaaaaaatgagcagaaaaagagaaatagttcaacaatagtaagacacaatactctacttttgaactatatcagtaatgttgtcagagatacacagacattgaacagtatcaaccaaagattgtttttcaaggttgacctggcttgaaaagcaatcttttcaagcatacctgggacattaaattaaaggttaaaagtgtatgttcattattttaactcatttttattttatgtgcattgctattttgcccacagatatgtctctgtgagggacttggatcctttggaactggagtcagagacagttgtgagctgctgtgtaggtgctaggaattgaacccaagtcctcttgaagaacagccagtgcttttaacttctgaaccatctctccagcctattgtttgtcatgttttgttaagacagggtcttactatataaccctgatgacttggattcgctgtgaagatcctactggtcttaaaattacagaaatccacctgcctctgcctcatgagtgctgggattaaagatacgtgccatcatgccctgccatattgtgtttacagaaatcaacaacggaaaaaaacttgaatcctttaatgtttgaaaattaacatgtggccaagatccagtgaatttaaaggattaaaaccatacaaaatatgtctttttagaaatgaacaacagatatttggggatcctcagatatttggaaattaaatcagaagtttatgctaaaggaaaaaaacaagaaattgagaaaatgtttaaaattgaaaataaagcatctcagaagacagtagttatggcacagtatttccccagcagggagggcagaggccaccaggacagcctgtgtgcagtaatagagatcagagaaacaacaccatgggccagcagcctgcagctcagatttaaacttctgggagtgtaggaagtgggggattgcaaaacatagcaagaggaaagtggctacaaggctagcctaggaacatagtaagactctgtcttgaaggaagggaaggacagaaggaagaaagaaaggaaagaagaatggatcataatcatatttttaaaaagaagaaaaaattagtcccaaagcagtcagaaaaaaaaaataacaaggattatagcaaaaaaaaaaaatagtaataaaatgaaggcagtagagaaatagtgcaactgaaaaatgacaaatttagccgggtgtggtggcgcatgcctttaatcccagcactcgggaggcagaggcaggcggatttctgagttcgaggccaggctggtctacagagtgagttccagtacgccagggctatacagggaaaccctgtctcgaaaaacaaaaaaaaataaaaattaaagaaaaatgacaaattaatctgcagccaagaaaaaagagacacatattaccagaatcagagtggagcagtgctgtgtctgcgctttatccctgcagtcaagaatagagactgggggatctctaaattcttggccagcctgttctgcatagtgagttccaggacacccaaggctacacagaacctaccttggtatgtaggtaggcaggcaggcaagcaggtaggtagatgatagatagatagatagatagatagatagatagatagatagatagatagatagatagatagatagatagatagatagatagatattgaaatattaattccttttgtttagttttgaggtggtcccgcccttggccttccaaataactagaattaaaggcgcatgttcagcttatagttcacctttttctgtatacaattttaaagtgctcagttcagtaagttttggtacagttacagtatgtggaactgcaacaactatctaaatattggaataagcccatgagttactggtgctccctcacccaggcattcctcttgtactcgttttggattgcttacttttaatattttagagaaatggattcgtacaaatgaccctttgaatatgccaggtttctttcctatatatgtacttttctctcatggctgaatggtattccactcttgggctgtacagcattgcttactgtcttagttagggttttactgctgtgaacagacaccatgaccaaggcaagtcttatttaaaaaaaaaacacacacaacaacattgaattggggctggcttacaggttcagaggttcagtccattatcatcaaggtaggagcatggcagtatccaggcagacatggtgcaggcagagctgagagttctacatcttcatccaaaagctgctagtggaagactgacttccaggcaactggggtgagagtcttaagcccatgtccacagtgacacacctactccaacaaggccacacctccaaatggtgccacaccctggtccaggaatatacaaaccatcacacttaccattcacaagccatagcagcggtgtagcagcaggttcgggctatagttaatgctgctactgtgattttcaaattcaagtttgtatgtgagcatacattttcaggtctttggagtttaacttagaactgctgcataatgtggcaaactggagtactagaaacaatttcactctaaacaaagatagtgtagagtaaaatggacaatagaaactaacagattgtcaaaactgattaaaaaatggaaaatctaatagactaaaagcagttgagcaattattaattaaaagtttaacaaataaaagcccaggccctagaggttttaatagtgttctgtgggatttgttgttgattttttgttttatttaatcagattttttctaaaaatataaaatttcagaaaatagggatttttttttttttttggacaaggcaagcagggttctgttacaaaagctagataaatacattggaaaaaaaatacaggctcatagccctcatgaaaaatagatatttggaacactcagctaagtcatagccagtccaactgagtgttgttgaccacttgcctcgcatgtggaagtcaaaactgacaaaatatataaaagaatattcattttgattgggggacttacctcaagaatatacagtagatttaatatctgaacaccagttaatatattatacaataaaaatagaaattgagacaagacctgagcagttggataaaatgtatttgacaaatccaaatccattcgtgataaaaggccctttgacctgaaaccgaaggtgctgcttccacaggtcaagagcagctactcaagacccacagcaaagaacatgcttaaaaggccaggccagccacttctcctcgatggttgggaggcatgtgtatgctggcgcacatacatgtggagactaggaaccagcccgcagattttcctcagggacaactaattgcttggtttttttgagacaaggtctcttattgggacctggtgctcactaatgtgtgtacccagctggccagcaaagccagagctttgtctccacctccccagcactagaattagaagcctactccgccatacctgcctttcttgtactttctggggatgaaacttgggggttcatgtttgtatggcgaatactttcctgttttccctccaacctgaaattaaattctaaaaggcatcttatattccagcattcttaaaatgacacttgtctgtttctagcttattttattatttatttctgattcaacagtcataattccaacacataaactgatagctcattctaaataattatgaaagggatgtatttaaaattttatatgaaaaggacttgaaaagaatgaacttagaggctatatcgagagccaggtttcaaagctgattataaagataaaagtaatgaaggcaagattaagctcttcataaaatagattacatgaaacaaagctgtcagtccagtggaggaggggggtttgtttgttctctattgatttttgacaaatagctaagacaattcaataggaaagaagagtccctaacaaatgcttctggaacagttggctgtcaaaattcacaagaccattttaggttcttgtgtcaagcaaaaagctaactaaaatggatcagatgcctgaatttattcatagaatttctagaaaatagtaggagacggtctgcgtgtctttgtactgcaaagggttcaacacccaaagtataagctttaaaaaacaaaacaaaaaaagaggagggggaggggaagagatggttcagcagtcaaaatcacttgttggatttgcagagtctgagttcagttcccagcaaccacctgtgactttacctctagctctagggaatccaatgtcctcttctggccctgtggaaagcacgtaagtgcacacatttttgttttgttttgttttttaatttgacagatgataagttagattttatcaaaagtgaagtcttttgtgctgtagaagagatcttgaggaaaatggaaacaaaagacaaggactaaaaaaaagatttataatagagtatgtatcttttttaaaaagtagttgcatatggaatatactagaaactctgaaagctcaatagtaaagattcagcccagaacatttaagtagatactctactgaagaaggtacacaagtgaagaaactccatagggaaagatgctcagcaatattgcttgttagggaaattcaaagcatacttcacaggacgtgtgtaccctaagatgggtgaggaattagggtcataaaaactgctgctcctgccaagtggtagtggggatataagtgatgcaggcactgtggagatcacttgagcatggtctttgtaaattaaaaacattaatatatcatccaatgaagcaatttcctcaaggaaaatgaaaacagtcacaccttaacacttacatgtgtgtgtgtgtgtgtgtgtgtgtgtgtgtgtgtgtgtgtatttataacagtcccactctaaacaagccaaagctcacccagcatatctgcaccattgagtagacctggaaaagcaaagtgcttgtatgtgaaatggccaggaaaaaaggcaaatcagtggagacagggtaggtttgggaagtgactatacacaggcctgggggatcttttcttgattgtgcaagtgctccagtctgatagtgtgacacttaaagaatttgaaaattgataaaaagttattaactttacacttaagtcatacttcagtaggttagaaaagggtgggaaacaagaggaagtgctaggtaccctacgtgttcttgaatctaacatctaaggctgctgtggggtgggtgatagtattttgttaaggatgctgaggctctgaaagcctgtgcttccatggagtgcattgccaaggattcaaatcataaaggaggtatatgagttggaacagaattccatggctaggaggatgtatttaaagatcatgctgatgttttatgtcatagtggttgaatgatgctgaaattggagatgcctagaatatggatagtatattacaaccaggaaaaaaaaaaaaaaaaactaagttgttttttaactcatccctttctagcctagattaaatccactgatttgactgggattttcttcgtaagcctacaagaagagttaataggttgcagtgaggaggaaagaataataatcaatttaagcttttttacttcaagatttaaggtgttgttaaaaaaaaggacagtttcagaatttaatattacacgtaaaattaggtttcatgaaatgaaaactttgtcgggagattgaaagtacattgaaactttttgcctgtagaagagaaataagaaagcacacttatcttcctgtagatcaagatcttagaagaggatgcagctgggaagtgcttaggagtctaccagacagagtcaccaccacagcaggtacacagtgcagggctcgggctggtacctttagaactgaggaagtactcaaggggtaggcttaataatatccacactggtgtaattttatttagctagaggcagctatagtatatggaaagcattttagttttgtgtttgagaaggacaaagggggggatgaattattttttatagtatttcttaattagcaataaaaagaaggtaagcaaggttacctcattcagagaccacaagtcactttgataccattgtgaaggtatagggagcaggtggtgcccattgcagatggtgtaagttcctcccagtgccttaggaggaaaactgggagttgtacccctcccttctcggaggctgttggccatcagccctggaggataaaggtagcagaggctacacgcagggtttgaatagccgtgagtatgatggaagagcttcggaagactgctgcagctacacaagcctactctcttgttccagggatggggtgtatagggctcttgtaggggtacaggcagaaaggacaaattggtcatagcatcaaacaggcagcaagggctgattggttataatacaacacctacttatgctgacaggaagccagaacaggacttgtgtgctgagttatgcagccttacacggaactctatacaaggtcatttttcaaacaagatcagccacctgtgttcaggcacgctcacccccatagggaagccctgctgagaaaggcatccggccatggggaactgcaaccttcatagcagggttctccatattagtgcagcagaggtacttacatgtgagctgagactcttgcaggggaagggtcttctgtaccacaaagtgtttcttacgcaagatttttctgactgtttcacaagtttgagatatttctttggcttgggctgtttatatactactttgggaatcttgtatactttggtagcattgctgtatggaaattttaaagggttgtgttgtgtatgtttgtcctttctgagttctccctagtgagaatatcacatgagttttgttttctatttatgtatggttaattatatcctggggcatgctgagcttcactgagttcaattctagctacctctgttttgttttggtggagtttgttgtttttatttttgtttttgttttgtaatgcagcattgtcgtaggtggggtttctattgctgttataaaacaccataaccaaaaacaaacttgaggaggaaatgatttatttcagcttccagtccatcactgagggaagttagtgcaggaacttgagatggggactaatgcagagaccatgaaggaacactgcgtactagcttgctcctcatctcatggcttgctttctcagcttgcttttataccatccagagccacctgcccaggggtggcaacagcctcagtgagtggggccttcctacatcaagcactaattaagaaaatgtcccacagacttattaacccacaggtccgtcaggtaagggcattttctcagttgaggctccgtcttccaaatgactggtaacttgtatcagtttaactaaaaaaggtagaggaggaagagggaaggaaaaacatgataagcatttactgacaactagaattagagggcctgctctatatgtttactatagtagataccttactgggtcatgaatggacacattcttttaagatacttttgcctctagactctagcataccaacttccacacattttaaatctgtactatgcactatggcattcactaaagtttaacatgtggcttttgaatatttgaaacatggctatttcaaatttaggtgtgctgttataatgagtgtactgaaaatctacagaatgataggaaatactaaaatgattttggttttgtcatttttattcattgtttttgttttaggtgaggtcttactttgtatatctgactggcttccaactctatatagaccaggctggcctcaaactcacagagatctgtctctgcctctcaggtgctagaattaaaggtgtgaaccaccatgcctggcttgatagcttttttaaaaagatttgtttgaaggttttcttgtttttgtttttaacgtatatgagtgtttttcctacatgtacatctgtgcaccatctgtgtgtctgatgtctgtcgaggccagaaaaaggcatcagatcctctggagctggagttacaatggttgtgagcatccctctgcaagagcagcccatgctccgaaccactgaaccatctctctagcccctcatttgctctttttttaatagaaaattgaggctggtggtggagacagggatggcacactgttatttctttcagagttatgtggttactctttctcttaaagtaggactcatagctttggctctaaattgtttatcattaatttgttaaaatgctaagctagtttactaaaaaaaaaaaaaaaacaaaacaaattaaggattaatgagtagtaggttaaccattctcttgattctagatactaatggaagtgactagttttccaaacccatttacaggaggccatcttctaactcagttctcttctcaggcactacagactcgacgtccaacaacaacacggccacggtgatttccacagcaccccctgcttcctcagcagtcacatccccttccttgagtccctctccctctgcctcggcctccacctcagaggcctccagtgccagtgagaccaacacgacacagaccacctccacgcctcttccctcccctctcggagccagccaggtgatggtgaccacgcccggcttacagacagcagccgccgctctccaaggagcggcacagttgccagcaaacgccagtcttgctgctatggctgctgctgcgggactcagcccaggcctcatggcaccctcacagtttgctgctgggtaaggagctttcccattccgtttgcatccagaacagaactaggatctcattcctgcagctcccggggaaaatttgttatcgctgtcttaggtggaaagtatatctgagatgggtttgcacttaagtttctaagtagccacattgtcatttccacatgatgacacagaactgagtcactgagtaactcagtgagagaaccaggaaaatgctcagaattcatcattattaagctttcttcagtcaagtatatttatctactttttaattcccccaaaacaggtaaaacttggaataaagtgatatctgattttatgtgtttttcagtttttctctgataatttcatacatgtatgcaatgtattttggtcatatccatccccaactcctcccaaactgccctgaactcacccccacccacacgtacgacttcatttttcatgttttttgttgttgttttgttttttttcttcaagtagccagtctagttagttagtgctgcctgtgtatatgtgactgtagacctgcccactgggacacgagtgacccaccagtgagctctcaactgccaatagctcttcagctaggggcggaataagagcccttgccctgtctataccagaatgtgtctggcttgatcttgttcagagaacctactctgcattcaatgagtgcaaatttcatgtccgggtctacaagacatcagttcacaaaactcccagcctccaactcttacatcttttctactgaggaacattttcattaatgttccctaagtcttgatgttagggagatacggttgatagtgatgtcctatttagggctgcatacccaacagttgtttattcttatcagtttgaccagttgactgcattaattattatccactgcagtaagagttgagagcatcatacatctgggtattaacataagttcttagagagcagttcgccataaccatttaacaaaacaatagtcagtatctgcccctgccctactcttggcccatgagctccccatccaatgggcttttgactacatttacagtaccaggcaggaacttcctgctatgaataggcctcagatcaaaccagaaaccagttgtttaccactagagcagtcatcccactgttccaccaatgccacatcttgcctgattggttagtattgcaacatacagggtctagtattgcgtaagagtgttgatgctttttctctcccaggtgcctgtatagcacctctggcactgggaaagttagccgcagttccagattttctatgtcctgtaactgaagtgcatttgtcttcagtaatcagatatagcatctagttatgatgtacccccaagatcagtggcaatagcctgtaatgagttgggttttttgttggtttttatttctagggggttggcctttatagctttccaaaccaataacttgttataaatgtaatgtttattctcctgatgtagttgccatcttcaaggcttactgcctctgtctgctaagctaggcctagtcctggaaccttccagcagtcacacaagctaatctaggcctagaatgtggtcagcctccgagactcaccactgactgcgcttacactttctagatctttctgagctctgttggctggtctgttggccagctgttctggctcaagctcctctccacgtggactaagtcagtctggcttctccagactctgactcttgcccacactacccctagcgatctgttctaatcttgtagctcctcattcaatggctgatcttgcctttccttgtatctagcttgttctctcaatgcagcttgtctctgtacaagggtcccagtagaactgcctcccacctctctcttctctcacccccaccctgtgctgctctctaaagtagcttccctttcccttctcgtgagagttgggcatattctattctgtcagatctttctctgattcatctctttttctgccactcaattagacatcacttttgaacataggtgcttccttctacaaactaactttattctcattgtttggaattaaaggtgcgtactaagggctgagccacaccacaactagagaaagttttttttcagtaaataatataatctgggggttcggagtgtgatcaaataccctgcggcaacttggacatatgtacccatgggtagcactgagatttttattcagtattctgtaccttctgggaataatagtgtctacccatctgggcactctgttcaaactccttttcttatttttttattatgggttttaattagcttacacatagaaggtttccacaggctttttcatacattattagtttttgttgacctaccttccttctctgcttccatccctcactgctgtctctgcttaaacctttaaatatccccgttattccctcctcttgtcgtcccaatacattctactatgtccctaccccattaagacctctgtcctcctctcaaggacccatccatgttttctgatgaaagtgcagatgctccaagttaaacataaaagactcaaagctaggagtcactgtgaaggagacttgcagcctttgtaattgtgggcccaggttagtcacttagtgtaatgttttccacttctatccatgtatctgcagacttctttacagctgagtaaatcccattgtgtgtttgtatcagtctcatctgtccatcagtcaatgttaatttcgtttttcctagctattgggaatagagcagcaatgaatgttgtgtggtgattttatatctttactgtcaaatgtaaggattatcccttcaagttttttcttttagaaaagaaatgaagcaattcaaagaaaagtcagaatgattcgagtttcatattttatgcagagcataaccttgttgtacaagaaagcagtaactgggaagcactaactgaaccatataaaatgatacagaaagtgacaaggatcctatacatttcctaagttgaggttttctattttatcagtttgggtatgtcagattgatgtctgttgacatggcagtagagtgactcctcttttgcacttacagaggtgccttactcagtctcagtccggggactctgggcagtgctctcagcccagccctaatgagcaacagtacactggcaacgattcaaggtcagcagcacatttgtcttgcttggtgcacctgagggtattggaggcagggggcggaggggggcagctagaggaagcttcctgctttgctaaagataaaggtgaagaggagagttgaatgctgattaagctgttcttgggggtcaagaagatattcctgtaaaaaagttttgtagaagagcatacgggttagtttgtgagaacagcaaatgcatagtttggtatatatatccaagaaatctaaactttattatgtgattagagttggaagtagatttattttcctcctgatgttaacctatctcaaggctagcttcttcaagtaaaactgcccagttccatccccactaagagccaagtgttcggcctatagaagtaaaacacaacgttttaaaatcatgcccttttctttatttggtgatgtgtgaatgttctcttgattaaaggcttctcaaagatagctttcatcttatatgaaatttattctcaaatttgtcaaataatgtcagttgagttgataaaactaaacatatttttaattcttcaatcactaaaagtagtcttcttgaatggaggtagttttaagtaaactccattgaaaggataatattattggatttaacaaatacttgtaagtaaatgtcaaaaacttgacacttaaaagatagaaatatgactgactggtctgcaactctcatgattcctccctgttgatttgtcctactcatatcattaagttgactttcaactctttgcatcagacgtataaacttgagctgatgtcagtacagcatcacagtggaggggagagtcagcaaagaggcacactctgctactgagtaggagttagctggtgtgttatctgtgttatctggcttctccaggatgaaatttaatgttcttcctgttctgggctctttgtctatagctcttgcttctagtggctctcttccaataacgtctctggatgcaactgggaacctggtatttgccaatgcaggaggagccccgaacatcgtgactgcacctctgttcctgaaccctcagaacctctctctgctcaccagcaacccagtaagcttggtttctgccgctgcagcctccacagggaactctgcacctacagccagccttcatgcctcctccacctcaactgagtccatccagagctctctgttcacagtcgcctctgccagtgggcctgcttccaccaccacagctgcctccaaggcacagtgagctgagtgcagagctgggttgccacaggctttcctcactacagggtgataggctggctaccagctgcttaagaaaatgacacctgtcattggcttcctcccaccatgttgtgaggaggaagaagacatggagagaagaaaaaattacacataccagaaaaaggaaagaatggagacaggacagcatttgcctaattttataataaaacaatgtcttttcaggattgcttcatggattggagaactttctaaccaaaaattttaaaagaaaaaaaaaaaaaaagaaacaaaaacagacagacaaaactaagtgaaaggcctacttaccatgtccagcagtcatgacgacaagctaaggtgggtcaccagttccaggagaggaaggggtctttttctttttctttctttcttttatgttattgttttggtttggtttttttggtttttttttttcttttaaaaaaaaaatcatttttataggtctgttgtacagaccattaagtcataacaaggtgtttataatcatatcaattgtgttgggggttcctttcttaactggtacaatttaggcaggcctgtattactgtatctctgatattgtttgtttatactatatatatatatatatatctatatatatatattgaacatgtttatctcttgctcctggatcctgtttcagtgagcgcccacactgtggggagggagggtttgggatcaagggagacttaggtccttaactcctgggaatgttcgtgctggtttccttatccttggtgactcttacagaggtgctagaaaacgattttcttttgccacttatgcaagaggcttggtgcagaagctgaaggcagtgtgtgcaaacacttctgccttacacacgcccctccccatcaggcggtgcctttggagcacttgtgtgtaggaaggaattcctgctgagccgtggctctcactcaccccgaatcattgagcagcctgaggcccagaccctgtggtgcaacagtgacgcttccttctacttcccatgggaacagctgtgcctgttgcagggcagggtttggttccgaagagcaaagactactgcagacacctgacttggtggctctcctgatttcttatctcttaaaaaaatgctcctactgttagtgtttgtttgtttgcttgtttgttttttcattttatgaaaaattttcatccaaacttccttttatttacttggtcagaatcgaattggcatactgaagttgtgcgacagttctctcccttgttttctaaagcaattctgttgaactgttttctactaacgaggtatcccagagaggtcagtatgaagagcctgagcgagtgtaccaccgttctctagagagtcacagacttcctgtccactgagtgggtcacaagtttctccaagcctgagagtctcctcagtcccctgactgacagaggccctttcctggctgggcaagggatctgtggaacttcagagagatgctgagcaagaacttctcagcctcaagtgtctcttggttggttaggcccctgctaagtagatctgatgacgacatgcatctcctatttgatgtaaaaagtgatttcctcctgtaattgctttcagggtgtttctagactacataaatgagcccattgaaaaggaagaacttgtgaaaatggatgaagatggatgagggcaatttagagactaaattcccccatttgtcaatatcctattattatactatctgtaccagaatttttacaaatgacggaatcactgcagtgaagctctgagttgcccttactggagttaaaggttcccatttggcgtctgagggcacttgcttcagttcctggtggtctgcactttgagctgggagtgactctccttctgattgctttgctttgccgcaggaaactgtgcatttgtttctctgcagagaaaaagttcagcgaggcagtagcagacacagatgtgtaccttttttgttgttgtttctcagttgggagaaggtcatactaatattaaaggtcaaaaacattttgatccctttaatttttttttagttccttttggttatttcccagagtatttaattttcacccctgaataatttcttttacctttaacttttcctaaaatccctccaaaaatcagtgaactgcaagcagggaaactcacagatgctcatccacctattttgtatggtgtgggtgttttgtttgttttgttttgttttttaaactaagcttgaaccaaagtcaattcttagcaagctgctgtactaatggactaatggttataatgtgcagttcaaacacagtgaggagatagatgctactgacaattcttactcatttttcttgattaattttatgtgaaagttgctgcttgtttttatcttttatgttggtaaattgtaatatcctctgggcagacattaccttgattttagctagtttgtttaagtcagtgtgtaaataggatggcgtgccagttactacttctcccctccccaccagcctttctctcttgttaatttaatgttttctcttgacttaacactctaatcttagtctgcatgtggttttaggcctgtcaatactgtttctgccctagcagagagtccttcccttgggagtgaggaggttaggaagaattcagggagagaaatgctgattacctaccagacagattagcagttatagcattaatttccagaattgctaccaaaggaagtagagagtcccaagaggctctggcccggggactaaggaggacagagggactgttttgtcatacgtggttaaaaggatctttttcccaaataagagtcccctacagactttgattttaaaaatgatactaagttttatgtttttgtcaatccttcctctgtagtctctagtgggtttgagaaaggattgctgcctttttatgtagttaattttttgaggatagactttaaaaccagcataaatactgtattgagaagaaaaggatctttagataaagataactttaattttttcctaccctttttcatgtgtttaaaattaaattgtaaaatgaaaggtactttatacatatgtatacatgaaacactactaaagttttctggtgggtgttcaggctaaaataccttccgtgaccatccctaaatggtcgttaacctactatacacaaacccttgggtagtttttacttgataccattttttttaatgatctcaaatgctttttaaactgacaactgtcttctaaggtaaagtactcagacttaaaggttcagctgccttttatgaaagaatgtagaaaccaaagaggttatttgactaaaagacacatacagttgagtttctacagttcctgagtaaacaggttgttaaacctgttagttcattctccttttcttccccttgatatttatgcttgctttatttcatccctaaatttagttaacacatagtaagccaaagactaattctaaatacatttaggggatactatatttgcctgtgataatgggccctccctggagagtagtgaatgtaattgtttaatcctgtttaagcaatgcagtttggcataaactttatttatttcctgtgtaaatctaaatgacaacagaaaaatctataaggtttctcacaagagcagtcttactgttgtaggaatagtaagtgctctgttaccttgaatgtctctgaagccctataggcagctccataaaatgaggaaacattattcctagccatttgcttccttaatgtgttgtcagaaaggtcagccccgtcctgtgtctgtaacttgttactccaaaatggaaccaaaggaatccggctttcagcttgtggaggaccagcctgtttatattctcataagctttattagaaattgttaaagggatatcagtgaaaaggttttaggtgtgatcatcttgccaacatgttctatatcatcatccatttgttttagggaaaaagcacaattatacctctctaatattattgtgtctattatctattcttcaattatttgaaaaataggggaaataatctcttcactatccagaagcacaggtttttgcttgacaatatttcagttcagctcagtcattattaacatttaacttgctggaaatgccaggtacatttataaatatagggatgttatgtaaggaaaaaatactatagttcctagtctgaagttcttcttaagccatgtcatcctcacaaatctttcttgaccaaaacaaagagacatctattttctgttcttccccaagaggggagaaatgctgccctagtgtgcaggagacagtgtcctgctggcagcctgggttggccctggccctgaggaactcacggaccagtctataacctgagcatgtggtgaggcagaaagaagggcctcagcagctcagcaagagagcttgagcagaaactttacgttggcttctgaagctgatgaacataaagtgtacttattcctcaaactctattagaactgtaaacatttaagactaccagtactaatgtaaggaaaatacttaaaagacctgaaacccatagttatacaagtgggcagaaattgatgtagtaatttatttataactgttatgagttcactttcatttgtggatatgaacagtatttaccatgttatattgtccatataaagagatccatgactattttgaagtcattttcagatacttgtaaaaataagacttccctaatattttgattttgaagaagaaaagcaattcttctttgccattcctctgagaataaaacactgttccacaggtttgcatggattgcacacacaagcataaatagaaaaggcggaaataaggtcctttgattattaaaggttgatggaataatctttgcctcatcctctaattcaccaatggaaagtaagtgtaaggttctagcagggtggtcaggaaacctcttcctcagcattcgtccagttcatacccggtgtatggtaggatttgtgaactgggtttcttccaaccatcattctcttcatgaaccaattccttagtttgacccttctgctcttggcctttgctggaagcagtaaacttgagtatatcacgtgtcgattcagtgatctggatctctctgtctcttttccttctcttattcatttgagtggtggtaccttattctgtgagaataatgctcatggggaacagcttctggcaccttcataaaatacctcagcatagcttagcattgttacagaactggttttagactgaaaaaccaaataagtataagaaaaaatctttataaatagtggaaataattctagctgtagtatttagttgaactaatgtttattatgattgttaaacatgattgatgctgtatgtatttggggtcctgtttatagagttagggagggttgggttgggagaaaggagaaattgattatgttagaaggaaaatattgcttgtgtgtatttgtttttctttatatctgtcttgccaaaggaaacttgatattccctatgaatgggttgggggtttgaggcctctctgtgatctgatatgcagcacagtatgcagaaccatgcaggtgatgtgtggggtgtccagtgggttcaggatgcccaggcacaggttacaaccctccctgtctgtggctgtcatgcccttgccccaagacctgccaggctctcctgacgatccattacctctgtgcatagctaaagcttaggcaaaggaagagtgtgcacgtgtccaggtgtgcagatgaaaagacagatatgaacgtgaacccgaggaatggagcggtgagtgatgtatcttgagctcggaaaattaacatgaaatgagtcatcttttgtcatgttagtgattgctgtgctagtagtagcccaacatttttaaaactttatttccttttcttataccaaggataattttgtctagaccaaaacacaaaagaaaaccaagccaagaagttgaaagctaacacaagtcaaaagctaaccctaccctgtactaaggtggggcatttaaggactgggtgatgagatggaagaagagttgttcttccttttgggaaatgtgaataagaaattatgttggtttaggaaaaaattaaaaacctttctgcccttgttctgtctgggacagactttcttagctccctgagttctaatgtaaactatatctcaagaactaattttttatctcacagaacttgagtgggatttgattttgataccaaagacaactgctaaaccattgcttctcaagttttccagacactcaaaggccatagagcaaacactgaggttggaaagcttcgtcttgtctctgttctccccatcggcctcaccccttcctcacttttggaagatgtctttttggttactctagctttgggaagagattggttttgttcctccctgctgcttggttgagattggtagagtttgctcagcataacactgatactctgactgagaaagaaacttggagtgcaaaaaatagtagtagaacttttacttacctttatctagttcatacaaataaaactaggccatccaacctgttggagtaccagtcaggatttagttaggaagagcagactacagccgaatgacatctccttcctctcctgtagagctgtttttgctgcacagtgtgttaggatacggctgctgggaggctaagaggcttcttatgtcggcaggctttagataaacagacagtgagagaggaaagaccaacaaccatgatcaggttgctaaatttcatgaaagctttacttgttatcattctgacattatgtaagtagtgttagtgctgtgtggttttttctaagcgttaggtaggtttgtatggtatagggatattgaagataagagcacggaaacaaatgctgtgagaagcagtgtgtgggtcgtgaacaccatttcagctgtgaaagggacgctcccaggttcagggagggaaacagtttgtgatctttctgcatccctcagtctgcccacgctgcacagagctctaccacccttgccacgtcctggttcaaatccagaaccctgtcagaaagttaagaaactttccaaactaatgtaccggaggagggaggagctgaggtccgctgcaaagttgttcatcactgcaacagccacaacctcacaaaagcagctagaagcttctttgctaaattggcaatgctattgatcactacatcccaaggtctgcaggcagctggtgacagtgcagttccaacagtgcagcatctgcatgggagatctttatgtgatcttgttagagaaaaagtagacagccaatgcccatccatcccagagagtgtctaagaactacaggaggaaacaaaatgttctcacacgggtgtgacagtgtctctgaggagcactgtgataggctgggtgggttccattcctacatgagtctgcagaaggcacgtgttgtttgtaagagtgacatgaactagttagtgctagcctggttagatttaaagttgcaaactgtgggagtgggggtagtgtgttcaacaagactgaccatattacaacattgactttctacaatatagatggtaaatggtgagaggaagacttcttcccactgcttacctctgcttccatgggaatgtgtgcattactcagtccacaggagggctcactgagggaagtgtcctgcccctagagtggccctcagccattgctctcctctgtggtagtgaaggctaggtgagtaagagtgggggtttctgcccaccacctgtccaggagctgtcgtatacctcatttctaactctaactcgctttaacttcctctcaaccctacagagttgccaagtctgccctccctcttctcagcaacattaaactctggcctatagcatcataagacctgtcgcttgggggtgggggactgtcccgccccaccccaccccaaagcctctgaatgtctctgcttttaagctactagaaactgagggcaaattgcaatctcctgtttgtctttgttgctaggggtcctcacaggttttttaccatgtccccaccaccttgccttcaaggtatggccagctctcctctccccatccaccctgtatttcaaagtgctggatagacagcagcttctgtccttgcttttccaagtggtctcaaggctgacctttcccttctgaagccttggggctctgctcattgccaggacttggtagaaaggacacgaaggttcatttaagctgacctaagctacacatttcacttgtttcccgtgtgacatgaccaaaaagaattccaaatatttaagtttattattaatatattataataatagttattattatttgacaatcttatatccgacgggctttctggaagctgcttctccggccctttcaacgttttctttgaatgtagttcttaacttgcaatttccacccccaaagttggagggggggaaagctcagccaggtcaggtcataatactgctgctataagccaggggagggtggtttctttgatttgttttgtttttccatttccagccaaaaccaaagatttcttaatgattgtataaactcaaaacaaacaaaaaaaccaaagaaaagggaagtcttcggccccaatgcagtctgtggcgtcctggcacttggaggcatgccaaagggtaggtggggacacctggccagctcagaggggcaggcaagtcttttctaagttgagagattcattcagatgcatgcccaggagttttggcccttgctcacttctgagtagagcatgcatgaaagaaattggaacatcagatttttcaaaagtcccatcctcaccacaactcatgtgacagcagccagggtcatcaccagagctgagcacagggccttagagctgggagctgctactgggtggccatggactccacagagtggggatgctgaagacgctggcacaggattggctactctgctgggtgctttcacctttggggcgggctcttaacccaagggtccttgtgagttctgaaccttctctctctcttctgttcccgaactgcactgcttggaagtggctgtcctgtttgtgaggaaacatgcagaacaattgtcaaacttttttttaatcttgtttctagttttgtttccttttgcagcaccactgtgcaactatgcattgtatttcataacctttgtgctaggtagacgcctgtgactttttaacttgggggtgggtgggttgcgggttgcaaatgaaggaaatttttacatggatctttttaatctcagttgattgggggaggggggttttggttctagggtcatacaagctctatcccaaagcaaaatccaaatgttaataatactagcctgatgcagataccaaagacaatttctttcctgcagaaccttagacttgtgtactaagtacgattatccggcacttgcattagtctaacctcagtaattccaaagcttagatgtatattttggtatatttccaggatattaaaaaaaatgtcgtttaacttcttgtttgtttcagtgtaatgctcttaaagtcatcgcatgaaataactgcgctgtcctattcttggtagtttgaaataatagtatttttgtatgttttgggtgtgtctgtatgtattaacataacagttttcactgcctaggtgttcatataaaagtgagaggttctgagtgtacatactattaaataacaatctctaccagtgtccacggagtgtctggaggcactgatgactgcccagctgggatctggttttaaagagacggtgattgtgttttctaaagatgtttgcttctgtctttaaatatcttaacttccccacttgttttttcctacttttttaattactattgattcaggggtgtttttccactgttgtcaagggaggaacacaagggaactggcaccttggcctcccaaaatatgttattttatgtattttaaaatgtgagttttgagttcttctttgtggaaacttacaacatgatgtacatgattctttccggagttgcccagcagctttaatgaggcagcagcagcagccgttcctgggtagtttattgggtgtcctctgacatttctccttaagatgaatttgcagtctgggtggctattgtgtagcctcactgccccagaacgtctgtagccatttccccttcaatggggatattttataagattcagctgatagctcggagcactggccctgttatctgtgcccatgggaaatgtgtttttcttgat

SEQ ID NO: 1358 - DNA, 2648 bp, Mus musculus
gcagcgagtcaagatgagagttcagccgcggcggcagcagcagcagactcaagaatgaataatccatcagaaaccaataaatcatctatggagagtgaagatgccagcacaggcacacaaaccaatggtctggactttcagaaacagcccgtgcccgttggaggagcgatctccacagcccaggcccaggccttcctcggacatcttcaccaggtccagctagctgggacaagtttacaggctgctgctcagtctttaaatgtacagtctaaatccagtgaagagtcgggagattcgcagcagtcgagccagccttcttcccagccgccttcagtgcagtcagccattccccagacccagctaatgctggctgggggacagataactgggctcacgttgaccccagcccagcaacagttactgctacagcaggcgcaggcccaggcccagctcctggccgctgcagtgcagcaacactccgccagccaacagcacagtgctgctggggccaccatctcagcctccgccgccacacccatgacgcagatccccctgtctcagcccatacagattgcacaggatcttcaacaattgcaacagcttcagcagcaaaatctcaacttgcaacagtttgtgttggtgcacccaaccaccaacctgcaaccagcacagtttatcatctcacagaccccccagggccagcagggtctcctgcaagcgcaaaatcttttaacgcaactacctcagcaaagccaagccaacctcctacagccacagccaagcatcaccctcacgtcccagcctaccaccccaactcgcacaatagcagcagcctcagttcagacacttccacagagccagtcaacaccaaagcgaattgacactcccagcttggaggagcccagtgaccttgaggagcttgagcagtttgccaagactttcaaacaaagacgaatcaaacttggattcactcagggtgatgttgggctcgctatggggaaattatatggaaatgacttcagccaaaccaccatctctcgctttgaagccttgaacctcagctttaagaacatgtgcaagttaaagccccttttagagaagtggctaaatgatgcagagaacctctcatctgattctacagcatctagcccaagtgctttgaattctccaggattgggggctgagggcttgaatcgtaggaggaaaaaacgcaccagcatagagaccaacatccgtgtggccttagagaagagtttcatggagaatcaaaagcctacctcggaagacatcaccttgattgctgaacagctcaatatggaaaaggaggtgattcgtgtttggttttgtaaccgccgccagaaggagaaaagaatcaacccgcccagcagtggtgggaccagcagctcacctatcaaagcaattttccccagcccagcctcattggtggcaaccactccaagccttgtgacaagcagtacggcaactaccctcacagtcaaccctgtcctccctttaaccagtgctgctgtgactaatctctctcttacagatcaagatcttagaagaggatgcagctgggaagtgcttaggagtctaccagacagagtcaccaccacagcaggcactacagactcgacgtccaacaacaacacggccacggtgatttccacagcaccccctgcttcctcagcagtcacatccccttccttgagtccctctccctctgcctcggcctccacctcagaggcctccagtgccagtgagaccaacacgacacagaccacctccacgcctcttccctcccctctcggagccagccaggtgatggtgaccacgcccggcttacagacagcagccgccgctctccaaggagcggcacagttgccagcaaacgccagtcttgctgctatggctgctgctgcgggactcagcccaggcctcatggcaccctcacagtttgctgctggaggtgccttactcagtctcagtccggggactctgggcagtgctctcagcccagccctaatgagcaacagtacactggcaacgattcaagctcttgcttctagtggctctcttccaataacgtctctggatgcaactgggaacctggtatttgccaatgcaggaggagccccgaacatcgtgactgcacctctgttcctgaaccctcagaacctctctctgctcaccagcaacccagtaagcttggtttctgccgctgcagcctccacagggaactctgcacctacagccagccttcatgcctcctccacctcaactgagtccatccagagctctctgttcacagtcgcctctgccagtgggcctgcttccaccaccacagctgcctccaaggcacagtgagctgagtgcagagctgggttgccacaggctttcctcactacagggtgataggctggctaccagctgcttaagaaaatgacacctgtcattggcttcctcccaccatgttgtgaggaggaagaagacatggagagaagaaaaaattacacataccagaaaaaggaaagaatggagacaggacagcatttgcctaattttataataaaacaatgtcttttcaggattgcttcatggattggagaactttctaaccaaaaattttaaaagaaaaaaaaaaaaaa

SEQ ID NO: 1359 - protein, 788 aa, Mus musculus
AASQDESSAAAAAAADSRMNNPSETNKSSMESEDASTGTQTNGLDFQKQPVPVGGAISTAQAQAFLGHLHQVQLAGTSLQAAAQSLNVQSKSSEESGDSQQSSQPSSQPPSVQSAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQPQPSITLTSQPTTPTRTIAAASVQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSTASSPSALNSPGLGAEGLNRRRKKRTSIETNIRVALEKSFMENQKPTSEDITLIAEQLNMEKEVIRVWFCNRRQKEKRINPPSSGGTSSSPIKAIFPSPASLVATTPSLVTSSTATTLTVNPVLPLTSAAVTNLSLTDQDLRRGCSWEVLRSLPDRVTTTAGTTDSTSNNNTATVISTAPPASSAVTSPSLSPSPSASASTSEASSASETNTTQTTSTPLPSPLGASQVMVTTPGLQTAAAALQGAAQLPANASLAAMAAAAGLSPGLMAPSQFAAGGALLSLSPGTLGSALSPALMSNSTLATIQALASSGSLPITSLDATGNLVFANAGGAPNIVTAPLFLNPQNLSLLTSNPVSLVSAAAASTGNSAPTASLHASSTSTESIQSSLFTVASASGPASTTTAASKAQ

SEQ ID NO: 1360 - DNA, 215221 bp, Homo sapiens
tgttttgaagcctctttctcttatttgttgtttactagttttgttttgttttttggtttttttttttgagatggagtctcgctttgccgcccaggctagagtgccgtggtgcaatctcagctcagtgcaacctccgcctcctgggttcaagcaattctcctgcctcggcctcccaagtagctggaattacaggtgcatgccaccatgcccagctactttttgtatttttagtagaaatggggtttcgccatgtcagccacgctggtctcctgaccactcctggcgctcctgatatcaggtggtccgcccgcctcggcctcccaaagtgctggaatttcaggtgtgagccactgcacccggcctgtttactagttttacatttacttccaccctacttctcaagcttctaatctataactagatcttaggagaatgatccagcgggtggttttactgacttcctggttgtaagactgtgtctttgtcttcctacttggctaaatcttcaacatcctataaagctgtagccccaggcagaagttaggccacaattttactcagcctccatttacaaaactgtgtgggagtgtgaaatgacataggtacaaggctgttcattgtgatattgagagtaacagagaacatttatctgtaaatagcatgtgtacagcaagagaggactcgagtaaaccacggttcacgcacacaatgaactacacagagctataaaaaagaaagtaaaatctccatgtcctgatatggaacaatcttctgtacatacagttaagcgacaaaagcaaggtatagaacagtgcatatggtgtgctatcttttgtgtaaaagggtatgctatccttttaagaaagcgagagacaccacatgcctgtggtcccagctacttgggaggctgaggtaggagaatcacttgagcccaggagtttgggctgcagtgagctatgattgcgcctgtgaatgtgaatagccactgcactccagcttgggcaacatcatagagagatcctgtctcaaaaaaaaaaaaaaaggaagagaaataagaatatatatagttgcgagaagagccattggaagaatacacaacaaaccaataaaaatgatttcctaaagaagagggaaagtgagactggagtaaacatgagatttctctgtatcataaaatgctatagtttgagttttgaattttgatttatgtaatatgtagatattaaaatatctaccaattaccaaaataaaaaaaaaaagagtgtgtgtacctgtgtgtagagggcaggatgcttccaagcccagagcctagttccaagcccattttagcacctctttgtggtgctaaaattccaagtaccactgcctgcctcaaggcagctaacctactcctggtctgcatttatgtgctcttcctggtttgtggaaatgattattgcttttgagtctgtttctttttggttttctctttttctatttcatctgtcttgctgaatatttggagcagaggaaatgtttagatttgtgaaactattgtgccattgtaagtccttttcctttagttttaacccttattattgaaaatcctttaaaaatatttttttcttaccttacaaagtccagcacactcagaattactaaacatttctcagataacaaaacataatagaatgaactttataacccttaattatcagtataaaatcattacatttcatagagtttaaaatgtcattgtaagatgcaccattattttatgtaccattagaaaatgctgccaaggcccagcgtggtggctcacgcctgaaaccccaacactttgggaagccgaggcaggaggattgcttgagtctaagagtctgagagcagcctaggcaacatagcaagaccctgagtttacaaaaaataaaaaattaactgggtgtggtagtgcacacccctgtagtcccagctatttgggaagctgaggtgggaggatcacttgaacccggcaggtcgaggctgcagtgagccatgatcacaccactgcacttggcctgggggacagaatgagaccttgtctcaaaaacaaaaaaatgctgccaattaaactatgatacagtgctttcttatcaaacctttgtaaggtgcatcttgatgtcaaagatattaaaatgtgaagaattgtgcatctgaatgagtaaaataaagaattatagttgtagacttggaaaataaaaaggttgaactaaatgtgactgatcctaggatgttccagaaatccaaaggaaatattttgcctagagtaatgtcaagtatatggtaggtacttgatgaatgtttatgaataaataaaggctttttacaagacattggatggtcattaaaacacagcgagaagtaggcaagaaaatttgttttaaaaatgttggccaggcgcggtggctcacacctgtaatcccagcactttgggaagccaaggcgggtggatcatgaggtcaggagttcaagaccagtcaggccaacatgatgaaaccccatctctactaaaactacaaaaaaattagccgggtgtggtggcaggcgcctttagtcccagctactcgggaggctgaggcagagaattgcttgaacctgggaggtggaggttgcagtgagccgagatcgtgccactgcactccagcctgggcgacaagagtgagactccgtctcaaaaacaaaaaaaaaaaagaaaaaatgttaagcatcgactctgtctaggcctgtactgtaacattaagaataagaagataaaaaaaaagaagatatagtctagtctttgatagtttatactctagtgaaggagacaaatgtaacacagtctgacaatcagaggagagatggggactgaaggagtaggttgtcttcagagggatattaatagttgaaattgggacagataatgacaccaaacaggcttgcaacatgagagggacacaagcagaacctcggagagtacctatatttaatgggaagaaaaagaggatccagtgaggaaaatcaagacagagttagagagatcagaggagaaattgaagagcaatttgtcattgagaccagaagcagagatggctttgagaaggaaggaacgatcaacattgtcaaattgccgagagatggggcaagatgaagagtgaagatgtcatcagatttggcagttaggagttcatcagtggtttccaataaagtaatttcagtaaaatcattggagcagatgtcagactgtaatgggttgttgagtaaatgcagggagagtttatctagagaatgcttatgaggaagaataaaaagaggcaggaaaaaccaggaagggcagaaacgtagtcaataaatgcagggggaaaaataggcatctcattgcatggaaacgaagtgaaggattgaatgtctagatgcgaggggaaggcaggttggggcagaagctggcagctaaggcggcgaacaaatctgggggctcagagaagaaaggaacagaggatatgcaatcaggcaatctttggttcaattcctagttctgtcccttactgtgtaaacttgggcaagttacttaatctctgcccttcagatgctaaaaaataatcctcagaaaaaggacagatactccaacaacactcctacagtaaatatgataacttctaagagttttttcttcttatgattttaatgtaggctgatgacataagtccaaagtacgattctaggaaagaatcttacaggggacaaaatgatgtatttcaagtgcatggctttctgacagtttggcttttaagagtatctagaggtgaaatagcaaatggattttatattgcatgccaatgctaggagatgccaatggctgctcaaagcactggttgggtagaatcatgtttgagcaagagtctaggctcagcataagaaagggttatggattaaagaagttgcccaggggcgtggaaaggatagtaagtagcaagagcagtgccatatacagtatttgctgacactgaattagaagagaaaatggctatgtatccatcagatagttctccataagtgatattgagctttttgataagtaatgaattgtaaagatttccgagaagtagaaatattctatgctgtacattaagggtaagaacataaattacagtagtcagctacagtcagaaagtgtgacatccttttatgaatgttaaggcatgtgaccagtttacattcattaatttagcagaaggtctctccacctgctcaagggggaaagaccatggaaatatctgaggcaggatcaaaatcttccttggaaaaacaggatactctataagacatggacaaaaaggagatgagggttccagtgcttcatatccaatgatcatcatcattttatcttgaaaactttttttgtttttttttttttaagagacagtctctttccatgttgcctaagttagtctcaaactcctggactcaagcaaagctccctcctcagcctcccaagtaactgggcttccaggcatgtgccaccatgcctggcttgaaaacttttaaaagtttcttttgccaagcttgcttaatagtatttatagtatatgcacctttaagcttgatgtacttacagtctatgcactttggttgaatcttccaagacagtgtatttcattatatatatatatatatatatatatatatatatatatatatatatgaaattatttgtgtgtgtgtataaactattttatctatgctaacgattcaattgattttcttgtattttctacatagacaataacttacacataaaaatgataatttctatgactccccaatatttgtaccaattatttaatttcatttactttttacccttgccaaagtgtcaatagaatgctaaagagtaatggcatccttttttttcttgattttatatacttctagatatgtatatatgtacacacacccacacacacacacacacatatatatatataccatgtttttaaacaaaatctcatcttgaactccaatacaggtgaagcagaaccattctggctgaaggggacgtagagggcttgtttttcatcaaggctggcactgacgacttcacagaacatagtttgaaagcctctgctgtaagattagttacgaaatgcatccctaggccacaaaacaaattaatttgctagattagaatgttcatctttatgaacaggtgaaatgttggggatgtttataaaaagtaataattttttatttagtcacttaaggcaattataatcattaaaatacatctcccagtgtctggattccccagtctttaacaaaaccatgtggtagcaccaagagttaactccagtacaaggaaggctgtgccagtcccagtcctgtgcttccctctgcctgtggagaaggtctgatctgctaattgctcctaacagggtgtggtcttttgagaaaaatggcacttcaaggcccaagaacactgcaggtatttcagtcttcacatctgcattctgggcagcaggaagacaaaaaaaggaggaagaataaacttgcttgttttatttttttgagacagagtcttgctctgtcgcccaggttggactgcagtggtgagattaaggctcactgcagtcttaaccttccaggctcaagtgatcctcccacctaagcctctcaagtagctgggactacaggcatgtgccaccacatccagctaatttttatattttctgtagagtcacagtctcatatgttgtcagggctggccctgaactcctggcctcaagcaatcctcccgcctcggcctcccaaaacttgcttcttgaaaaagcattcccagaaatcccaccaaattaactctttataattcaatagtcaaaattttgtcacacatggccacacctagctgcaagggagcctgtgtgttgcactttagcaagacagatggaacacattcctgttgacactttagggctgttactaaggaacattcatccagtaatggtaacagctaggcagaagtaaccaccactcccctgcactactgtgccatgtgtgtattttactatatgtacagatttgtgttaccactaccatactcaggatacagaacaactccattaaccacccccctcctccaaacttcccttgtgcctatcccttataatcacatcttcccctgtaactatctcctggcaaacactgatctgttttccatcactatagttttgttatctcattaatgtcatacagatggaaccatatagtacatggtatataaccttttgagactggcttctttcagtcagcataatgcctttgagattcattgaagttgttgtatatgatagtagttcattcttttcaattgctgagtagtattccatggtatgaatgttttattcattcatatgaaaaacatttgaattgtttctactttttggcaattataatagagttgctatttgtttctaagtgaagttaagttctcatccacatatacctttttatttgtatttatttattaaaatcatttttttgagacagagtctcactctgtcacccaggtaggagtgcagtggcaccatcatagctcactgcagcctcgaactcctgccctcaagcagtcctcatccctcacctcagcctcccaaggagctaaggagctgggaccataggtgtgtgccaccacacccaccttaacttttggctttttgtagagacagggactgtgttgcccaggttggtcttgaactcctggtgtcaagcaatcctcctgcctcagtcttccaaagtggtaggattttaggtgcaactactgcacctggcctacatttttattatgacattatatacaaggacattgtttgttaatgtgttgttcccttcctatactgaactatatgtacccatatggtttaatctgtgaccccaccaaatctcatgtcaaattataatccccaattttggttgtggggcctggagggaggtgattggatcatgggggtggatttcccccttgctgttctggtgacagtgagttctcatgagatctggttaagtgtgtatctcacagcttgtggaactgtgagctaattacacctctttgtaaattaccccatctcaggtatttctttatagcagtggaagaacagactaatacagaggtgtctggatcattggggtagatttctcatgaatggtttagcaccatcgccttggtgctgtcctcatgacagtgagttcttgtaaaagtgtgtggcacctgcccccctactctttctcttgctcctgttctcctgtgtgatgtacaagctcctgcttggccttcaccacgactgtaagcttccagagtcttccccagaaacatagtccttcccagtgctatgcttcctgtatagcctacagacccatgagtcaattaaacctcttttcttgtaagttaccaagtgtcaggtatttctttatagcaatgcacgaacagtctaatacatgtacctccaagattttgcctgacccaaagcaaataacttagtgtagtggttaagagtacggtcccttgcctgtgtttgaattttagctctaacacttaatagtggtgtgacactgggcaagttacttgacatctctatgcctcaatcttcccatcctagataactgggataaagagtttctacctcccagggtattgtaagggtttttttttttcttttttaaagtgatatatgtgagtttgctgaggttaaagtagtgtcttacacattttcctatctttagcacctagtaagttcatgagaatgcagatgtttacaattttttattgaataaatgacattaattttacaaataatcctaacatacataactgtatattcactatttttcttcaacaaatatgaacacctactatgcccaggcattgtgctaggcactggggacagctggaaacataaataactcattaggaggaaaatgaaactttgatacagtctattttaagctatttttgttctcacagaactatccttccttaaataaaaatcctttccatgaaaatttccttttatagaagtgaaacagtaaagaatgcataacacatacactagcttcaatgactttccgaaggtcatattaatatactttttgaaccaaagagcaaaactaggattaaatagaagacaggaaattaaatgagggtatttgagctctttttcttaatggagatgatttcaaatttgtggtccccagagcaggggcatgtacttaactatttccaataaggttgtcaattctgagacttcccttacagtaatgctggtgaaaataacttaggccatatttccagattaactagttaaatatttcatttccttaagtgtgctggttggcgtggctctaaataattagattacagggcggtctaattatttggttcaaacagtcatgcacacaccctaaggcttaattaccacgaacaaatcaatcccacccccaaatcgttgcctgtcactgacaatagctttaactgtacttgcacagttaaaggagtccaacgagcattctaggactgatgattaaaactttacccattaaaataattgcactcacttggaaatcagttttgtttttaattgtagaaccagcagttctacccaatttaaacttcagtcatatctctcaagacagattaactagagctgattttttttaaactttgcttaccatgaaatacacctttctattcttaaaaaacaaacaaacaaacaaaaatagggctttaaaaattcgtaaaataattagacctgggactttgtccagggaatttcgccatttaagataaagaaaactcagcaacattatgtctagttaccaagaaagatatgtgcaacgcgaaacctttccccaataccatatttactctgagaaacacagcaaaataaaattcacgatgaagttacgatttcgacatttttattagtcatcagcttactgctaggttttaaaaggtgttccaaggcgggaagaaggcgcggggggaagcctcagaatatggggtctgtttcgattggggggagcggcgttagaggggcgtgaaggcagaaaggaagggtagggcggaaattagcgacttaataagacgcctagctcccgaggaagccagcctggcgttagaagcaagtagagcagaagagatttagggctaattaaaacaatcacacgacactccccctcgcgtttgccggggccgggtctcctgcactagcagagccgggggcggggattagctcggattcaaatttaaagcgggaggcccgcgtgtggctcagcaggtgcctcatgcccggctcccgtggcggtcgtttccgcccctacctgcccagagggccggaaattacctagcgaggagcggcttatccattgttgccaatgtttcaactgcgcggaaaccctgaagaaagtgcggagcacagggcacgcgggccgctcactgcccttccacgcgcccccacgtttctggccgctgcgctccttgccgtgcttttacaatgccacaggccactgggggagaccggagcgaagccaggagggaagcaaggcgggaggaaaagggagaagtgtaagaagacacaggcgcccgggatactatataatctggttctgagctagagggagcgcatgcgccggcgacacttctggcggcaggagaaaggcgcgcatgcgcagagccgagacgaaaaatgaagccacagggtgcctggctgattgagggcgctgctttagctaccgaagggccacagcgccccgaaggcgcgtgcgcagagcgcgggaagggggtggagctcttctgagggggccggggcgaacagagccggcctcgcgcgccccctggcgcgcgcccggggagaggaaggagcgggagggggcggagaggagggaggaggcaagcagggcgggaggggggaggggagccagagcgagggagggtttatcgaccgggcgattttggttaaaatattcaaaatggcggacggaggagcagcgagtcaagatgagagttcagccgcggcggcagcagcagcaggtaatcattacagcattttacatattcatattcatactcaaccccggctcccgctgcccccccccgcgacttagcataatttattagtactcaggattattataattaacggcggggagatggggggccggggagcattgagcccccgccgggcgctgagcggagggggaaagaggctcggagcggccaggcggagggggaagacaaggggcaaagggggctgcgatccactgccctcctcctgcacccggcccaccccgccgccgctcgccgtctgcccgtcggcaccggccctcctcctctgccggccgccgctgccgcctcctcgccgccgtgcccgaacccgagcgggtccgcggcggggcggcggggccggggcagagggagaggacaataaagacattttacatattcatagctgctgggccggcggggcgcagtagggcgcgggcgggcggccggggccgggcgggcgcggggtggggggcgtgaagggggatggaggcggcggcgagcacaatgccggggaggcggcggggccggagcggaccccggcggccggacacccgcacgcgtcttcccccgggagcgggcccgggcgggggggcgctgcccgccttggggggcggccctcagggcaaccgggggtgcgcgcggggagagctccctgcccgcgccccgcgcggggatgagcccgggggtcacggccccaggcacttcggccgcgccccactggtccccaatgtggtggcctgacccaagccaggcctgctctctaggtgggtaggggtgagcggtcgtgggcgctgcgaggtggcctggggcggcgggggtggggaacccgcgcaggggtctgcgtgccccccctggggggtggactggattggaaggagtccttggggcaagttccttccgaggggatgtcctctggggcggcccgcgcgcccccggccggcggtcggcagcccctttgcgttgtcggccggggcttcgcgggcgagttgggctggaggtgcctggcgtggtctgacctccgtctccctttgcccctccccgctgccccccctccgttccccccaccccctgcgcctgaccgggacgcacggggcgggtggccctccggggcctctcgctccgaggccccagaagcgcccagaggcctcccgagaacttggatgtaaagggctgccctcctgccccagaatgggctggcctgacaagttgatcgtattctcgatttcctctctcctgttgggagtcggtggggagggacggggatccccctcccttcttctgtggcggtgttttctcgctgtgtgctgggtcgtctttactctctgcttagctgaacctcttctcatttgaataatgtctaattcggggaggtttatattattgaaatggccgcctggctttccccgcctctcatgtttagtaattcagacctttaataacagccactcacagcccaacgccgtgtttatattttacattcgccccatgtgcttttgtggttcgatatgattttttttttccttggcaatccgcagggctctgagatcaaacccaggccgtgctgggaagagaggggggaagctgggccttggcttctctagcagttgcctaggcctcatgttctctgctgcttgatttatttactaataaccaaaatgactacctccaccaacttccacacactttcccctcctctgcgggcaaaacaaactctcttggggctttactagcattaaaacaggtcctagctaagtatcaactctgtgatggtttgttttctcttaaaaagactttcttatactttgcagtagtattgggcctagggggaaaaatctgtcctgtattttattttcagagcctatgaaatctattttggtttaatccaaatcactttgttttggggatgggtaccccggttgctccccacccccatgttaaatactttaaggctttgtaaaggtctgtagtatttgtaaaactgacactttttttttcctctaggagttgtggagtagctaaatattagaaattccaattaacaacagtttcataatttcttggtgtggtgctacctttctgacatcttcattctaatttaaaatggagctgacgttaattttgtgctatcattgtcatagacttgcttattttaattgtagcactactgaaaacaaaaaaatggggttatgttttctttgagtatttgtgtcatgattaaatgagtgaaaagagaagaataaacataggcattgcgtttaccctgatcttggaacttattctcctcccagcacacccgcccctcctctttaagttgtcagaattgatgttatgttttatctagacttaggacagttggcttgtgagaggcagattaacttttactgtttagaggaaacagtaattttgatttttggtctttcctgtggtaaaattttcttttaacatttttattttgtgtaggggtgtgtgtgagtgtgagtgtgactagtgttgcctgtcactggtggatgtttaccgctgcgtagtcgagggaagtattagaggagtggggtttaacactaatgtgttaaacctttgaaattatgttaagacattttggtgagtggctagctatgtattttgtgggactttggtcttcagtttaatttgtaacaaaattctaggtttgatggattaaacgcaagctaatttcagataaccagttctcaccatttttcttctttcactcacagtaggcaggccctgaatgcagcaggaaaaaaaaaaatctgtagcttttaagagaaccttcaggtgaatgactgcttcagagacctgaagtatgaggtcagatggacaaaaagcagcaatataatttcatgccttaaatagcatatgtttttgcacccgattcccaagatgtggtcaaactgatgatgtcattggacagaggacaaggtgcagttaatttgatttattgtcctgaggtgaagtgtagcagtgaagccttctcatagggaaaccatttatttcgggtcaatttcctttatagctgcaatttaatcactactgaggccgtagatattttatacaaaatgataaaatgtacattggattttacaagcaaaatttcgctgttacagtttttgtaatacagaaaaggatggatgttgttaactggccttatattttggttcacttttaatgctattgtaaaaattcatttcctcaaaattctcaaatggagtatttgggttttagatagatagtcatagaagtgacccatataaatgtttgttgtgatcccccagacttttataagaaactgtgtttcttaatcagagcatggcttaggctaatggagagaccatttgccttagaatccatttcagtgaataaagcagagttgagaatgagggctgtgtattctttaaggtggaaatgataatgttgaaaataaggtagaatactcacaggaaagcatgtgcttttaaaacagattttttaaaaaaaattcagaattctttttggatttatcttagtctggacaagtttgttcattttgttttgattagtgattttaaaattgttccattgcaacagtgattgcacttagaatttttgacatattaatagattttcttgtaagacatttctcatatttttaattattagtttattttaaggtgatgattaaaattccctgagaatgtgataaaattgctttatttctaacctgaatttgtgatccaattttgatagagtattttaggttacttttgaacccacatgagtttataacctgcctgtctccttttgcatctgtcaagtagtttcccgcgtatttctaggaaatccattgtcactgtcttcttttttttttttttttttttccagacagagtcttgctctgtctcccaggctggagtgcgttggtgcgatctcggctcactgcaacctctgcctcgtgggttccagtgattctcctgcctcagcctccttagtagctgggactacaggcatgcgccatgacgcccggctaatttttgtattttttgtagaggcggggtttcaccgtgttggccaggctggtctcgaactcctgacctcaagggatccacccgcctcggctttccaaagtgctggattacaggcgtgagccaccatgcccagcccgttgtcactttcttaactctcccacctattaattacaatgatacttttgaatcaaggtcttgaaaattcatgtgacagctgaccaactgtttttgatttctaaaggactgttctgcttccaaaccattaccgtaaaagcaatttttaacctcttccctcaaattagtttgtaattcctttcattttgtcattgtcaaaaatcccagtagacaaggaaaaaacaaaccgtagctattattcaggttcaaatgaattcaggtgtagtgttctgccatattttaaatttactattctctacatcaataggtagtataaagcagtgtaaataaaatatgtttcattgctgcctagtttgaagtaattgtcaatctgccattcatctggttagtggattttgcaataagttcagggctcaaaatgttacgttgctcttctcaagccaccaaagatgtttaatagacccttgaatatcttaggcaggtggttctgaaataacagaagtggaaatttgaatgttatctttaagtattttctattaaaaattgaaatatttgacctgcttcttgaatctgtattgcttcatcttgaatttatttgtgttttttaagttggtcactcattttcatgaatgtttcctttgtacttggaagactgtaatattatgtagtagtgattgccttgttgttatcggttatttttgttttgttttttaattttgaaaccccatagttgtaatctttgcatattagtctttcaagcaccattaaaaataatgttgtgtgactcattaatttgcctttatataattgtgttaattacacagtttttgtgattagtaaagacttgctatgaagcctgattttaagcaggaatgtgtttttcctaatgaaagtgattgcatttgaatttagaactattcaggtaatttgcgtttagggaacagaccaagtcacaaacaaaacatgcccccttttggttatccatgttcttgtttctgatccctccttaaatgctaaatgcctgagcaaatgtacttactatttcttgggcgttagagttgaaagttgttgatttgattcagtgacatatctgctttgaatttctgtaccctttctgcatgaattttttccttttcctttttttggggtaactttgagtcaccattttgcttacttcttactgtgttgcttaaaggatgtaaatatccttttgagtggttgaaagggataataattaaggttcacagagaatagcagtttccttatgcatctttcgctggacatttttgtgcattattgacatttcataagtaaagagaattgaataactgtagattttaattcttcttaggaataaattggtttgttttgtaccgaagtatttctgtgttctaaacaggtgatgagctcttataaactgtttcagcagtaataacaatggaaacaaaaatagcctgagtagagctattgcctgacttacttgatccgtttacagtatgtttagaatttggaatatgagaattgtcttgagtttcagaagttctgatttgaagatgctccttgcatacagtgcatgtggttatggggttctgtgtgtttttactatggggtgtgaattttttgagcattggtatctttgtatactcagtgactaatagagctcttttgtttttgggttttatttatttatttatttatttccaattaagcaagcactcaagatttcagtgttgcctacatttgctgacaggactagtaattgagcaaaagaagaatcagcaaacctctagatttatcagattatcttttattcatttattttctcttatttttaattttttttaagagatggggtcttgctatgttgcctaggctagtctaaaactcctgggcttaagcagtcctactgtggcctccccaagtgctgggactacaggcatgagctaccacacctggcccagatttcttttaaactgctggaactcctggacatttatccggagaggatacattatactaacttttttttaacagccaatgttcacattccacaaagctaagtgtttgtagtagctttactaagtcttcaatattgaaagtcatagcaagtgcaatttatcacattatttatttcataattctttgtaactttatgctttttatgttggaatatagaaatggtatatgaaattaaatcaataataataattattatggcaggtttccccccctctgttgaactttctctttgcaatagaagatataaacaggaatggctggaaaatgaacaatatgctgtgtgttaaacgactcatttgtgcttaaacatatgattaccttaatggagttgcactgataccttaaagggaatatatttttatatggaaaagtgacttaggtgttttcttgttttagtacacttattttagtggtctgcttaatgaaaaatacagccttttttggctgattcatactgcagcaagcaatattataattaatgttttaaagtagttaccatcctagtctataaaaggtatctgctatgtacctggtcctatgcctgtagtctttgggaataacaaggaaatatgactgctgcggaggagttggtatgtttacttaagcaggaaaaattgaaaaacagtgtatataattacatattaaaatatgtaacagataatgaagattggagaatagatcagagtgtgtccaagtttgaaagagccagagcatcctagaatatattatagctggaaggtaatttagatataatctttgctaaaggttttgcttcacagatgaggaaatattttcacaatggtttagtgacttgctcacagtcacttaactattcagtaacagataagaacacaagacttctaactttctcccacctcccagtctctcctcctgccccattgctgtcagtcagagaaggctttatgtagaaggcgagacttttaaaccgagctttaaagggcaaaaagaatttagaggaatgggaatacagagaaggccattgaaggggagattgtgttcaacattgtgatgtataggtaaagaatgaggaagcatttgttctatctgcaggaaagctgttggaggattttgaaatagggactgatgtgataaaaatggtgtgttaggagtaatgtggtgtgcaggatggtttgaaataggaagggagagattagatccatagaaaccagtgtatagaggtatttggtttattaactaattactgtaggtgctactagagatacaaacataatttaaaaattacttgacctcaagagacttccagtctaatttatgaaatagataagtcgtgataaaggtgttgaggatattgtccaattacattacatggaataaggacgtttgggagaaattcttacctggcctttacagtagaaactatttgtttttagtcttatggacactgaattgtctaattgacttagtttccttttcaaatcaaactacagtttgatttggtcaaatttaggtcagattattaacctgagaagcacatgcataggcaattacgtttgcatttcttagcctgattagtagatcaattttttgtccatgcatttgttttgtatttcttgtattgcttccatctttaaactctttttatcttgttttatgtgggccaccttacatcctttctggagcaaggcaggtataaataatattaccataaccatggcacagtgataatgtctgtatttttatagtactttgaaatttatagccacattctcattttcattacctcagttagtcctttcaggcaagcgttactatacccattttatagtcgagtaaaataaaacttagattaagtgactttctcaaggtcctgtgtttttataagcattaagtgtgggtaatagcaagacttccagcttagttgttatttaggctgtgtattaaggcactttggggctctattgtggagagctctgaatcctttgtgttggtgtaagagtttggattttatttgctaggcagtaggaagtcactgaattttttttttttaatttttttttgttatggacagtgccatgatcagagcccttaaagtttagcagctaattagatgcaaagagattatcaaggttttgagtttaggttatccagaaaagagcattaccataagcagatgtagggatgttgggaaaaggagccatttggggagtaagtcagtgaattcactttgacatgtcatttgagacatgtttgggtgggtcttattgggttgtagattccttgtgaaaattgaaaattttttagtgaattaaatgtttgataaacattaatactagggttgaaatttatgctcatgccactgtgcgtgtggactgagtattgaatctgaacgttgtaaattctagatatctcattttggctttggcactgtcttctaaggttatttccttcaacaatacgatggtgataataccagtgttagagggatgctgtggggagtatcaaattgatagcagaagcatttttaaagtaactctgtaatagtttttcttacatgagcacaggagtaaaatcaggaattttattacttgtgctgctgtagagaagcagaagctttagcagccgatggattctgtggggcacctgactgtaggttgttcattttttggtgcagccagcatcttaggaggaatggacactcctaatactcttctgaaaactttatacagtggaggtgttgcattgtagcaaatacaacttaccttgatttcagggcattctgttatctagcccctacccttgcctatgcattattatctttactacttccttaaatagcatgactcaacaattccatcaaggaagttcccttattgtccatttctaccacaaatacagcatattatcagattttaatttttaaagaaatttccctaaaatttgaagatctatcttgggaggatggctataatttatcctgagacttacctgagcctttctcccattaccatccttgcaacaccaatcccagtttgagacacatgacctgaaagtgtacccagtgttttggtcaagccagtgtgtttgggacgttgtgtgagaacctttactcacactttttcctccattggaaggccatggtgtatggtatggtagagtgaaaaaaggtactggggggttcagagacctggcttctctgtcactaattagcttagtaactttaggacaagttacttcaccatggattttttttttaattgcatttgtaaaataagggatttcaaacttttaaaagcctttggtgttcttttttaaaggcaaaagtggagctgttctgattaaaattggatattggagcaagaaaagcattttcctcctcctttccacagtagcttttgaggcactttcacagggtccttaggacttctgctggtcatgacttgaaaacttttgtccttatttatcttaagggacctgtctgtccatttctttatctccacaaatagccatctgtcaaatctgagctcctgtcatactttctctgaaattagcacttaatttgtgttcagttacccaattcagcacttcattatacacagtcctattttcttctctaattgattatgtaagtaaatcttgtcctaagagccttgagtgcaggaacatactggtagggacagagtaggcctagacatttaacaaataatgaatgcttggttgatggacttagtggttctcaatctttgtcaccatggggtgacccatggaactttttcaacataagaaggcccaacttctaatacagtagaggtctgaaaatccatactttaaaaaagctctacaggtgatttgataacattaaatgattacttgttgcacttcaagattatttattgcttagcataccttgaataatggttttcagttaatgcaccagaaaggccctatactggaaagacagactgagaattaggagacttggatccttattctgcttttagcattaacgataatagctttctgatcctgaataaatcactaaatttttccaacccataggattcttattgataaaattatgggctgagctaggtgaatagttttcatactttttttttcctttttaaactggaattattcagaaacatcttttgggtgaagaccagtaaatataacatatatttttatcagttcggctttcatctgggtacctgaatatttattaaaaatatagaacatggtaagcttggtcctgtcctagtaggagagctaaattgtatgcagtaggtagtactgaagatgggatttagactttaaacttgaaacatcctattagaatgcgaatgaacaaaggtagtaagcttatcaataattgtggtactcagtgtgaataaaaactagattatgatgaaccaatatggccagtctttctgcattcatttaattcaacaaatatttatagagcttctgctccttgtaatgtactgagcactggtggtagagtaatgaataagataacatctctgccctctcaaaatgtatattggtcagttggggaaatcatatgttaaataatactggttgtagtttaatgagtagaatacgagagatttgaagtaccccaggagcataaggtggggactgctaatctggacaagaggatttgggaaggggctctctgaggatatcatgtttacaatgagatgtgaaagatgaataggaattaatcagttcaagaactgggagtgagaagtggaattgaaaatgttctgagcaaagggaacactatgcagacatctcagacatccctcattatacacaggggcataccacaaggggattggttccaggattccctactcgtgtgccctcctcccccaacacacacacaccaatatcaaaatctgcacatgcctcagtcctgcagcaggccctgtggaacccgagtatgtgaaaagtgtgcctggcccctgggcctcagagcccctgtgactatgagctgtttgcatcccgtgaattctgtatttttaatttgcatgtgattgaaaaaacctgatttaagtggacccacacagttcatacccattttgttcgagggtcagctgtacaatcacgtaccgcataatgacttctcagtctatggaccagtatacaatggcagtcccataagattataacagaactgaaacattcctatctcctagtgacattgtaatgatcctgaccctgtgtgggcctaggctgatgtctgtgtttgtgtcttagttgttaacaaaaacatttaaaaggtaaaaatttaaaaaatttaaatagataagagcttatagaataaggatataaagaaaaattttttgtatagctgtacagtgtgtttgaaactgttattacaagagtcaaaaagtttttaacattttaaagcttataaagttacagtaggcccagcgtgatggctcatgcctgtaatcccagcactttgggaagccgaggtgggcagatcacctgaggtcaggagttcgagaccagcctggccaatagggtgaaaccccatctctactaaagatacaaaaattagctgggtgtggtggcacacgcccataatcccagctactcgggaggctgaggcaggagaatcacttgaacccgtgaagtggaggttgcagtgagctgagattgcgccactgcactccagcctgggtgacagagtgtgagactccatctcaaaaaaaaaaaaaaaagttacagtaagctagttaatttattattgaacacagactttttctcttataaatttagtgtagcctaagtatatggtgtttttaaagtgtatagtagtgtacagtaatgctgtaggccttcacattcgctcactcgtcattcattgactcacccaaagcaacttccagtcttgcaagcccattcaggtaagtgccctctacaggtataccatttttaaatcttttataccatgtttttaactatactttttctgtgtttaaatatttttattttttaattttttttttttttttaagtagggtctagctctgtcacccagactggagtgcagtggtgcagtcacagctgactgcagcttctaccttccagggctcagatgagcctcctacctcagcctcctgaggagctggtaccacaggcgcacgcacccatgcccagctaatttttttttttttttgtagagacggggcttcgccttgttgccccggctggtcttcaactcctggactcaagcagtcctcttggcttggcctcccaaagtgctgggattacagatgtgagctcctgtgcctggcctaggtatttttaaatacacaaatacttaccattgtgttaggatgcctgcagtacaacagtagaataacatgctgtacaggtttgtagtctaggagcaacaggctataccatatagcttaggtatgtagtaggctataccatttgggtttgtgtaaatatgctctgtgatcacacaatgacaaaatcatctaatgacatagcatcgttaagtgatgcataactgcacatacaattcttgaaactaatgaaaacacagcactttcaaggaacaaaagttcagcatagctggttcaggaagcatgagatttagctgaagagccaaagatgattttcatgttatgaggctatttgcatgatctttgtactttttagtgacaagtccacagttggaaattgtggacgagattccatacttttcaataaatacattgattcctagtaacaacagcaataacatttatcaagtctttgtgccagttgttgtactaaatgctttacatgcatttatgttaattacagtgacccccatggggtgtgtattgttatcctatctttcaggttaggaaaccgaggcttaaagaggctaagtggcacacctaggtctctgttttgattatagcagtaagcagttaagatcattatcaggctcttacccgttaatttctgcttcaggccagtggaatgatgaagcatatatcaaatggaattgggggattgcagaatttccactgttaagatctatagatttaacagctgttattctgagtttaacctcagtgtttgtacagttcccaggtccagattgtgtgctctagaatcaattgtgcattcttatctctgtattgcattttggagacacagacaattgattatcagatctaatgttaacttagctttcaggatttctagatgctgactataaacgtttttgaagttggttgtatgcaaactgctgatcctggtaacccatacattctcaacattttgggtttttgttaagaattgtattttagggtaggtttggtggcttatgcttgtaatcccagcactttgggaggctgaggtgggaggattgcttgagaccatgagtttgaaactggcctgggcaacatagcgagaccttctctctgcaaaaaaatttaaaataatagccaagcatgttggtacttgcctatagtcctaactattctggatgccgaagcaggaggacctcttgagcccagcagttccaggctgtgatggactgtgattgtgccactgttctccagccaggatgacagagcaataccatgtctgttaaaacaaatatatatgaaactgaagctaattacacatgttaaccttgggataattttcatctggagcagcatttatatttttttgtgacccagttggtgaaatagaaaattaggatttaccctgtttacatgttattttgataaaaacataatttaaactatttcagtgttgtcaaatgagttgtgacttaaaattaatatgcaagcaaattatgcaaaaaggtggatttgtttaccactttttaccaaccacttcctttctcccataccaagctgttactaaactagggctgtagctttcagttgaggaaacatgacggttgattattgtttctaataatagctattattagaagtcagctatttcatggcattggtttccagtcattcacacctcatttaatcatgccctgcatcaccttgttgagttgttaatgctgtttatttctcaatttttcttttacactacattgctaagtccccccatcttcctcttcatagtgctttccctaccctctgagtacttgcttcttcatgctctggccaaggagagtggtgttttggcagactgttttatacatgtacacttatatgccaatcatcattagttagaaaggaattggtgaaaatgctcttatgttatgagagacatgttcaacatcacaatagtctgagaagatgaattaacaatttatgagtgttgctggaaagtatgatttcaggcgattagactataggggcaaagccattgccggcttatgctgttggaatcacatcttagtagttacataatgccatcaggaccagtacgagactggtttggtgattgagcccatttcctgggatttgttcctatgtattgcagacagatgtccacgcttaggtgtgcatgctcctgtcatgcatgtacacataatttttaaaaaaggagtcatagtgcatatcctattatatacttgctgtttttcccccattgctctctattctttagttcactcatttaaataagataaacattttaatgaaatcatattctttgcagtaacttggatggagccagaagccataatcctaagtgaattaatgcaggaacagaaaaccaaagactggtttggtctgttctgctgagacctagtggaggaggctagtccaaaatagtagtctcccataaactttctttaacagaatatacacacttaaaaattttgtacatgtcgtcaggttgcttttagtaccactctatattttttatctacagtatttaatagtgtcagtttctcctgcactgttaactattagtcttttaaatttttcctaggttgatgaaaaacacttcattgctttaattttaatgtttttactctaatttggacatctttttttttttagacagacgattgctctgtctcccaggctggagtgcagtggtgtgatctcggctccctgcagcctccacctcccaggttcaagcaattctctgcctcagcctcctgaggagctgggattacaggcgcctgccaccatgcccggccaatttttgtatttttagtagagatggagtttcaccatcttggccaggcaggtgttgaactcctgacctcatgatccacctgccttggcctcccaaagtgctgggattacagacatgagccaccgcgcccggccgacatcttattattaaatttttattaaattaaatcttactaaattttattaaatataaaatcttttatcattagttttcaaatgtacaacaatgatttatttttcctgttttggccgtttcagaatacttgtagttttcctgaaaatttatgacttcttaaatattctctttccacgtgtgcctgccccacctccttccccgcagctaattcctatacctctttggagaagtagcttagggatgcaggtggagcttggatcagtctacctgttagtcacatgctttacttgcatcccactattagctgttcatttatagaaaggggatggttgcagagtctgggcagggatgggtcagctgtggcactgtggtcctggagagtcataccctactcttggacaaaaatgtttctcttagcagagaactggagtgagcatattttttttactctgctttctctaaaggcaattttaatttttaagtcaaatatatgggaggtagggataaaggagaaatggaaagataatagagttttagcagtctaggggtctatttcctacacaagggcttggaaatgataagactaatcctgaaatattttcagtgctggatttcacctaacctcctagcaagcttggagttctctgggacttggggagcaagaaatttaaggaagctgacaataaggaggaaggtatctaacttctgagtagagatggcttgatggtgatgatacttgtgaactagggttaacatacagcagtgacagcattgtaaagtctgtcagtggtgagaaaagatgacagtgaccttgaaggagagaggctatctaacgagaacatacttatgcgtgttggggagtgtaaacgcctacctagactttctgctgggttatttagaatgttgagaagttaatagattcatattgttgcatgcataagtttttgtcctactatttgggatggatgaggaaagagctcagaaaagaaacaggttacagtaacagccctgttggtcttgtttgttgtttttccggtaccctttggccatttttatcaagtaatttttgtattttctttttcatctgccggtatgttatttttaccattttgagtgatgtctgtggaataagaaatgtttgtaaatattttgtgacttacatggtaagcttgactaggtttacacaaagtcattttgtactaccatttgtctgatttctacaaatacattatttgggggtattctttaatttttctttccccttttgtccttaattcctcttcccctgttcctccagttaattgagttactggttttattttttaaatccatatatgtgtgtgtgtatatatatatatatatatatatatatttttttttttttttttttttttttttggcagagtgttgctctgtcgcccaggcaggagtgcagtggcgtgatctcggctcacttcagcttccacctccagggttcaagcgattctcctgcttcagcctcccgagtagctgggattacaagtgcgtgccaccgcacccggctaatttttttgtattcttagtacagatggggtttcactgtgttggccaggctggtctctaactcctgacctgaagtgatctgcccgccttggtctcccaaagtgccgggattacaggtgtgagccaccatgcccagcccatatattcttaatttcttgagtaagcccttgatttctcatgtgaccttttttctgatcccttaaattaaaaaatttttttgagatgcattaatgtaaattttatccatttatttatttgtttcattttgtctctcaagttggtttatagagatttatcaactgtatggcaagaaatgcaaaataaaaatataaaagacctaatataaaaatctaatatttatttccggtggggcccaaatactctgtaaacttcttagtagatgatgcaaacaaggaaaacttggtcaatttatgcccataaaatttgaaaacaaacaaacttttaagaaaagcacaacaattcctggtactaagatcagaaggaaacttctcttcagaggccttataaacaggaccctatgtaatgtaataaacagtgccctcaacagtcttcctactgtggacacaccaacaaatttcagaatgcccctgtataggccaaatgcatcataccagagcaccttcattaaggcagttaattggtgggagatgaggatattgagtgaggactattcaaaatggtctgacttaaaaagggaaaagattttggaataattagaagaatggagatactgcatattctttaggcaatcttccataaatacctgttttgttcacagttagtacaaggttactggcatagggtaggttatcaagaaatgttttcagagtaaatactgggttgcattgggtttgaaattacatttgttggtgcacatcattgaaggtagagtgataagattttcatgttgttcagggagactagttggctactcagatgggtggctagagtgtactttgccctaaacagtgcagggcacatcctgaaaagttttgttctctaggctcccctttcctattctgaatccaggcacacactctaaaaatctttaacctttaatcttttctccaccattcttttttgtgtatggtgtaaggtgtaaccctgacaaactttttttcccccccaaatggacagccaactgtcctaacactacctatcccttctaccaaaaatgtcagtttcagtcattcagtcatttaacctagtgttctttttctgacatacgtagtgttctttttgtgacataccatttgtcaactgacagaaaaagaacactagattaaatagtctactttaaaagtatttttaaataaggagatatagtttaaatttcgaatatctgtgaatcttcactccccatatcttttttgccatgctatcaagacatagttaactcctagttataataaatacagtgcttatctggtatagatgccactgctttacaagagtaaaagaacatatgtaaaagtgctgtccatgggcagcagttcaaggggtaattttaattcgtaccacaggtatacatacacattgtaaactgctttagtggcttaatggttgtattttgacattgtagtcaaatttgatactcccaccccaaccctcacttttatgctcattctagcaagtgctgggaatgctaaaagcagaatacatagccccttgaagaacaatatacttaaaaagtgatcaccttaatacagacatgaaagtttcctctcagcattaagctagagtttaggtgcttggaatgattgaaattgattttttaggtagaagggccagatggtgttgggacagttggccggccatccatttgaaaaacacaaaaaatgtatgtcgtcagggttatactttacaccgtacacaaaaaagaatggtggagagattaaagattagactgttcaaagaaaaactcagaaaaatactaagacaaaaatacaaataatttttatttagttttggggatggaaaggcttttttttttttctttaagctatgaataggactttatggaaaggcttttttgacatgacacacaactcaaatgccataaaaggaaaagatggatagatttaactatataaaatatttatggttctgccttctgaaagactctacaaataaaattaacataatatatggtagaaaagtattagcctgtatggaacatagagggataatttttcttactatatcaagttctcttagacattagtagtacataacaaataccccagtagtcgaagtgtatgaatagtcaattcatgtagaataagggctgtgaagatatgaaccctgactagaagcctctgctgtaaagacagaaccttctttaagtccgatataaaacaaaaggatgaagaattacaaaatgtatgctttggtagggcagtgaagaaattaaaatattagaaaaaagagtaagagttgaatactggccattgttttagaggtaattgaggaagcgtattttatatactcgtgggtaattttactactttaaaggtggaaaaaatatttaaaataatgaaataaatagagaagggattcctgctgttcctgatttaacacacaggacaacagataaatgattatgagcttatacttagcctaagtttgtgtggaaactgttagtttcttccaagataagtgtttcctagataactgaaaatctactattgttttaattcactttttcttgtgcttctgcataaacatatttaatatatgcctttggtgtcccaatgaagttcaccttttacagttggtttgaagcccttccctagaggtttgccaacgttatttctatgtggaaatccattcagaacccagcttctgaaacctttgctttggggacaccttgttctgtaatgaaattatctgaaaaggccgggcgcggtggctcatgcctgtaatcccagcacattgggaggcctaggtgggcggattacctgaggttgggagttcgagactagcctgaccaacatggagagaccccgtctctgctaaaaatacaaaattagcctgatgtggtggtgcgtgcctgtaatcccagctactcgggaggctgaggcgggagaatcacttgaacccgggaggcggaggttgccgtgagccaagatcgcaccattgcactccagcctgggcaacaagagtgaaacgccatctaaaaataaataaataaataaataaatagtctgaaaaagttctcacccaggagataactctcctctcctattttacacatctccctttgatttgccagtgtaaagcaataaccttagcagaatgatgtcttctgtcataatctatttgtcttcataagggcatgactcaaagaggtctgtagaatctgttttttagtgccgggtgaaataactaaatatttcgttttaaaaggaaggaattaatcaggaaccttttatgattctagctactactgggctgtaaacagtgatgccagcaaaatgttacttcagctgatgaagtgatgctgtttcgagaatttgaaagcaatttttcagtggataaagaagttgacagcacgatttgttggatgtgatgaaggattaatcagcatacaccttcacttgtattagcttaagatggaatggttctgggcaatataaaataacaggttttccagtttatttttattactgtacttgcttgtttataatattaggcatattaattaacacctatgaagcccatttggtatgctaagcactgttctaatgttttacatgaattgtctcgtttaatcttcatgtcaacacttatgtaggcatcattgttatgtgttttataggtgtagaaaactgaggtacaacgaagttaggtaatttcaaaaagttaacataactggaaagtggtagtgttaaaaataatttgagggttttgattccagttttcatgctaactttagttgactaaaggaaggatacattgtctaatttaatcacaaacgcagctatgtgaggaaggatttttagagttctcagagcctaagttttcttaagtgcctaaaaaaatgccttggttaaggaagatatttatggtagaaatgctttgttattgccaattgcttttatcaggattttggacctaagttacctgttaggtgctaaaatatttttaaagatgatgaagcatccaagtgctgcttgttcatttacacttttattaagtaattgtgaacattaattatggtttaactaagaagcaccaatattaatacttttggttttcagagtttcaaagccgcaattttgagttgttcggcctgtttagtgacagtcaaaaaataaatgccatgcacgagaatttcagcactatgagcagtgatagaagagaaccaagaagaagtgtatacctttggaaaatgtgtttcctgttatagacacatagaaggacctgttgcccttgatgattctgcaaagctataaaagctggtacttgaaaaacatggtgtaagaaacccaaatcacagaaagactctaagaccagctttcttaccatggtgacgcattgaagcactaagtgtttgagcacatctcacaggatgatctagctatagaattgacaagattttgccctaagatagttgagagaagcaaatgtatgctttcttccatggcataattttacctatttaccttttatgtgaaattagcccgaatcaggagtcacagcttaacctgtttatatgggtgaaactttccatattgtgagatgttgtttttactagcaaagtaacaagaaatgaagaaccttccagagtttgtaacttactgccttgctatgaaaatgatacttcagatacagtgatgtgtttataatgtctccttttgcgtaggataaatgctgtatctgtatatgtatgggcaaaattcagaaaactattaatcatacacaatgtatacagacatacgtatattctcattctccctctctccctccccctccttccacctgcctctctcccccgctttctttcttatttcctttgtttcccaaaatgaattctacctttattaactcagttgaattttcagcaagtgtctactaattgagacagaatctactgttcttcagtgccgctacttaactatatgctcatctctttctactcatatctctgttttatatttttacttgggacgttattgcatggtaattaagaatactggcctaggaatctgaccggttaatgtttcaataactgaccagtagcttgattccttcaacaaatatttcagtgcttattgtattaggcattgttttaggcacttaagaaaatctaggctctgagaagttaactgtaaaagcccttcctcatgtagctgtgtttaggattaagtgagataatgtatataattgctgagcacgttggaatctgtcgatttatgtaaactatttcttattatcttcaaaccttttaatgacttggaactctcaaagtgaaaaagtaagtatgaacaggtataaatttatttttttaatttttatttttttttgagacggagtctcgctcttgtcgcccagtctggagtgcagtggcgtgatcttggctcactgcaacctctgcctcccaggttcaagagattcttctgcctcagcctcccgagtagctgggattacaggcttgcgccaccatgcctggctaatttttgtatttttattagagatggggttttgccatgttggctaggctggtctcgaactcccaaccccagatgatccacccgcctcggcctcccaaagtgctgggattacaggcttgagccatcacacccggcctaaactgttttcttgaattaagtttcaggattgacagccttcattataacatgtcccatgtaattagcatcatgaccactatcacaaacatactgataaatatagtacaggacccagatttcagcacctgttacatagagccatttgtttttttcccctcttatccgtagctgccctccacaaatatggataatggaccgagagtagactgtgctgtgtctgcccatactctgaatcatattgccaatctcctactcatcctgcctcttgagaatcctgagcacaggacacctgagatagcaaaaggtccttcctgtagtaaaaggcttacagagtcaaatggctggagcggtgtgagaatatggactcaggaactttggaattgggagtacattttagattagaagatagcatgtaaaggaagaaggagagaatttttgtgggtcaggcatctgggcatggctcaggtgggtcctcacaaggttgcaattaagatattggtcagagctacagcctcatctgaaggttcaactggggaagcatatgctgccaagctcactcacacagttgttgactggactcagttccttactggtggtcgaaccgaggaccctggtttcttcctggcagttggccagaggctgttctccattccttgccatgtggacttctctggcttgcttcagagcaagcacatgagaagagccagatagtgttccagctggaaaggagtattagcaagacagagtcacagcttttgtaacctaattgcagaagtgacatctcatccctttttcagtattctgtttattagaagcaagtcacttggtccaccccacactcaaggggaaggggctacacaagggtacaaatagcaggagttcatgaatcattggatggccatcttacaaatccacctatcacctacctactgaaagccttcagtaagctttaagagcatacaggagccctgacacccaaaaattagagaactgctgatctaaatgtatgttacattggtggaacatgtatgggagatataataccttccttaaaaagttcttctctaggataagatcttgggccttggaagcctgtatatggggagtgcaggtaaaatcaggaaagcctcccctttttgtcaacttcagtttctggagagagggatcttaatactacatagctgtcttctaacatcttttaggaagtaacacaactatgacaggaacagtagtgaatgttagaaaaaataaaaggtctgagagaggagaataggagcatattcttgcaaagcagaaataaaactttttaaaaaaatccgtgcccttcagtgaaacttttttttaaaggatctttgtatgttaccttatgggaaactctagaaatcaactctaaaaatgaaattttgagtaacaatttttagaatggttgttaaaatggctaaaagctattatgtgactcaaatttctttttttttttttgtttgagacagggtctcattctgtcacccagctggaatgcaagtggcatgatcgtggctcagtgcagcctttacctccttgggctcaagtgatcctcccaactcaacctcccgagtagctgggaccacaggtgcaccaccaccatgcctggctaatttttttttttttttttttgagatggagttttgctcttgttccccaggctggagtgcaatggtgtgatctcagctcactgcaacctccacctacccggttcaagtgattctcctgcctcaggctcccgagtagctgggattataggcatgcgccaccacacccagctagttttgtgtttttagtagagacggggtttctccacattggtcaggctggtcttgaactcctgacctcaggtgatccgcccacctcagcctcccaaagtgctggaattacaggcatgagccaccacacctggcccagctaattaaaaaaaaaactttttttgtagagatggtttcactgtattgcccaggctagtctcaaactcctgggcttaagcagtcctcttgctttggcctcccaaagtgttggaattacaggcgtgagccactgtccctggctcaactcaaataatttctgaaaattgtgataggattttattgtttatggtagtcattcagtctgaacaagaagctatgtttttcatactcagtccttactaaatggacagacaaaaaaatactttctgaaaatctaagtttatttctgcttacaaatctaaaaataagcaaggttattgagaagaatttgatgtcagttaaactgtattgtaatatctaagattcatgtacaaaaatagaagtaatgataataatgatagaacattaaacaacaaatgagcccttctatcagatttattgttgttgagaaggttgtccttaagtcactttgaatttttttttcatgaagacccacctaggagatttctttcaaatcctaaatacctgaaaaaagttttgcttttcttgagaaatcaaatgctgctgttccccctttcctcctaaagcaaagtttagaacattttcttctttgctttagccaccaggagtcttagtgccaagtttatgcctcagttgaataactttacatatttacattcgaaatatatgctcatttaatcttctatattgttccttgtttctgatttctgtgtgttttacttttctctttaggtctttgcttaaaaaatattgaatgaaattattattataaaattttttagtgaacttagaaaattgttagcttcacaaataatctaagaagtataaattaacactgagaaacatttaaaatcagattgtaagaaatgaaaataatgatgattttcagtgctgactgacaaatgcagtaaattggacactcatatctgttaatggaagtgtaaacctgtgcagtctttttgtagtgacttaaaacatataccttaaggaaattccttaagtttggaaaaagctatgaacaaaggtgcttatctgtccttcattttaaaaaggtgaaatttggaaataacctaaatggaactgttaaatgagctattatatacctatgtactttatggaaggagtaatactgtatttttaaaaatcatcaaaatgaaactgacccagtaatcccatagacagtaaatcgattagtttatacttttagatgctttaggatataaataaattggtaactatgaaccacgtgctatagagtttaatgctaaatgtaattttacaagtaaatcaggttaatatatatgtgtgtgtgtgtgtgtgtgtgtgtgtgtgattgaattttttttttttccttaaagaaacagggtctcactctgtcgcccaggatgaagtgcagaggtgagatcagggctcactgcactctcaaccttctgggcttaagtgatgtaactgcctcagcttctcaagtaactgagaccataggcatgtgccaccatgcctggataattttgttttattttttgtagagacggttgcccaggctagtctcaaactcctggccttgagtgatccttctgcctcgacctcccaaagttctgtgggattacaagtgtgacctgccacacccagcctgtgatacaatttttatatctccgaattttaaaatgtttggatttgtaaaggattcttctaaaatggcatatattctaatctttacctaaatttcctcgttacccaactttttcctcatccaaagcttctttttgttgttgtttcaaacctgaaaatatccatccccacttgagtttcagttttgagctatatagtacttactaggcttctatcaattggaacattgacctgtttatagtttttttttaaaattctgtctataatacaatgatccagtatacatactattccatactgttaactttggtgtaggaattctgttgttggtcagtaaggtaagtggaatatgtctttatgacttattggaaaagacaaacctagcttggcttttctacgtgttttacatatgtacctttgaaaaggtatgcttaaatattaaacaaaaagtacaagtagaatatttataccatgcaatcaaactgtgcagattttgaatgtttaaattttgccatgtttaacttttttaaggttgcatgcagagagataaaacaacaatggacactagtcagattctcataaccagtgagggggaagtatctttttctaataatagaatgatctttggtttgtgaaaagaggtgtgtagttggaagttaatgtatttttctttacagagtatacagcagtttactccttttaacctgttatcagatttattttggaaagaattgtgtgagtaatgttctgaatttaaaaaagcattgcaggaaattgatgtgtgattattcttttgagtacagtgccctttaagaactcagtgggtagttatgtttacttgtttaactgcatcacatttattcatgatagacaagacagcaagttagtagatgaacttaatggatgaatttgttttgctttgttataccttgcaagaaagcacaaaacaatcatctaaggctttatcgtctaatttccatcaggtactgtgttacactgatttgcatacattgctggacttatttttaacagccccctgaactttaaatagaaaaggtagctcctatcctggaagaactcacagttcggtagggaaagggaggcaaggagcaggaacagatgagtcaactgaaattataataccctgtgataaatgctgtgaaggatataaatcctgtatgctatggaagtaatggaataggttcacttaacccagtagtttgtggggaggagggagaggaagagtcaagaaagacttctcaaagaagatccccagagctgagggataataggaattaggttgggataaggcggttgaggggagtatgttccttgtagtactgaacaaacacaagagcatctaagagcatttcagtcttttaactacaataataggtaacatttaatatacagtgcttattatgtgccaattgctattccaagtgctttgtattttccatgtattaactcctttaattttcataacaactttattatgtaggtattataattatccccattttacagatgaggaaactgaggtacagaaagagaaaataacttgtctaggatcacatgatgagaaagtagaagaactaggatttaaacccatgttgtctcatttcggagttttggcttttattatgagaaaagttaaactctggattgcaccggagataagtacctggggtgagaaaaccttttcaattaattcttcttactgaaacacatatattattttcttaaaatctgaagcagtggatcctatccatttttttctgcctctgtaagaatgtttggcatcctttatcttctcatctccaagctttccctagtaaccagccctcttaaacttcagcattctcgaacttctcccttctgttttctctagataccagccttttgcttccccttatctccagacttctttgtaaactcctctaaactccctgcctctgctatataactttcattccctcctcatcccattgaaatctgggttctaaagagagatttatgaggaaacttgctaggcagtgtagggttatgccttctttttgtttttctaatagtgcttgacaggtcaaggtgtagaagtaggagtggagatggcagccctccaggattggggtctttgttaggatgtggaacagaaggacaggggagcaagggagtggaaagtcttgacaggaatgtcattcatggaccctgtggtctcagtagaatttagaaggaagtgaagacgggagtgaattgatggtctaggggaaaatggaagagcaggaggtcaggtgaattgcagaacagctctttaatgggagtaaaagagccagaggtctgggagtattgaggtagtattgggagagtttaaagttttagaggaggaactgtcctgagtgatacatttcaagatctggtggtcattggtgtgaatgactgaagtgacagtcgtgagagttcatgctgactcacctacagtgaggatgggccttgtgtgtgcagtggagcactgtgatgagcaatgaaataatgaaagcatcatttgcaagatggtgttacctttgcccacttcttgctgtcagatggtagatacttatttcattaacaggagttatgtttatttttgtaattgacattttattcttgtttgcatagaataatgcaaaatcttcattgaaaaggagcagtatctgtagtatcaaattcttttgtgtgtcattttttttttcagtatattttctaacataacacttaacattagcagtattttgaccttttctgtcattctggacaatctgttctggcattttccttccggaaaatagagaagagaaaaaaatatgagatgaagaacaaatggttgggcactcatctttaattttgattgttagaattgtttaggttgttagaattctggttgttagaattgttgtagatgtttggggaacatccatcatggatcagatagaaaagaaaacagtgtttttggcttattattactttgctttttgttttaattttatatagttataatgttacaaatatttctcaatttaaattatagtgtttaaattttaggtaagaatggaaaatgatgcctgttaacatttttattcttgagaatgttgccacaggaacattagagaaaaaaagtaatcttgtgttttgagagaattcatttgttgttgacattcccctcagaggatactactttgatatgtacaaataacaaaggtagcaatatggtttgttggttttctttaaactttggcatagccaaacctttagtggaccctggaggcattttcttatcaacaaagtggatcaaactgactctaaaagtggtttctagtaatctggtaaacagaagaaacatataagggcccagcatatcctaaacatttcaattttctgatatactagagcactgtttttaaaaatggattttaataacattgtcttcttagttataagttattttatttctccaaattttgttaccttccctaattatgctcagtttaggagcataaatgaacacatatacacagactttattttgctggaattctaaaagcaaattaagacattattttagtagtttcagaattgtgttcctcaagagaacagtaaagatttaagtaacaacagttttggttaataacagtgaaattttctttttgtgaggtgtattataagaacatctcatatgagtagaacatgaggtattttagctttaaagctaatcttgggccaagtgtggtggctcatgcctgtaatcccagcactttgggagacagaagcaggtgaatcacttgagcccaggagtgtgagaccagcctgcccaacatgtgaaacccccatctctacaaaaaaatccagaaattagccggtgtggtagcaagcgcctgtggtcccagctattcaggaggctgaggtgggaggattgattgagcccagtaagtcaaggctgcagtgagctgagatcatgccactgcactccagcctgggtgacagagggagaccttgtcataaacaaacaaacaaataaataaataaataaaattaagctaatcttgaattcatttgtacttaactaattaggcctagtatttgtcaaattcatatattatttggtagagtatggagggaaatatacttaagtgttagtttggagaggtagttttagtatgttattggggaatttttacttttgactttccctcatggtctctgtatatcaagtactaggaaaacagcatttttccattaaagggctcatacttcttggaacttctggtctgacaggctgatcttgtttgtgtgactacataggctatgtttaggtttctttacgtattaggctttacaaagaagatgaaaacaccatatcacttttgtcatcacggaacatattacaggtttcataatggataacgtaaaataattcagctcactgtattttttgtttcttcgttatatctttttttttttttttaaacagagcctcactgtgtcgcccaggctggagtgcagtggcactatcttggctcactgcaacctctgcctcccaggttcaagcaattctcctgcctcagcctcccgagtagctgggattacaggtgcatgccaccatgcttggctaattttgtatatatgtatatatatagttttagtagagaccgggtttcaccattttggccaggctggtctggaatgcctgacctcaagtaatccacctgcctcggcctcccaaagtgctaggattacaggtgtgagccaccgctgcaagtctcttcttcatatcctgattatttaaatcaaatgtatttcttttctgaggtcttggagttttccccatgttttaaaatgtgtttccttaccttttaacttataacagaatccctttaagacgcttttacaaatgaaggccatgctatttgctattaggattatctgaacagaccaacagagagtatatttgaccaacagtccaggtttcatgtgaagaaggagaagcacgtatgtttgtagttctttgtagtttgtgcctacaaaacagcagtcaccactaaaatacttatttgaaatattttaaagtgctgagattacatgcgtgagccaccgcgcccggcctgaatctgtttttaatgttaattttttatttttctcactgaaggggaaccagcgccctattaaactccattgttggtaatttgagaacacaaaccaattaatatctatattctgaataattatatagttaaggtgcagcttttattatatctggctttttactttgttgcaaactccaaaccaaagaatgttcataactgtcctacagcagtgaaatgaattaaagtaattctggtcattagaaaatctttaaattattttaagaatacgtaactgactgtgataacttcttgtttataacaggttaacatggatgactagtttatagcttttgatcttatgtgtaatgacactgggaagaaaacatgtatccctctaaggtagcatttctgttatttctatgcccaaagactgtgctgaccgccattttgccagaagctttgaacactgttgactgattgatgtgtacatctaattcagatttacataatctaattggacccttgggttcttaaaaaatggccttcttttatcaccatatgtgttcattacaatgcatattttaaaatgagatggcccaaagagcatgctatgatgaatttactgttgaaatacttgtgaaacttggataaacctaattatcaagggacagtttcacttaagagggcaaaagtttcacttcaaagaaaagcctactgctcttgcttttaatggtttgaattatgtttttatctttcatcagcccaagagtttgtacttcagggtcagaaacaaaacttggagcctctgtgaatcctgtaatcatttactaactctcttgtagaacaagatgtcattttttcctactattctgtttcattctttatttttctgccccccccaaacacacaggagagtggaacttgggattataattggttaatgggttttttgggtttttttggtcttactctgtcacccgggctggagtgcagtggtgctatcttggctcactgcaacctgtgcctctcaggctcaggcgatcttcccacctcagcctcctgaatagctgggaccacaggtgcctgccaccacgcctggttaattttttgtatttttggtagagacagggtttcaccatgttgcccaggctggtctcaaattcttgagctcaagtgatccgccggccttgacctcccaaagtgctgggattataagcctgagccaccacgtccagccagaattttttattttttaagaaagaaagtttatcttaggtcctccttcccccataccccattttaatttggtgccaggtttgcctgtctctgtggagaaaagaatagaaatgttggctgagggaaagtttttatgtctcctctaatacgtatttcatttttttctatttgctccttgcttttctaatacaggtaggataaagaggcaacttcaggaatacccagactttagctccatctaggaatttttattggtttgttttttgactagagtgtagaatggaagctcttttggctgggttgggtccttgggcaaaatatttcagactcctgtattatatggtgaattaaattgcttcactggcactttttcttttttaaagcctgttcacactttatacagtttttgaagaggaaaactttggatagtgctctttcaaaccaggcaaatgcctcggtttcttttaaaaaatctttgtaaaataataatattagtctgacttaaaggttatgatggaatacatataaaacatttgggagtctcaattctatttaatgtaggttcgatcaatgttactaatgtgctttagctgcaatatattaatatttgtttcttagcatcctgaggctagccacttgcctcttgttcaccttactagtacaactaaactagtgtctggccctgaaggtgggcagaaaatattcattaaattgaattttgatgtagggataattctgtttctttgtgtcttgcctaagtttaattcatgtcatagtcatgtttcacatgtatcttaattcttactgcataaaatgttcatgcaaaaggcagtattaattttactcattgttaacaatcagcaagtactattcagagtctgactcataaccatagagtatcttgatgctataatcagaaacatttattatccctggctttagcagttgaacttacaggataatgtttagttctcattatcagagaaaaaggtgattcaggtaatttcttcatttgttcgtttctctatccctctaccccagtgtcttgaaaaaatatttagctagaatgctcaaaaatggtgtgttagcattcattttcttccattaggtgatttttgttgactatcattaatagcaatatgtaagacttactattcatttgcctatttattcattctacaacatttattgtttttctactgccaggaacaatttgaagtgctggatatatttagtgggaattggttttcttaggcagattatcatctgtttgtgaagctttttcacagtgtacgtgcctggccccaaatctaggagattcttgtttggtatatttggtgtggtgtaagttcaggcatctgtatttttacagagcttttcaaatgactctaatgcacgtttgcttttgagtaccataggaataaaacaagtctcattcaataggtactcaaaataggtaaatgcagtaaagtttcatagatgctgtaagagaaactgttggtatagtgtgggcacaaagcaagaagtcctactaggtacctcaggaaaggtttcctaagaatagaaatgcctagctgaatcttgttctcctaagtgttttagagtaggtggaacccatgaatctatagattagcctaagtaaattccagtatgcagggcaatgtgaacaaaaagagagaggtgtgaaacagcttacagcattttggaaattgcaagtagttggcatgattgaattactagatgaggatggttaaaaataagatagtttttatggtgctgaaaacaagcatacattaaagaatatgaagaaaggagaataagagtagacttgaactttagaaagatgacagtgatggtatgaagcatagattggagtggtatgagaatggaggtagggaaatgggttgacatagccacaagaatccatacaagagcaattcagaggcctcaactaaaggagtcgcagttggagaggaagaggattggaaaaaagaaccataaggaggtggaatctttgagaatcggtgactgactggatttaggagacaagaaagacgaagtaatttctcacctatatgaagaatatggttgatgtgccaaacatcaaggtgagggttttaaggggatgattaggttttaaaagaagataatgcagatgggaggaggaaatgggaacagggaggcatttaccttggataagagaaggtgtagagaacatctgtgtttttgcttggagggactcactcctttcctacttttagtccgtgcttacggggtggtgtttactttgcttcaggattcaggattgtgttcccctagttacatggttggttcaaggtgggcacattactctagtgaagccagtcacagcttttgcttttgtttgagctgtaggagaaagattctttgtgcttaaacctaggggctgatgaaggatgagagtggttctacaacttatctggccatcaacgggaagcctgagaataagaaaatacaaagagaggcaagctgagtgtgttgggggtagaagagaagagagagggaaaagggagaagtatcaggttgtgaaggcattgcctgagtgtcagaaatgaactctacttctggctattctagttccttgagacaataaatttcttcttttttttttttttttgctgagtttgtgttgggttttctgttctttgagattgatagggtcctaactggtatagaaatgataataattgttgttgaagcaggagactagatgatggagataacataactttttagatgaagaattgttgaggatattcacaccaaataactttgaatttcaacttgagaataactgaggttaagtgactaactgaaagtcatgcagctgagagtagaattcagatctcagaatcttcagcttagtgagtttataccatatcatctcacttacgccacccgaaaagttacgaaatgatagtctttggatgtgttgcctttgaataagggagagtaatttatttatttattttttccccttggtggttgtatttggaaaactttgggatgtagcagtacaatgactttcctgctctgaagagcctgagtgaatgcctattgatatattagagtctgggtgcactggttataactacacaaatctttattttgaggcagtcataattttgagttgcttcagggagagagatacttataaagcagtaaaaacctgtccgaatgtgactgtaccttttcactgtctggatgtgcttgtggaaaatgtctccctaggacctttaattttgttcctaaatttacaacagagccacttcttgatgctatctattgctcaaggtactgttggcgataagattgttattaagttgggtaggtgagctgtagactgtgtcctgcagggaaccatttattgttttgtacaagaataggtagtggtgaggaatcaggtctcattttgggcatcaaatggtctctcactttaaaatctgacattggcactactttttctttgatttaaacagaaagaccagcagatgttcatgtgagcatgaggataacttaaaaacaaccatttttttttaaggcattggctctattttatttgctctatgaaaagtaaaaacaaggaagagcactacagtaacacatacacctatgtccaaatgatgagaggtggatggcattttggcctgatgtcagttactataattctttccccagaaatgtctttcttttgagccctgacgtcgattttcagttgaaaatgttggaaccgtatagggctgaacatacatagtagcttcaaatctaaagaaatttgctgagaagtgaaataaacttttattaaaactatttgaggcaaaagggtattgaagaaaatgggaaatgtaaactataagtgattgcattgtaggaaatattaagggatctatttagacaagactttggcaactagaggtaataataatggccaacatttaatgaacactgatgatgtgcctgacactgctaaactgtgttatcttatttaatactcaagtcttggaagcaggtttttttttttttttttaaaggcaaggtcttgctctgtctcccaggctggagtgcagtggtgtaattatggctcagttcaccctcaacctcctgaggtcaagtgattcttcctcctcagcctcctgagtagctgggactacaggtgcgtgccatcatgcctggataattttttttttttaatttattttctgtagagacagggtctcactatgttgccaggctagaggtagatgtttttaacttccattttacaaaagaggagtcttgagatttaggtaaaataatttgcccaaggttccaaagctaagctgtgattgtcatgtgtgtcaccgctgagatgtaaacataggcaagctgattctcatgcccccactttaaacaatatgttatagctccagatgaatgaatatgctcttacctctagttatattgtgactccagaagtgactgcgggtaacattttgcttcattttctactgtttcttatagcttgtgagcatctccatattttggagggagtgactgaaagacacaagaattagcaactttcttcatatttcttccccttctgaatgtgccacactgtatgcgatccttagcaattgtttgacaaccagttattatcaaacttgatcctttatttccttcatagcacttacaaattgcaaaaaaattataattgcattaatttgttttgctttcttctttactaataatatccagcacatacctaatggccaggtctatttgtctatcagtcagtgagattatatagatatatgtgtgtgtctgtatacacatgtgtacacaggaggacctgtgtaagctgttaatcagaggttggcaaatcttttctttgaagggtcagatagtaaatatttcaggctttgtaggccaagaggcaaaatcatggatactatgtagatacttatataacaagagagagaacaaattaccatgtactttaaattcagaaaattcaaaatataaacgaatagaatagtaattgagttaaaaactcttgcaatacaggtctactaatgagaagaatagaattatttggggaggacaacattttgcctaattggggtccaagtttagtgtttcttatcaaaacttttgcaaatgttcttctgcaaaaactattcttggcttgtggaccatataaaaagaggcatcataccagattttgcgtacaggctgtagtttgctaacccctgtttttattgctcatgtgactgttgggtcagctaggtgattctgctgatcttaaccaggcttactcgtgtatctatgaccagctgctgtgttggccgaagtttgtgtaggctaagatgcttcagcagagacagcttgtttctgcttcacatggttttatcccgaaggaggctggccttatcttgttcacctggcagctgagcagtgttataaacgagggagtggaagtatataaggccttttgagacttaggctagtaacatcatttttattgcattctattgggagaccatcccagatttgagggatgcagctcttgatgggaggagcagcaaaggcacactgcaaaatggcatggatacagggaagggagtaactgcaaccagtttagtaaaccatctaccgcaattcagtttcatgaccgtgtggtattttgttgaataaatatgccacagttgatttagtcgtttttcttttgatggacattttgactgtttccagttcttggcacttataagcaatgctgctcagaataatccagtatatatctccctgtgcgtacatgttaagagttttattaagggggggtgtgtttgtgtgtgtaagatagagtgcatggacaaaatgtacagtacatatgtaagcctagaagtggaattgtatgtagggtgtgcacatctttagctttatcagatactgcgagagtgactatatcaatttatattcttactactagtgtagttcttattgcaccacatctttgccaagatagtgtaattttgccagcctcattgcacatgaaatggcatctcataaagggtataatttgtattttctttattgttaatgatattaagtatcttttcatatgcttattgatcattgcgtttcttttttttttttgagacagagtctcgctctgtcgcccaggctggagtgcagtggcgcgatctcagctcactgcaagcttcgccttctgggttcacgcgattctcctgcctcagcctcccgagtagctgggactacaggcacccgccaccacgcccggcaaattttttgtatttttgatagagatggggtttcactgtgttagccaggatggtctcgatctcctgacctcgtgatccgcccgcctcagcttcccaaagtgctggggttacaggcgtaagccactgcacccggctaattgtgtttcttctatgaattgccagttaatatattttgcttgttaaaaaaatcgttacatctttcattgatttttaggaatttttaaattctaattcttttttgctcggttatgtatgttctaatatctttcccagtctgtgattcatctttgtattttttaatggactcctaatgaaaacaagtttttaattttaatactattgtatttatcagccttttcctttatggtttgtactttttatgtgttattaaagaaagctgtctcttccagatcttcagattctcgtatgttttcttaacgtttgcttttttaccttttgatccttagtctacctggagttgatttttgtgtatggtatgagatgaggatctaattgtttaagtatatggatttctaattctctcaacatgatttgttgaatttttccctctttcctcagctttcctgcattgccaaagctctgtcatacagagtttccacatatacacatgttctacatttcttttgacgctaatttcctgtataggaaagttgttcggttttcacttttgaagctggcactttttgtttactactatgttattgcctgagtagtcttgactgaactgtgcccttaattactttggataagagtaggtagcagtttttgggttgctcactatatgctagattagtatacttaaaattttagtgcatttaatgcactaaaattttaatgcattagctcttcatgacagtagtatgaattaactatatttttttgttccttttagaaattagtaaactgaagcccagaggaaacttaatacttagctaggattatgaacccatgccagctagcttcagggtctcaactttaaaccactattttatagtatttctcatttgatttataaatgtcttgtctgatttgaaacatttgaataggagagtggttcccagtcaaccataacatatctaaaatttgtctgattactgatgtttaaagaggtaattgttaaaatgagtcaagcaagcgctataaggactagttacagtttatttttagaattttattaggtttttttaaatggtcacctttgagatctgcccctctcccctgccactcatgaaaggaaagatgcagaaaatgattctttattttggaaaactatttttgtgtttttagatgtctggatttttcatgtgtgcactagcagaggattcttgcataagataatggggccagtgagcatgaacggttgtaggttggagatgtggtcctctgcatgggttatttttctttttaagagcaagatatagggatagatatagctgttggcacagtctaggggaacacattgttttagataatcttgcctcttcctgccctctagccaagcttctgataagcattttgcattgaggatgaccaactttgatctctccactcaatttcccatggcacttgttatctgtaccagctctttggaaattcatattcaatttaggatttgattttgttttttgttttttaagacagagtcttgctctgttgcccaggctggagtgcagtggcacaatcttggcttggctcactgtaaccttcgcttcccaggttcaaacgattctcatacctcagcctcttgagtagctgggattacaggcacgtgccatcatgcctggctaatttttgtattttcagtagagatgaggtttcaccatgttgcccaggccagtctggaactcctgacttcaagtgatccgcctgcctcagcctcccaaagtgctgggattacaggcatgagccactgtgcccagccttgattatgtttgataacacttttgtatttttctgattgctttgaaaatatgtttcgtgtacctaagaatagaaccttaggaaccttcttgggacagggatggtgttttatacttatttttaatcatctctacagtcttagcacagcagctaattacagtgcaggtgttcaataaatgttgctttttttgagatggggtctcactatattgtccaggctgaggtgccatggctactcacaggtgcagtcatggcatattgcagcctcaggctcctaagcttaagtgatcctcccacctcagcctcccaagtagctggactaggggtgcccaccactgtgtctggtgcttctttcttttagtgtggcttaactaatgagaccccagagataagggcaaattttatatttgatttaaaattgttgagtgttttattcaacactaatttattcagtgtactttgttcagcgaattgcgggaaacacaagatgaatcagaaaccgtatctgccctcaaagggactaagttcttaaacagtttaagttataaatatagttgcttgcttctgtgtacatacgtaccctcttagtttcacagagggagctagaagttgtttataatttaattgaggagatcaaacatatgaagaaaaatcattcaatgtagaatgtggtgagtcacaaagcccctggggatggattttgtacttgaggtgggttgaagaaagatgcttagagtggcagtaacaagggagctgggccctcaataaagaaggtaggattttgacaggtgggttaaggatggagggtggggttgcatttaagaaagaaaaaaacagtgtgaagcaaggtctggtagaggcagaaaaagctggccatgtttggagcaaaagtagttcaatttggctagaatataggagagaaaagtacataaattggggccagtttatgtagagtcttaaatatcaggctaaggtgtttggacttaattcagtagacagtggggagccactgaagtgttttgagtaatatgatctgagccatacttttggaagattaatctggttgcattgtcagtaatgaatgagaaaatgaaagtgttttccattgttggaacacttttttgttttctttataaacataactaaaacaaatgtaagcttagtgtagctatcaaataacactaaaaacctttattaatgaaaatgtaagaaaagatatgtttttgtatatccagctattttaaaaaacatgtcggccgagtgtggtggctcatgcctgtaatcccagcactttgggaggccgaggcgagtggatcacctgaggtcaggagtttgagatcagcctgaccaatatgatgaaaccctgtttctactaaaaatgcaaaaattagccgggcgtggtagcatatgcctgtaatcccagctactcagggggttgagacagaattgcttgaacccgggaggcagaggttgcagtgcgccaagatcgggccattgcactccagcctgggcaacaagagcgaaactccgactcaaaaaaaaaaaaggccctattcacctgttggcttctaattcagatttttgcatttagcctcttcagtgagttatgtaccacagatagatataaacttccaaaaacacagttccgattggtatattttactactcaaagccttcagtatctctccatttggctgctgaataaagtccagatttcataccccaacagtcaaggccctccctcattcatctctcctactactctactctctggctgtttcagacaaactattcttaagactccttgtgatttcctacttctttgtctcatttactctagttcttgtgaccttcatagagtcttaagaataaaagggagggaagatatgttgaaatcttgagaacacctgtgagtaggtcatatgtggcagagctgggatgaaagctcttctattacttgttattttttgtaattgctatgtgccaggtattgtggccaatcctgggttatgatggtaagtgaaacaaaagtgatctctgctctttataccttatggtctatagagacaaatattaaccactatatatagtaaaccaatgttgcaattacaaacttggatgggtcctatcaaggaaaagtactttgaggtactttaagagaagataatgggcaaagggagtacagctaatttatagtggtatgtcaggaaaggtctctttaaggaagtgtttttttttttcttttttcatgctgccccatgtgattaagaggaaatgaattttaagctgagaactgacatatgagagcatgtaggtagggcaaagagtggagaagggcattctaagcagagtgagcagtatgcaccaaggcccccaagtggaaaggaatttggggtattagatgacctcaaaggtcagtgtggccagaacatattttgattactgaggagtaagatgaacctggagagttaaggaggaaccagatcatatagagccttttagaccatattggattttgtattttatataaagtacattgaaaagaaaatggcaattgaagggcttttgaagagtgacacagtccagtttgtgtttttaaaatatcactgtgattaataatatatccaaaattcagccacttcttatctccacagtctccaccctggtataaatctcatttgaattagctagtctcagcttccacccttccagccctacagctattctttttttatcttttttcttaagaaatttttttaaaaaaatttatcatggcccaggcactcacaccaacagcctattctagacagttaccagtttttttcctttaaaatgttagagcatgtctctcctgctccagatcttcccacggtttcccattttactcggagtaaatctccgagacatgctcccacctcagggcctttacacttgctgtctcgtttgcctaggatgcttttctcacagatacccatgtagttcacttcctaacctccttcaggtctttatacaactggtgaatccataccagaccccatccctgccagtccttccctactttatttttctctgactttcatactagaatgtaaatttcactggataaagaattttgtaagagagtcctgtactgatctattctcaggatgtgtaatgctgtatataacaggcattcagtaagtattagttgaatgagtagcttggtggagtctagagtagcagctgagagaacagtttaaagggtctgagtctagatgagagatggtggctgagacaaagattgtggaagatgcagagaagcaggggattcaagatacattttagagatagaattaacaggacagttcacaatgataagataacttaagtttttgcctcacaagtttagcgtttcttctattaaaccattatgaaatgtcattgttagctagtaatttaagttagtaattaggttattcagagtcattgatttagcctgtgtctaaaaccaagcaatgtagatggctgccaaattcactaatggcagcagcatgtggtgaaggttaaagaagatttgataactcttttaggtatttaaaatatttgtatatttttaaaaatcaaacttatgagacagtgcatgcagtagtgaaatgtatatatatagctcatttgaggagtactcttagggttgtggttctcaaatagggacagtctcttgccgtaccctcccccaccccccaacatttggcaatgactggagacatttttgattgtcacaacctgaagaatggtgctcatggcatctagtgattagaggccagttatgctgctaaacatcctgcaatgcacaaagtcagtctcctcccctctctgcaaagaattatctggtccaaaatgtcagtagtacttaggttgagaaaccctaccttaggtattaaaactcaagcttcaatttatgtcaatgctaagcctgcagctacactgttaaatccacagacctgtatacttctacaacttgttgtgtatacaaggtgtgattagaatggttgcacttttaaacaaatataactgacacacttgcatgcttatgcacagaaatccagttgaaagctccaccttcacaatagttctcttgggaagagtttgcatttatatgattctgccatttttttaaatttattttaagtttcaggatacatgtgcaggacctgcaggtttgttacatagatgaacacatgccataggttctgccttttttatagttgcctttgaaacctggagcataccctttaaatctccttaatggtaccaaattatcttccgaaggtggatttggaaatatccagtgctttctgaatgcattgtgatgggtgtaatcaggttgggtagtaattctattgtaaggtgaaattgagatatggctataaaataataattggtggtttaaaagtagtgcttttacaaaatcttttcatcggtaattaagtgtgtcataatctcaatttgaagaggtatgtgcagatgttctagaattattaaaacaaaatcagtatcagaatgtcaaatatttaaaagattgttgtctgggatcaagggaaacagccactgtcacataatattgggaaggtactttggcacaatttggtaatactattaattttttttttttttttttttgagatggagtctcgctctgttgccaggctggggtgcagtagcatgatcttggctcactgcaatctccacctgctgggttcaagcggttcttctgcctcagcctcccaagtagctgggattacaggcacgtgccaccacacccagctaatgtttgtatttttagtagagatggggttatatcgtgttggccaggatggtcttgatctcctgacctcatgatctgcctgtcttggtctcccaaagtactgggattaccggcgtgagacaccgcaaaatgttcatattatttcacttaggaattctgtctctagccatttgtttacagacatttttacaccagtaaggaaagatatgaaaagtgctgtttcttggaggtttgtttgtaaagtggaaaaattagaaacaacccaatacctgtattaatagtattagtattgtgatcagtattattgatcacaaatcattagtatatccttgaagtaaaatactatacaccaccaaaaaatgaaggtataatgtgtactgatataaaaagagctatcaaatatattaaatggggtggggggaaggaagctgtaaaaaggaaaaaaaaaacccacaaaagtagtaggtatggcatgtgataccaaactatatatgcaagacatgcatagaagagagacctggaggaataaatactaaatctaatgggaataggatagtttcctatatttcagacttgtttgattgtattgtaatgttttacaatcaggaaaaaaaactaaaaccgtgagacagtgatcttacttataactagctcttttaagattttgaagcagtcctttgtattagtacatagctaccgatctttctgcagttctgtttttatattaataaatacctaaaattggccagagattcctagggcattgttcttcatctgaagttatttactgctttaaaacattttaaaattcttcattgtgaaagtatcacagttactgtgtctttttttttttttttttttttttttgagatggagtgtttgttgctctgttgcccaggctggagtgcagtggtgcgatcttgactcactgcaagctccgcctcccaggttcatgccattctcctgcttcagcctccctagtagctgggactacaggtgcctgccaccaggcctggctaatttttggtatttttagtagagatgggttttactgtgttagccaggatggtcttgatctcctgacctcatgatctgcctgcctcgagcctcccaaagtgctgggattacaggtgtgagccaccgtgcccggcctactgtgtcttttttaaaatcttgggctttgaaataccagtgtggtaaactgctaatctgtgtttaccctgcaggtggcgctggtggttttgtggtgttcttcagcgtgactcaagtaaaattcccttcagctgggaaatcacttagatattggttctgcttgtagaatgttatctttcatgtaatctgttgaatatcagacattttcttactattatttcaagaaatacatgtagcaggaaaaaatctactaacaaattattaggatataattatattttataccttatttatctactttattattcattacaatttctgggaaaattaaatttatttcagcagttcattactttccaactcccttaaaattccaaaacttcatcaaaaaactggcagtagaactaattttttcaaattaattctctttgaagtctttcattttcctttctgtttgtgtgtctgactccccctttctttctctcagtctgtcaagttcaagagcagctcagatgccatgaattaagtggagcacaaaagggggaaaggagacccttttgaagaacaaaggcctcccattaggctgccatgttcttttttgaccaaaagtgcaccctacatggtttctattgttgtccacatgccctgcacataaggtaaatacagcagatcctcattacctcacgttttcctcctcttcctcctatgccacacacaaccagtgaagctttgggtctttgatgtctttaggcattcttatacagttgctttatctccttttaaaaacctacaggggtagaagtggaagtggagagcaatgcacaccgagtagtaaaacctcacaagaagggaaaatgagctgttagagaagctgcaacccaggaatccagggcaagtggaaagatccagagattttactgttgttgttctctattctctgtcttttaatcctatagcttaaaaatcctgtatttttaaagtaataactttgatttacattcactatagtttttcctccctttgtccgtgtaacaagacaggcaggtgggaataaatttaattgctgagagcagttcatgtaatgatcagaaattcttgctaatctgctcctacttattggatgttggctctttggtgtcatggagatggctttactgtaggtttgttgtgttgcattacttttcattgggattgaactgagaaataacaaacaagctttaagtgggaaattaaaaaaaagaagtaacctatgtagatccaaacttaaaatgtgagaaattattgaaatttcattttctacaaacttgaaattagcctgctaattgtaaagttgttttaataatgctgacaaatgtcagttacgtttgcaaaggagtgtatggttctaggtatttgcctactgttaaccgttgagaaaaacattgtcaggttagcaagtctattgaaatagagacctccttagtttacagcaaagaataaatagctgatgactggagattgggactaaggttttatttatttatattctttgaaagaaatcggacagttaataagtggtttgtggtagagttgaaggatgtctgagagatggaaagagagtgacaaaggaggagaaggaatagtatttcttttttagtattgttttgaaattaaaactctgttattttaatatggtaaagagcaagagttgggttgggcgcggtgactcacgcctataatcccagcactttgggaggccgtggtgggcagatcacctgagattaggagtttgagaccagcctggccaacatggcgaaaccttgtctctactaaaaatacaaaaattagccaggtgtggtggcacatgcctataaatcccagctatttgggaggctgagacaggagaagcacttgaacctgggtgacagaggttgcagtgagccgagatcccgccactgcactccaacctggacaacagtgtgagtctctgtctcaaaaaaaaaaaaaaaaaagagtaagagtcgaacttaggacaacgtatgttttcttttttttctgacgttgagctaatggtgggcaatttgtgacttaacatttagtgaccaccttgaactctccctgagtttgtgggtctgcccttttaggattatagaggtgattcagtggtgttaaaaacaacattaaagggattaaagaagtaattcctttgtaggaacagtagtaacattttattttgaaaatttcatgaggaaatttttagtattcctatttttttccccatatgttcttcaaataaatatacatagcacattcaacatttttggtcctaagaatttcttatattaaaatctgactagcatagctgaagttaaaaaaaaaaggcctgttaactacttgaggaaatgttttgactctttatggaccctgaatattgcttttcaggaagtattccttgttttgtttttttgggtacagcagtctgcaagaagcctttggtttatgtacttggcagcaaaataaaaggcaaagagcttcttgctgtgtgttatgtaggaaattaccattcctgttgtctgtgtaggatgttctaaagatgtagccaggaatctcagaggagagagagaagagacagagagagagagacagacagagagtcagacttgtagttctaatattttcttgcttttgcctctgcctctggtcatacattggattgtttttctgcttttgttccttggggtggcatctgtcttcaggagaaatcactccatagtcaaacacagattgctgaactgtggcatttttgctgttactgttatcctgaatttactgggaacagttttaatatgggtgcatttaaacacttgtttgtggatagggagagatggagagtgaaatttcattctctgttgaatgctccgtctcctgcccagcacatttctgccccttccacatggtttttcactaactcctgaatgtttctctatgctaatctgaaagctctacagcagagactacacatttatacagttccccacatacagggtcactttatgaaatgaattatttcttgacatttttcaggtttgtgattgtacctttccaagccagtgttaacacatttcaaatattgtgaaaagttgaatttatgctagcattgttttaattatttaaataacttaacattttagaaccttgtggctttagatttaaagaggtatcaagtccttaaaacattttcggttattatcctaatattaatacaataatagtcattagacaaatagtaaattttaaaaagaataaaaattaaaaagaacacctaactgggaaagtgggagagaagccatttaaaacaataaactgaaactcttttcctgagtttccttagaagccatttggacaattaatggagagattttaaacattaaatgtatttgtgactaaaacttgccttttcaacaagacacccgaactgccaagacttcacaggggtctcattgtagagaattaaaattcaatgatggttgaaagagaaaaggcataataagattggtcagacttctatatttattcaaagattgagcatgaaaagatttggagctttacagtatttcaaggaagtaggatgtgtaaaaagttgagatgggtggcttattttctgacatgagtagattttgatttaaaacattcaagctgtgccctggggagagggatgtgtaaggagggaaggaatctgatgaaatgaggacctcagagagtttctgtggaaggcttagaactggaagtggtgaattagtgaaccatcaagaaagagaatatttttatagacatttataaatttttatttccacaaacattggaaataatgtaggaataggcaaacaatggtcctcaggtcaaattcgtgttttctgtttttgtatggcccttgagctaagaatgatttctacatttttttgtgggggaaaataaaaagcataatatttcatgacattataattatatgaaattgaaacatcaatattcataaacttttattgggatataaccatacccatttgtttatgcattgtctctgtaatatctatagctgcttttatgctgcaacagcagagttgaatagttgtggcagagaccatgtgtcccataaacactaaaatgtttactttctgactttttacacgacaggtttgctgtccacagaaataaaagaatgtccgcagtatgttagaatgaacagtatacagttttttgtaagactaggaatacttgccattaataaattcattttctgtattcttatatttgcttatcaggaataaatgctttttttggtgaatggttttcattctgaaaaatgtcaaaatagtaaatattacctttttttttttttttttgacaatgcccccttttttggctgggaatgttcttactctggttttgtaagtatgttcccacacattaggatttcaaaaaaaaaaaaaaaccatattcagaactgtattagtcagttcttgcattgctgtaaagaacttcctgagactgggtaatttataaagaaaagaggtttaattggctcacagttccacaggctgtacaagcgtggtgggggaaggcctcaagaaacttaaaatcatggcagaaactgaaggggaagcaagcaggtcttttatgaccagagcaggaggaagagagagaagtaggaggggctacacacttttaaacaaccagatcttgtgagaactcactattacaagaacagcaagggggaagactacccccatgatctagtcacctccttccaggcccctcatccaacatcgaggattacaatttgacatgagatttgggtggggacacaaatccaaaccgtatcattctgccctggcccctccccaatctctcatgtccttctcacattgcaaaatacagtcatcccttctcagtagtcccccagaatcttatttcagcattaactcaaaagtccacaatccaaagtcttatctgagacaaggcaagtctcttccacttatgagcctgtgaaatcaaaaacaagttagttacttccaagataacaacacgggtacaggcattgagtaaacacacccattccaaaagggagaaatcaaccaaaagacaggggctacaggccctgtgcaagtccgaaacccagcagggcagtcattaaatcttaaagctccaaaataatctttgactctatgtctcatatccgggcagcactgatgcaaggggtggtctcccaggtcctgaggcatctctgcccctgtggctctacagggtacagcccctcggctgtctttacaggctgtcgttgagtgcatgtggcttttccaggtacacagaacaagccgtcagtagatctaccattctggggtctggaggacggtggccctcttgtcacagctccagtaggcactgcctctgtggggactgtgtgtgggggctccaaccccactcccctctacactgccctcgtagaggttttgcatgaggcctctgctcctgcagcagagtcctgcctggagtttccatacatcctctgaaatctaggcaggagctcccaagcctcaactcttgccctctgtgcacccgcaggcttaccaccacgtggaagctgccaaggcttacaacttgccccatctggagcagcagcctgagacgtatctgggccccttttagccacaaagaattttctttctcttggcctcaggccagtaccttttatgccttgcctattatgtctggcagaagtgtggcagttgttgggaaagtaactgggagctctcataggcttctgtatgaaaagctaggataaccacgttatgagtagtgtatggacaagaacttgaacttgtggtctttcccctctcatcagcttcatattgcttaagatagaaaaataagggatttcaaaatgtaagagtgaaagaaattagagtttgacaaagatataaaagccatagtttaaaataaatgtgttttattttcttcctgaataattgagcctgaaccaggagcatactgttcatgtttaatctctatgtgaaaaaacaagggtagtaattgtagagcaaactcttgatttattctgaatgaccaccagttactaactaaaaatacgattttccccaactaggttttcttattccttataatagttgaagagtaataaggttgagattttctttttgtgtgtttctttgctcacattaagaaggttactctatgcagaactttttgactacttttattagttacgtacccctcctttcccttaattattaaagctctaatctctagcatgtaatgttttgcttttaatctgttgcttctcaccctgttgctttaggtaaagtttaaggggttttattttaataggcctgagtagagaatgaaactatgaagaatctgactataaaactagtaacagaaattcacttggttatttcagataattcctttatctaatatcttcctttcctcttctttccttctaggtcttttgagtattgcctggaatttactatttctgacaaatttctatagaacatgtgggtctatgaggaaggtttcattttaaataggtagttacctatttctgttattttattgtccttgtttttagatgaattttgctatgtattgggtctatattttgccctagtaaatatagaccaaaattactctgaattttaacacagttaaaattcagtctttgctgattagtagacttacttctttgtagactcactgtgtttccgaaagggttgggagttaaaatagtttggttgtcatttgttcatatattcagttttctggacaaaccatgaattatagtaaagttacgctttcttgtaaatccagttcttgcgaaaatgcttgttgcctttcattaatgacagcatttccatctaaaaataatgacaaccctctcattttcctttacagctccttcttgttttccaccttttttgttgtcttttagaaagatactcttctgaaacatactacttttagtcctgagatttgcagtgaatgaattgcaactgatgaactctggggctgctaatcttacttagtcaaataaatgttttttttttttttttttttttgagacaggctctcactccaggttggagtgcacgatcacagctcacggcacctttgagctcccaggctcaagcagtccttccacctcagccttcccccagtagctgagactacaggcttgcaccatcatgcctggatttggtttttgttttctttgtagtgatggagtcccagtatgttgcccagagtgatcttgaactcctgggtcaagtgatccccccaccttgccctcccaaagtgttgggattacaggtgtgagccactgtgcccggctgtaataattattgataatagaactatgatgagaacaatagtgttttcttacagaagactttttttttttggcttatttaaaaactgtattaaaactttaaatgtacatcattcttcagtatgactacagaaggccgcaatggccctgatatctctacttgttctttctgaaattgaagatggggccaaatactgtgtctaattcaacagttcagatttttcattcccactttttaaagtgttagtgttcgcttgagcacacaggcgagattatgggatcttaacatttgaatcacctggcagaactctgaaggtttagggcaaggaaaaaaaagacatcccaaaattctatgcttactatcaccctgtcttagtaatggtaaattttaaattctaccaccccctgcccaaaaagatggggtaagaataatgattggttaagtgatacatggaagactgctacatcctaaaaaagactgatggatggttctgtgaaacactgcttatgtcttagctattttccattctgaggtttctgtataagaatatcttgtgccctggaaatattcaagaaaaagtactttagatgagtcttatttaataacttaagattttataacagagatggtggtttgtgccacattatatccagcagttagcgatctaagaacaaaatatttagcttatactagaagacaacagtagtccccctttatctgctgtttctttttctgtggtttcagcttcccacagtcaactgctgtccaaaaatattaaacggaaaatccaagacataatttataagttttaagttgcatgctgttctgagtagtgagatgaaatctcacggcatcccactctgttctgccgaggacgtgaatctttcctttgttcagtatatcccatgctgtatacactacctgcctgtcagtcattcagtagcggcctatgttatcagattggctgatcattgtattgcagtgctatgttcaggtaacacttattttacttatagtggtcccaaggtgcaagagtagtgatgctgacatattattataacttctattttattattcttattgttaatcttactatgcctaatttataaattaaacttaatcataggtatatatatataggaaaaacatagtgttatatagggttcaatactagccccagtttcagttgggggtcttggaatgtgccccccacagataagaggggactatattcttatagaagaagagtttgattttttaggacgttatttcctgttcaaaccattgacccactctttgagataagttattctgaagctttcatataagtaaaagcaattaaattttgccaccagcaccatcctcaaccattctgaattataaagtgttaaaattaagaacaggaagaatggaagtattcaataaaaaatgaagtattttcagttccatattgtcatcaaataagggtgggaaaggcaaaggagaaaatcaataagtatggagaagaaagaaatgagtagatagaacaaaaaagatgagaaaggaagccatattgaagtcaggagagagtgcagagcaagaaaggatgggcagaaaaaaagaaaacaagaaaggagtttaatgagtgagtagaatgtgctcttgttgcattctactgccagtctaagccatggaatagttcactattctgggaagtattcttaagatcatcagtgaccttcaggtcatgaaatctaataagcattctttcagacctgttcttatttgacctctcagtggtgtttgacactctcaaccaccaactctttgtgaaacctttttttccctgaaagctgtgaggtcgtgctttctcggttctcttctcatgtctctggtaactcctgctttgtctactttgggttttttgttttgttttgttttttgttttttaagagttgggatcttgctctgctgcctaggctggagtgcagtggcgcaatcatagctcactgcaacctcacactcctgggcttaagtgatctacctgccttggcctcctaagtaactgtgttcatttgacacagtttaggaactaaagatcaggtaaaaccagccagttcctgagctggaattgaatctgttcagaatgtctgggaactaactccatttttacgtgtcaaccatacctggctaattaaaaaaaaaaaaaaaaaattgcctaggccagtcttgaactcctgacctcaaacgatcctacctcagccttccaaagcctcggattacaggcatgagccacctcaccccagccacctttgttgtccagagatgtcagattttgtgaaagctcagtcctaggcttccatttcttttcattctacgacccagcaattatatctatcccaatggcctcagttactactcgctgatgccgcatgccatcctctggtgtcccacatgtcagtgaatagcatcaccttttttattccagttttccaagttaaagacttaggagtaattcctaataccccctctccctcacttcccaaattcttactgtactaaggcctgtctatttgacatcctttaataattttcaaatccatattctctgctgtcttagtctgagtaggattatctcccccttgcagcacaatagtagccctccatatccttgttaaatttgttctgtacactgaagctagggtactgtatcctatgaaaacacaaatccagtcatgtcattctcctccatagcattatttcctgctactcttaggataaagactaacattccccaggcctacttctccacctcccctcttatttttcaaaccctctgcacttgagccactgagacttttgttcagattctcacaggtaccatgctctgaccttttacttctctgcttagtcaatttccatttcattcttcacgtctcaacacaaagactgtttctatagaaaaagtgattattgatatatggtcttgtaagattctgttcttttgcttatagcatttatcataatttgttattatgtatctctgagactgaaaactcccaagagggatgggaccttgtctgctttactcactgctgtatctccagcacctggcacatggtagggatttcatagataatggttaaatgacttgagtttgtcctttctctagatctagggtatttgtcatttgtccataaattttgcttcaggaaattttagggctcagcataatctgattaggcttcaacgatgaagataatgttacatttatcattcgacacagtttaggaactaaaggtcaggtaaaatcagctaattcctgagctgtggaattgaatctgttcagattgtctgggaactttatttttacctgtcctgacaagtcttctaaaaaaagatacgttgacttagctcacttttcagcaagcgtttcagtgcttacaatacgccagacattttgcaaactttaattggctatccccttcatttgtttttctattttaatagaatttaataaaattctattaaatttaataaaattctattttaatagaatttattttaaatttggttttcaagacctatttcacatgggtacatatttgtgtctttgagtatgattctttaagtaaaacactttgcaaataaaatgatcatctgaaagatattttttcatttgattgtaattagttaggtaaattaaggggaatacataattacacagcttaaagatattcaaatgctattggaacaggattggtgtctccatgttcttccatttccttctattcccccctgattataatggtacacagtgcttacagcatacgcctgataatgttaaatgaacacacattatgtgtagaatatgcagaatcatgggtagtggtatgtaacaaatgttgttaactgatgagatatagcaaacgtgaataaaaaaggtttaattaacatggataaagaaattcagtcttttgttttataatgtaatgcaactgacctctgccctgtgatgcagacaagagctgttacaagttatcaaaagtaagtttatgaaaaagatcatttttcttattgatgttgtgtccccccatgacagaacatgtaacagagttaagagaataatgtgtgacctaccctcgcaatccagataaatatagaaattcttgataatttagttatatgagcttgagtaatattttaaaggtgagaagagttatgacttagaacagaggaaaaatgtgattcttggtagagggaactgcagcttaaatgttccagagggggccgtgcatggtggctcacacctgtaatcccaactacttgggaggctgaggtaggagaattgcttgaaccctggaggcggagattgcggtgagctgagattgcaccactgcactccagcctgggcctcagagcgagactccatctcaaaaaaaaccatatgttccagagggaataaatattgatgggagttgggtggggacagatgatggatggaacttaagttctggaagggttagcaagcaggtttacttgtctagattgagaaaaaagtgattcatggaaactatgtttggaaacataggataagcactctgacttgacaaaatgatttgtatttaaaaccatattgttggcagggcatagtggctcactcctgtaatctcagcactttgggaggtcgaggtgggcagatcacctgaggtcgggagtttgagaccagcctgaccaacatggtgaaaccccgtttttactgaaaatacaaaaattagccaggcgcctgtaatctcagctagtctggaggttgaggcaggagaatcgctcgaacccagcaggtggaggttgcagtgagctgagattgtgcactccagcctgggcgacagagtgatactctgtctcgggaaaaaaaaaaaaaacttattgtaaatgtgtgatatcagaaataataaagctttcctctccagatcttatgaaaataaaagtggacatgatatgtagcaaatatgcttggtgtttgagcttgatttttttttttaaagagagattttattgccattactgttatgtagggtttttttttttttcagacttttagtttttatagctagtctattcatttggagaatgtggaaaaataactctgaacacttcccactagtgaacatgttaggctctcaataaaacagtttctatagtcagtcatcctgtatcagtgtcagccagaattacctaaaggtatgaacagtattatgacagttacctttaaaacgataggcaacactgggcttttacatggccctttgtgtcaagatgtgttacagatcagttttgcttcctttgttttgaaatgattttgatttagccttttgtgaacctttgacttttcttcccatttcactaagataacttcttttgcatggtctttgaatagtctcattttttaaaaagtcctaagcataaaaagtaagattttccttctttccaaccctttctgtgaaattataattgtgctaaagtatcagcttagatttcaagcagtcctcatgccaaaggcgtttattaagtgtttatatgtttgttactatgctgtattgtatcaataaagtaggaacacacaggagtcacatctattaagtgcttttaaagtgcctggtaacactaatgtaaatcatattttcaatgtcattcatataaatagtgtcaagtcctgcctgccccctctccaccaaagctaagtatcttaaatgctaagtatcttacaagattacatccccataggaagagggtggagtgtttagtcttcatttgtgactggtttaaatgaacagatacagttctccaaaggtccatttatagaccggtcttaacttaaaatgtacataatgtatttgggtattgacgaaagagtcaaactctgtaaaatatttaaagcgtcttattctgagccaaatatgagtaaccaagacctgtgatacagctctaggtgtgatagagttaactgggtgacaactgaaaagtgaaatgagggttgcctgacatctgagaatcattctggagtgagacagtctgttaaggagtatttgatcaggaagaaggtagtgataaaagaaaaacctcggctgaattaaatttaaaagaatttaattcagcaactgacggtttgccaatcgggcaggcctcccagccatagtaggctcagagactccagtgcagccacatgatggaagaagatttatggacaaaaaaaggaaagtgatgtatagaaaatgggagtgaggtacagaaacagctggattggttacagctcagcatttgcctcatttgaacatggttcaaacagttgactacatttgattggccaaaactcggtgattggcgtaggtgtaggctacggtctggttacacctccacttgttatagttcaccatgtacagaaaaacctttagccaaacttaaaatacgtaatgaggcagctttaggctaaacttgatttaacagtagagacttttcctttttgttccagacttgtaaattctgctgtctgttgaacttctctcaacggtgcatcacattaaacatatccaaactcattcttctccctttcaggccacactttttcctctactcatattttcctgctcatctccttcactcagttgcacatgttacttagtaccaaggcttccttctttatattgttcatacctagttcttttccattctcatggctactactttaattctagctcctactcttgcctagggttcatggactggctccctcactattttcatacttactccctcaaatctatattcatactgttacttaagtaaacaaaagaattttttttcttattttttttttttttctgagacgagtctcgctctgtcgcccaggctggaatgcagtggcgcgatcccggctcactgcaagctccacctccccaggttcacgccattctcctgcctcagcctcccgaatagctgggattacaggcgcccgccaccacgcccagctaattttttgtattttttagtagagatggggtttcaccgtgttagccaggatggtctcgatttcctgacctcgtaatccgcccgcctcggcctcccgaagtgctgggattacaggcgtgacctaccgcgcctggccaaaaatttttaaatttctattacatccctcttgcttaaaactcctaaaaccactcagctttaaggactaactttaagaagttgaaacttaaatatgaggaccttcataatgtggtccttgtctatctttccagcctcttctcctgtcacttttttgcctcttcttttcactctgtcttactggtgtttcctgaatttatcatccctgtcacacctcattttcttcccatgttctactttttctgtacttttccaccctcataatactgctttcccttgtttctacttctcagggaagcctgctctaactttcctatagggtttagatattgcacctcttctctgccccattagcttcctagcaaatggggttaaatgcagagcttgctccagaggcctactgtccaggttaaaactttagcttcactctgctgattatgtcttcttgggcaatttactaaatatctctgtctctgttttctcatatgtaaaatgggagttacaaaagaacttcatagggttgttcttgtgggagtaaattgatgtatgttaaacacttagaataattgtgcttggcacatgttaacacttactgaacattaacctattactatcttgtgtatacctcattcataggacagattatttgatattgaacttctgttttacttgtttcttcctctagtacattgtgacccttttttgagggcaggaactaaatcttatcaacttaaagtttatttaaaaatatttgagcatccattaaatcattgatacttggctaagtccaaattacggcctgttttgtgagacccctttttacatttttgtaaaatgtaaaaagccattaccaacaaaaaggaggaaaaaaaaaagaggaagaagagtatggacagagaacatgggccaacaaagcctgaaatatttactacctataattttcttaacagaaaacatttgctgatctctgagctagacctcttgatgttgatgttacacataacatgattagaatccagtaaatgtttgctggaatgaatggatggttgggtagatagataaatgactaggataagaagatcagaattgtgtgtattggtgattatttcttaagacgtgacagcaatatgaaagtcagtgaagagtctgaaatagttgctttctcatttggtgacatgagactagactatttgcactttgtgggtaggaatgttttagggtcctgtgtctttctgttgtgtttgagaagttggacacaagaatggtgttcaaattcctggtattaacatgtgaagaagacaagaatttgctattttctatagtttgtacagatggaaagtgtcaagcggtcttctgtgttttccattaagcattccttgctgttattgctaggaatatcataaaggagaggatcctcactgtcatttaataaataataataacagcctaagtggttaattttgttccttatccctacagtaaacaaataataaatactttgaatttaactagcttaatattctgttggtgtagaattgtggagatagataaggctgagtaaattcaggccagattctttaatatttatttttgaccgctcttagggattttgaccaaagcaatttaccctctaactgtcctattttgtatttgtggtatcagaacaatttttcttccttcatttttatttccttaatgattcaactttctgtctgctctaaacagtatatgtgttaaagctaatgtccaaatggtaataaattttttttgttattaattgataattgtttggatgttgctattctgaaaaggaccataaagagtatttacaccaagtctttagttttacagataggtcagttatttaaaaatcacaaaggttcttgatagtagaatgacagcgaaaagctggtgctctgatagaccatgctgcatctcctactgtcctggttttttatataataagagcttaccatcttcagttacattgttttgctgaacttaagctgtgtattgcactctttccattgctacctgacagaataataatgatcaagacttaaaatctatttctagtttattttttaggtattcgaaaatattctactgtattcactttgcctttcccattgtgaatggtccaagaaactttaaaaaatatagatactggtataactatgatttgatacattttaatataggcagtgtcaacattttgtgaattttatgtcaatattagattatatttttcctcttcaaaggggctttttaatgaaaattggggaataacttgtttctagtcttgtaaaatcttccttcatggcaccatgaactctcatacatacagtggtagactttctacttttatattatccttagctgttttagtttagaattctgttagtgcctttcacaataaatgtttgttgaattgaattgaaccttgtgagtagaactgttttgctttgctgttttgttgcaagtataacagaataacttgtcattatttgctatctatactcgattcatttgtgttcatagtattttcaacatatttttctttgtttacttaaatgtggaaattatattctaaatcacttggcagctgtgatatgcaagagcaataggcttattaagttaaaagatgaagtttatgccttcattctgccacttgtatagcatttgtattaggacaatcagcctgaatcttctttcctcatctgtaaaataatgactgctttatagagttttgttaggattaaaagggaatcacatttaagcctacctagcatggtatctggtacatggagggtgttgagtaaatgtttacccggtaaaaaatggcgatatgtactttagatgtatcttaagactatttttggccgggtgcggtggctcacgcctgtaatcccagcattttgggaggccaaggcgagtggatcacgaggtcaggagatcgagaccacggtgaaacccagtctctactgaaaatacaaaaaattagccaggcgcagcagcaggcgcctgtagtcccagctacttgggaggctgaagcaggagaatggcgtgaaccccgggaggcaaagcttgcggtgagctgagattgcgccactgcactccagcctgggtgacagacagagactccgtctcaaaaaaaaaaaaaagtatttttaataaaggttttatagaatcacaaaaccttagattttaaagggatatcagagttcaagcccagtttcccttttaagaattaaatttcttctctgccgtatcctgggctagtgctcatttatcagttgctatttaatttctttgtgcaaggcgctgtggtaggtttttgggaagctgcagagttgatttaggacagatactcttctcaagaaggttgttccgagtaagcttcatggaagaagtggcagttgagctagaacttgaaggatagggtagaatctgaatctttataggggttgccaactgcaagaacacaaggaacaaaggagagaagagtttgggcagttgcagaaaatcattaataaatgagtaattttatttgactggattagggaaggtgaagaaataatgaaaggtatggctggaaaagaagattatggccaaataatagagatcctggatatattgcaacaattggatttcctggtactcatcagatgaagtaaaatgaaacatttttaactgggggtgatatagtcagtttcattcagctttttaatatatatgccaagttttaaatagttctttattaatattaacttcttgtaactttgatctctttgctgtagttcattctctttagccttagagtcagtccctctttcatccttcatgtcaaatcagatacctgtcagttttgcccctaaaacacatgtaaagtctatcctcattgctcctgagttactgtctcatgtggcacaggatcaaccagtaagtttccattcctactctcctgtttagagcattcatcaaaacctctggtagcctttattgtcttaaaaatatagagagcatagtgaaaaccatgtcactgcccttgattcttatcttcaaaattatagcgaagttaagcagtctgctaattcttattttcctgttgtagctaaagcaggaatcactgaggtaataagttattgtttatgcattaccttatattgttgagcactagagatgtctgttaaaatcagggcagagaaatagacaagtaaaccacagtgacaaggtggagtaaaataagtacatacttattttgtgtagtgctatggaaacacagaaggggcaaacaatactgttttaaatcttgcttttgaagatggaaattattgtcttaaagcttattctcagagacttgtggcaatataatggattagataacctgaaaaattctgtgaaatgtctacaaatgtccataacattcgtttacatgttttccctgcaagctcaaggatgtgaaggatttccccagggcaatcgaagagaaaaattaatggttatcaagctaatgcaggcgctgccctaagtaagggcctttgttcaaaccacactccagagctttgtgttgtactggatcttctcgagaaaaggctggatttttcagggcagggaaatggagctgaggatccctgtatagagctgtaactcttaaagactttatactcttagtaaaagggtaggctggggcgaacaaccacccaccagcaaagtatactgatgaaggcttgtctttcttagccttagatccaaatagaagtcttccctgaaaatttaaaccataacccttttaaaatacaggtttgctatttgaatttgttcacctgtgtggtctgggaaacccagagataagaaactaaaatgatcctgagctagaagtgcctcaactggagcagaggcaaatatatggcctttctgaaggaatgtgctttcaacacaagcttctcatattcctccagattaaagttttccaatattagcctgtaacccaaaatgacagaacctaggaaaaaagacaacatcagaaagttgcagcaaaacaaccaacaaaggaaaaaaatagtcattgaaatttagaaacttaatggacaagttcagcaaatagatacgttttgaagaatggtttaggaaattaacatatgtagtactgctttgttttctctgagtctcttttctctgagatgaaaaatgcaaaagagaagttcaaagttatggaaaatagaatgaggttcaaaatgaatctaattggagttacacagaaagaatagggatagttctcagctgctatcagtttaaatacatactggctgagatttgatacaaggcatgaattctcagctttaggaagcacaatgaaactccaagcgagataggtaaaaattctgcacctagacacattatcgtgaaaatgcagaaaatcaaatataaagagaatatcttaatagagagtagaaaaaaatagatgattgatcataaaagagccacatttaactactcagtagcgatgatggaagcctaaagacgatcaagttataaaatactgagaaaagataactgccaaccttaaatttttacccaggtgaactttaagagtaaagatgaaatgactttttggacaaataaaaactgagttggctaccatcatacattcttttaaaagatgtacttaagagagaaggaaattgaactcagaaggaaagactgaaatgcaagagggaataatgagcagatatattggtagcctgtgggtaaatctaagtaaactacgcttattttatgaccttggtacatagtaaatgcttggctaacagatatattattcaccagttttcctgaaataacgtgttttcttattccattgtgacagacagtggaattgacttcatattcagaaattaagagaagctggaatctcaacaggattcctaacatggttagtcttatttttcaaagttaacagatacagtgtctttaggagctgacttggagtggctaggtttcttaaaagtttatgttggccaggtgtgtgagctcaggagttcgagtctagcccaggcaacataatgaggccccatctctacaaaaacagttaaaaattagccaggtgctgtggcctgtgcctgtagttccagctactcaggaggctgaggcaggagtgtttgtgcccaggagtttgaggttacagtgaattgttatcaggccactgcactccagcctgggtgacagaatgagaccctgtctaaacaacagcaacaacaaaaaaacaaagatttatgtctacttataggctgctgagcaaattttaatttagatattaactgaccttgccccctccttaccaagatcctaattttttgtgtttgatttatagtttggatctagaatttccgttcaaaatgttctcagatttcacaatcattaaatagaagacagttctaaatttattatttgagaacctgtgctaatcttgggggaaacattataacaataagtaaaatggaactcagtgctctttaaatggccaagaacatcacaaaccggaagcttggtcacttgtggtcctgacttgtaaaaagaagtatttgctaaccatgtttttatttttatttttttaaactattgaatttcaggtagtctatgaggggagtatacttgtagtagcattttgctagatgagctgcctttattccaaatcaataaatgagtggtctgagcacatgtttctttttttgaaatagtttctttgaagttttattgtggacttaaatctaatatccctgacgtaatatttattgactttctaggcatcattcattcattcaacaaatgtttctgagtgcttgtcagattctaccactaaggttgctgtactgaacatgacttataaggtgcctgtgctcagcaagcttaccttctagtgaggactaaacagaaaccagacaagtgaacagggtttaaatttaggagaagtacatacagaaaataaaatcaggtgatgtgatagtgacttcaaagggtctctctgaggaggtgacattcagacaaagacagaggcctgggcagaagcatcttcagtggaaggaacagaaattccaaaggctgtaaggtgcttgtgagtgagtttggtgtacatttacatggtgctgtaagtgctgagagggtatattaatgtgatggtttaatgtgactaacatattttgtggaaattaattttgattttatgatcaatcacaccagattgccataacttaaaatttctatctcaggtcttaggagttacactaacttttactctgttctatatttggccagtggaactcaaacccatttgaaaacgtttggtctgagatgttcatttatttgctggcttgtgttctgttctcttttagacagtttttttgtgaccccattgtaatgtaaaaacatttaaatatttgccaaattagttgaattataaatctacatttttacatagggagacaaaatataatgaaaaataattatagtaacttggaagagacttcaaaagcagtatccaaaactgcaaattatgttatacagtttaagcacttagttcattttctttgtaataaaacttattccacaaatacgtaattatttacaggattcctacataaataaggaactactaagattgcatgaaggctgggtgcggtggttcatgcctgtaatcccagcagtttggcaggcagaggcgggtggatcacttgagctctggagtttgagactagccagggcaacatggcaaaaccctgtctctacaaaaaatacaaaaatcagcccagtgtggtggtggtggtgtgcgcctatagtcccatgtacttgggaggctgaggtgagaggattgattgaacccaggagtttgagcctgcagtgggcagtgatcgtgccattgcacttcagcctgggcgacagagcaaggccctgtctcaaaaaaaagtgtagcacgaaaaccacatgttctcttttgtgttgagatatgcatatgattatacccttttatcaaaatttagtaaaagcatttcttagcttttgctcaaattacagattctatatgtctgtcctaacttgtcatccatccagctgaagcgtctcaaggtcagaatcatgtctgtttcatctttctgaccccatggagcagagtacagtgcctatgcatagtaatctctcaaaattgtttgttgagtgagtgaatgtgtgaacattttatgaaattatctttaagagtagttactcatgatcagtatactttaaaagatcggcaaaacattgatgactttttaaaaagtaattttggccaggagcaggggctcatgcctgtaatcccaacactgggaagtgaaggggggaggatcacttgaggccaagagttcaaaactaggctagtgaacgtagccagaccacatcgctacaaaagaaaaattttaaaaccagctggatgtggttggcatgtgcctataatcccagctactggggaggctaaggcaggaggattgcttgaacccaggagtgcaaggctgcagtgagttacaattgcaccactgcacccggcctgggttaaagagtgagaccctgtcagaaaaaaaaaaaaaaaaaaagtcatttcataaaattgttggaaaatatgcatttctgaaggagaggcgtcagtgtgaagaacactcatctgaactaagaatcagaaaatggatctgaatttcagctttgctattcattcagtgtccttaaataaatcatgcaaccttgcacatcattttcttatttatacaatgaaagcattggattgatcattgctaacatttctctctgctctaaaactgtgatttttatcctttgctatttgcaagaaccagaagagataaaggttgccttttatgttagatttgattctaaatctaatgatataggacagcggtgcttaagctatttttgtgaagtgataaggaaaaaccctgggaaaggttcagtggtggtttgcacagctgattatttgttatgattaattgttccacttttattttcttttgtggcctgtaacctaatttttcacttagtattgggattattttagtacaaacaagtgatatatttgtaagaagggatccagagagtatggtaaaatgtctggatgctgatgttctctaagttaaaggagattctagggggtagtctataataaaggaaaaacacattttttaaggttttaatttttcagagtgcagggaggtgctaggtgctttcctcacattaagtataacatttccttttacagtatgtcagcatattgttgaagttttccaatatgaaaataatatctatttactagcatattaaagcttagcaagagaattttaatagcctcatttagcctcctaaacagtcagaggcagggaaatattattagagtaacaacactgtaggtgctctcttttgtctctagtagcaaaatgaattctggctaccatgtactgtaggagtgctgctggcttgaggctcctgagatctggcatggctgttatactgacttgttttctttcaaattcatgttagaaaaatctgtgcgtgtgtgtgtgtgtgtgtctgtgtacacaaatatttatattactgtgtctcagtgctttgagactgtgtgaggcgggggaagagctgttgaggctttttatagataaagttgataatgcttttttgacttggttttctgttaccatcttttttgtctctattatgatatctattatataagtcagaaggagaaatgacacaaatgccagtataccagttcaagataggatcttggtttgatttagctaaaatttaccctacttattggtgcaatttttaataatagaaaaccattcctcattgcttggaatttttatctgcactttccattttgaatattattgttagttgttgaacaccaggtttactctgcaggacaccaagcaaagctttagaaatttctgccatcattaaaccctgaacagactgataagcagcaaaattgaatcagtttaaaaaaaaaaaaaaacttgccaacaaaaaaagtccaggaccagatggattcacagctgaattctaccaaacattaaagaagaattggtaccaattccaaaagattgagaaagagggaatcctccctaaatcattctatgaagccagtatcactctgataccaaaaccaggaaagaacatttaaaaaaaaactacaagaaataataaataaataaaaattaaaaagaaaactacagaccaatatccctgatgaacatagattcagaaaacctcaaggaaacactagctaactgaatccagcaggacataaaaaagacaatccaccatgatcaagtaggtctcatcccagggatccagggatgatttaacatacacaagtcaataaatgtgatacatcacataaacagaattacaaacaaaaaccatacgaccgtctcaatagacaaagaaaaagcatttgataaaatccagtattcctttatgataaaaaccctcaacaaactaggcatggaagggacttttaccttaaattagtaaagccatatctgacaaacccacagcaaacatcatactctatgggaaaaagttgaaaacattccccctgagaactataacaagacgacaatgcccacttttaccccttctatttaacatagtcctagaagtcctagccagagcagtcacgcaagagaaaagaaataaacagcatccaaattggaaaagaggaagtcagactatcgtgattgtatgcctagaaaaccctaaagactcttagattcgagaaacaaattcagtaaagtctgaggttacaaaatcagtgtttacaaatcagtagcactgctgtacaccaatgaccaagccaagaatcaaatcaagaacccaatcccctttacaacagctgcaataaaatataaaatacctaggaatatacttaaccaaggaggtgaaagatctctataaggagaactaaaaaacactgctgaaagaagtcatagataacacagacaaatagaagcacaactcatgctcatggactggaagaatcaatattgtgccagttgacagattcaatgcagtccctatcaaaataccaacatcatttttcatggaattagaaaaatatcctaaaattcatatggaaccaaaaaagagctcaggtagccaaaggtaattgtaaacaaaaagaacaaatctggaggcatcacccactacgggatttccagttatactacaaggctgtagttaccaaagcaacatggtactggtataaaagtcggcatgtagaccaatggaacaggacagagaactcagaaataaagccaaatatgtataaccaacctgatcttcaataaagcatacaaaaaagtaaattaggaaaggacaccctatttaataaatggtgctgggagaactggttagccacatgaagaagaatgaaactggattcctatctctcaccttatacaaaagtcaattcaagatggatcaaagacttaaatctaagactcaaaactggaactagaagataaccttggaaaacctcttctgacattggcctaggcaaagaattcatgactatggtggctcacgcctgtaatcccagcactttgggaggccgaggcgggcggatcacaaggtcaggagatcaagaccatcctgatctcagtgaaaccccgtctctactaaaatacaaaaaaaaaaaaaaaaaaaaaaaaaaattagccaggtgtggtggcgggcacctgtggtcccagctactcaggaggctgaggtaggagaatgatgtgaacccgggaggcggatcttgcagtgagccgacatcatgccactgcactccagcctgggcgacagagtgagactccatctaaaaaataataataaaaaaagaatcatgactaaaaccccagaagcaaatgcaacaaaaacataaataaatgggacctaacggaatcaaaaaacttctgcacagcaaaagaaataatcatccgagtacacagacaacccacaaagtgggagaaaatatttgcaaactatacatctgacaaaggactagtatccagaatctacaaggaactcaaacaaataagcaggagaaaaacacaaataattccatcaaaaagtgagtagatgacaggagtagacatttctcaaaataagatatacaagtggtcgacaaacatgaagaagtgcttggaatcattagtcatcagggaaatgcaaattaaaaccacaatgagataccactttattactgcaagaatggccagatctggtgaaaggggaatgcttatacactgctggtggtaatgtaaattagtacaagctctatgaaaagtagtgtggagattccttaaagaagtaacagtagaaggctgggcacggtggctcacacctgtaatcccagcactttggaaggctgaggtgggcagatcacttgaggtcaggagtttgagaccagccttgccaacatgatgaaaccccatctctactaaaaatacaaaaattagccgggtgtggtagagggtgcctaatcccagctactcaggaggctgagaccttgaacctgggaggcggaggttgcagtgagccgagatcacgccactgcactccagcctcggtgatagagcaagactccatctcaaaaaaaaaaaacctaacagtagaaataccattctatccagcactcccactacagggtatctacccagaggaaaagaaatcattatatgaaaaagacgcctacacatgcatgtttattgcagcccaattcacagttgcaaagatatggaaccaacctgagtgtccattgactaatgagtggataaagaaaatgtgatatgtatacaccgtggaatactactcagccataaaaaggaacaaaataatgtcttttgcagcaacttggttggagctgcaggccattattctaagtgaagtaactcaggaatggaaaaccaaatactatatgttctcacttataagtgggaactaagctatgaatatgcaagtgcatacagtgatataatagacataggagacagacgtgggaagagagtgccagataaaaaaactacataatggttacaacatcactattcagatgacaggtgcattaaaatctcagaattcaccactatataatccatccatgtaaccaaagctattgaaattttaaaagacattttagccgttatttttgtggagccatgaacatgattcagaggctaaattgtaataaaagatttctcttaatgttctactaagttggttgcttggtgttatcataaccagtgtaaagtgaatgggccatagaaggccttcttctataccagggagaatagggaacctcttaagggtcgttgtaaattttttgttgtaattgcaggatgagtgactttgaacatgaaaaaagtaagagtctgtgaatagatgtgttatggagctgctgtttttaattcagaaagggagggtgtatagtaactgctttaatatgtaaaaatctttaaaatttttatttggtctaaaaagcattacaagtagaaaacttttttttttttagtttctgtacagttaagtcgtgagttggacaaagaatttttactgaaggaaatagattattggtggagactcaaagtagtaagggcagcattttggagttcatccattgagcctttttgcattcaggtaaaatgagagctaaactcaggccaaatggagagatggtcagaaagaatccagttttatgttacttctaagcaacctgagcttagtatttgaaaaatcttcattcatatttgtctatttcatcttcatcacaacttagaactttctcatattgtaacacatctttatatttaatatcaatattgtaattcctgccacagtggttcttacttgtttttaatctttatcattttctctgttggacctatttttaggactctggttcatcttagctcctcattgtctgaagcagaaaaacttctttcaagaggttctttgtgataaaataataaaaactgattacacagcgttgcactccattatttacacagatttgggtaataaaggaaaagtgtttggtcagattctggggacctaaccaaatatattaggaaagtaaagaattcagctaaaattcttttaataaaaataaatttacaaaaactcggtgtccattaaaaagattgaaacaaaaaatagaaatgtatatggtaaatgttaaccatttagtgtgaaactacaagtcctttttcctgtgttcatatatatgtccataggtatatgtaaaagtcagatcatatctgtaactatccagcatatttccaattatatgcaaagcactgtagtgtgaaatacggggactgtttgcactttaaaaacttgtatcatgaaggctgatttttaaaaattataggctggaaatggtgcaaatatgctatatatgtttatatgctgtatgggaagactgatttttttaaaattataggctagaaatggtgcaggtatgcttatataactaagataactaagttgatgtgcaagacaggaaagaatggttgaaattaaaaaccataatttaatattgattttgcactaataaccagacccaattttggaaattccaacttgttcataatgtgcatatacaacaggagttttgcagagttttggcaaagtatgtggcagccacatgtcttcacagaacactgaaataatccttagtaaactctggtaactctaacttgtgaacaccaaattaataactcttaataatttaacgtatttgttattggtagtttgctttcagcttcagacaattggaactggctgaaatacaaaggagtttgcgtggctaatctgattgagaaaccagaagcttcaaggacaatagggcagggctgtgtttggactctgcacttctgtgttttgctttaccctcatggttgcaaaataactgccagcagcagccagggaaatatgcttccttgttaataatgtccagagaaaagagagtagtctcagtattctctattaaaagtaagactatatcagaaaggttcaggagctctgtccttgatttcactgcccagaattgaataaaaatttgaaatgcagttcacttctgagcaagccattagctagggggatgggattaatcattcaggccctttccttgtccttgctcttattcagctagagagagttggaatggcaaccagcatgtactactactatgtaagccctcagtcaaatgtcacaaccaacagaagcaacaattttgaatcagctctatcccactagtggcaggaagaaaatactttggcaatcactagtgtaatgagaagtgggctgaggatggaccctaaggaacactaacttttaaccagtagagcaagaggccaaggtgggtggatcacttgaggtcaggagttcaagaccagccttaccaatgtggtgaaaccccgtctctactaaaaaaaaaaaatacaaaattagctgggtgtggtggtgcaagcctgtaatcccaactacttgggaggctgaggcaggagaattgcttgaacctgggaggcagaggttgcagtgagctgagatcaaaccatcacattccagcctgggcaacaagagtgaaactccatctccaaaaaaaacaacaacaacaacaacaacaaaaacaaacaaatagagcaagaacgaggagcctgtgaatccatttcctgttttagtccatattgcttctttgatatggaataagacagtaatgatgactccaggatttttttcttttgcatttctttttccaagactagagtaaatgctggaaacacattaaagttagaaatagagacttgaatttattctttaataaaaaatgttccttgaacatttaagtaaaaatgtatctatgatacaagcattttctaatttaagataatagcaagcagaagaaaacaagttaaatgtaaattttttttctgtttcctgctctgtatgtaaagtcaagaatctgacctttgagtaaatttcatcatatttcttatcgtaaaatagattacaaaataaatcctgagaataagtaaacaaacacttccctttgaatttcctggggtggtttgtatttcgttttttttaattgtggctggtcttcagattcattcaaaatataattttaagagtccattttttgggagtataatactgacggcatttagcaatttatttttaattatgagcttcaaaaaactattcagtttgcttgaattcattaattttaacagcatatgccatgttcagtttacccagtggcttttcttcattaaatctgtgtgtctctggtcactttaatgtcagtagctcatcagtttcttcgaagtgctgcccattagaattatggaaggaaggctgggcacggtggctcatgcctgtaatcccagcactttgggaggccaaggcgggcggatcacctgaggtcgggagttcgagaccagcctgaccaacatgagcaaactccgtctctactaaaaatacaaaattagctgggcatggtggcaggtgcctgtaatcccagcttctcgggaagctgaggcaggagaatcacttgaacctgggaggcggaggttatggtgagccgatatcgcaccattgcactccagcctggacaacaagagtgaaacgccatctcaaaaaaaaaaaaaaaaaaaagaattatggaaagaaaagaaatatggaaggagttgtgattggatatactgaggttaaaggataaaatgaaaagtgtatcttgtagtatatatgaaggcagtgtggttagttactaggaagaactgcatccttgtatgttttttaaaaaaatcttacaagtagtgttgttaaaatgtatgactcaaacttcatactcatctttacatacatatttaatatgttgaaaaaattattcttctaaaaggaataaatggttaggtttgctgccctgtgtgggaagacatcagtgattggagattgattgtgattagtaatacattatgaatggtagtggattgaatgttctacgtgcaaggaccctcctgtccttgagtgattataaacaaacacttgattttcgcttggtgctttacatgtgtaggaatgacagacacactgaactactgtttatctctgcatatcttttagacggtgagatattagccaacagactcaattcaggagaccagagttttttttttttgttttttttttttcattttattttgctgctgttcctcacctagttccaaagagtgggataaagcattgcattttctatttcatatttgcctcctctgaagtttgacactgtaagtcagtggttcagggtcttctaggggtttgttaaaacccagattgttgggcccccacctccagaggttctgatacagtaggtgtgaggtaggggccaaaaaagtgcatttctaataagtttccaggtgatgctatgatactgatccgggtactgccctttaagaatagctactgtgcactgttcacaatagcaaagccatggtattaaccaaggtgcccattaatgatgaataaagaaagtgtggtacacagataccacggaatactacacaaccataaaaagaacaaaaccatgtcctttgcagcaacatggatacagctggaggctattaccctaagcgagttattgcagaaacagaaaccaaaataccacattttctcacttgtaagtgggagctaaacatggggtaggtaccacatggatataaagatgggaacagcagacactggggactccaaaacggtcaggaggaaggagagcaagggttaaaaaattagagatcaggtaccgtattcactgtttgggttatgggttcaatagaagccaaaacttcagtatcatgcaatatatccaggtagcaaacctacatatgtaccctctgaatctaaaataaaaattaaaaatttacaaaaagaattaccattgtgaaaactcttattttttatttatttttttgagacggagtcttgctctgtcgccaggccagagtgtagtggcgcgatctcagcttactgcaacctccgcctcccaggttcaagcgattctcctgcctcagcctcccgagtagctgggactacaggtgcacgccaccatgcccacctaatttttgtatttttagtggagacgagttttcaccacgttggccaggatggtctcgatctcttgacctcgtgatccgcccacctcggcctcccaaagtgctgggattacaggcatgagccactgcacccagcctcttatttttattttttatttttttggagacggagtctacctctgttgcccaggctggagtgcagtggagtgatctcggctcactgcaacctccaaccccctggttcaggcagttctcctacctcagcctcctgagtggctgggattacaggcgcatgccaccacgcgcagctaatttttgtattttagtagaggtgaggtttcaccatgttggccaggctggtcttgaactcctaacctcaggtgatccgcctgccttggcctcccaaagtgctgagattataggtgtgacccaccgtgcccagctgtaaaaactcttaacagttttaattaaaccaaggaactgtcatattaaatttatttaaggaaaagatgcatagtatttactactgtttagattagactttatattggttctctctctctctctctctgaatgttacctattacattaggtgacccacagggaatactcacttaaaattttatgtttctttagtcaaagaatggttatcacttggtgatgggcattttgtaacttttcacagacacgttagttactgctgttgggctgaaagccacttttggactagcagaaaataccttgcgttattttgtttaacatttcaagcaaagataaaattttttaaaaattgttcttaactgagataacataattattatttcactaaatgaatattgaaacttttaaaaccaatctgaagccagtacagcctctttgccattgccagctgtgcatgttgctatggaaactcagtagggactagcaggattactgttgtgaggaccacacctggtttatttgcatccagtttaagttgggggaacatttcaaaagaataaaaggtctcaagatgtgccaatggacagcaagaaagagcttgttagtttgtaaccatcatattggaagggtgggtaggtttttcttactccttacagttcctggttgggagggtttggtggatgtgttaaaaatttgttttgtgtattcatttctctcaatttttcgctattccttacggtgtttttttgttctgtgtgctttttgttttaggtatttcttcttgtaatttaaatgtttttttcattctcttaaagtatggacagatcaaaattttttaagaggaaagaatttaatttcttttcagttgtattatgtaataaaatatcttaataaggttttcatcactgttagctatggtagaattttatgttgatctctgattttaagtagtatgagcctctatgctccccttcactcacaaaaacaaaaacaactccttttatttatcccccgcccccgagacggagtcttgctctgtcacccaggcaggccggagggcagtggcaccatctcggcttactgcaacctccacctcctgggttcaagcgattctcctgcctcagcctcagcctcagcctcctgagtaggtgggattacaggcacacgccaccacacccggctaattttttttttcttttctttttttttttttgagacagcatctcactgtgtcaccaggttggagtgcagtggcgtgatctctgctcactgcaagctctgactccctagttcaagcgattatcctgccttagcctcccgagtagctgggattacaggcatgcatcaccatgcctggctaatttttgtatcttttagagacggggtttcaccatgttggctaagagggtctccttctcctgacctcgtgattcgcctgccttggcctcccaaggtactaggattacaggcgtgagccaccgcgcctggccaacaactcctttttaagaagacactttgaactgcatttgattttgtttgtaccattgcatctcagctgttcagattcatgaaataggaacaaaactgaatgtacagaaaaaagttatgtgggccagttatatgagcactgagtatggatctataaaatttacatagttttcattaattagctatactactcaatcagttacactgacttataccagttatactaattatgctaaatcaaaaatagctataatagtacaagtatatgttaaataagagtcatagcatgtaccatttctttattggtttatgttgtttgaattctatcgatgaggattctgaggcctcatgacaaagagggggatggtcaaccagtgatagtaaattttcacacctgtgtgtaccaagtattggtctttctcattttctaaatacaaaatataatcttatatcttttttcagaatacatccatagcaacctgtatggatctattgctatctatatcgtctatctatgtatatatataaagccagtagatacttgtattgtatattagggggaggttaatgtcaaatgtggagatcaggtttttttttttatgttagtgaaatgcaccctttaaaaaaaacctgagtaggctgttttatccagcttcatgaaagaatagcaccatacgacacatattcaaagaactttctgatttatctccatggtcctttagtaagggcaggtactagttatttctgttttgtaggtgaggaaataggtacaagaggtgcctgcctaaggcagctaatctaaatgtgtcctgatggatagtctggtgtcccccactgtgtgtaattgttctctctttaagtgttaggttattttatacagcttactcagttttgcctttttctctttttgtgttcatagactggaaaagtaagaagagctttcctgcctttttaattaccaaactactctcagttttcaatgaatcagttcaaagaaagaatgcagtctttctatacctggtaaatattttctgctaaataaagctattaatttagtagcatctgataaatccaggtgttatgatgattacctttaattttgtggaatgactattaaaatgacttatcaaatatatatttttctatttttaactctgaaatttgtttgatatttattgatatgatggagtgatgcttgggatgcctgcgacccagccagcaatggaaaatagtttaggattggccctagttcttagattagactctggtctcttttgaaaaggttgtgaaatcagtggaaatagggtatataaatatatttttatatcatctttattctgtgatgatatatcattagcattaatccctgtatgatagtttaatagaagcactttgtaaataatggttttataaaattaatgtagtaatgagaatattacattttaccattttacaaattacctacatgaagattaaagaagtaacttgcgaaagaaattcagctagctagtgtagaacagagatccgactccagttcagaatctacatctgactcctagtctagtgccttttttatatttttatttttaagtactttaaatataaatgtacgtgtctaagagaataaacaaaccatagtgatgtttcacatggatttttcttttgatatagcttataatgttacagtgttactgttaacagtattaaccattaattaactggtatgtgcctttgaaacttttgtatgtattattttatttaagcctacgaagaactcttgagagtattactgtccattttacagatgaaaaaactgaggctcagaaaggcagtcatatagctcaatatgctagaactggagtttaaacctagttctgtgttctttcaaagcacgttactaaactgtttagcctgcttatttttttaaacgaaaatttatgtgatcacaaattcaacccatctcatgttcactaacactgattatggaatcatttcctctcctaattcacctatccaaaaatctcagcattttagagagaggtgaggtagtgttgagaaaccatatattcctccgtaatgattttaactaagggaatcatactatttttataatgtaattcaaagatatgaatcttatccccctttaaaaatgtttatgaaatatttgtatatcgtaaactatgttgaagttcaagtaaactaatttgggcaagtccaaagggatattttctgtgactgaacatttatctcatgttttcactttttatagttgataagcaataatttattttcataagacattttaaaaacgcttttcaaaattagctgacacctttaatgaaaaaaaatgatgttatagaaagagtattattcagaaattaatataacatttcacatctgactggcctgggggtaaataaggcttattatcatgaatgaaactgtaatgatgaaaagtgtagagaaaatctcttcttagtaaaatagccagaatgtctgagtttgccaaaaccaggagaatctttgctttaaaacctgtctcattccctgaagttcacctttcctcaggaatctcattaaattactaccaccacctggctggccaaaagagggtggggacacagagaatgtaggcaatttttttttttttttaaacaggatctctctctgttgcccaggctggagtgcagtggcgagatctccactcactgcagcctccacctcccagactcacgtgatcatcccacctcggcctccttagtagctggtattacaggcatacaccaccacacccagctaatttttgtttttttgtttgtttgttttgtagagatgggtttttgccacgttgcccaggctggtcttgaactcctgagctcaggcaatctgcccgccttggcctcccaaattgcggggattacaggcatgagccactgcacccagctgaatgtgatatttaaaatacctcttttaatagctcatatcatgtaaccgtttattcctggtacggtgtggagatcttatagcgaataatttttagttacatgaattttagcctatgctattctaaatgagaaggtacatttgattgcctaatgcctttctattttgggcagtcatatttaggactttatacaaggtgagaagcattaacagatagtactttgattttactttttagtaaaactctttcacctaaagcttataaagataatgtgaaatttattgagataatctgtcattatggaaagattacaaagttgattaccctaagtacacttctaccactcatcctctgagtagaagggcaggagggtggggcagggctggaacaactaacatttcctggaattcctactctgctgggcatatggtagacatgttcacatgtattcttttatttttagtatacatagaaatgtagaagtataggaagtagggcaaagagaagaaaagcgttgtgcatggaattattccttcctttttgtttgtttgaacggtcaacttgttaaccctccacattctttcttcatctgcttttggcagcagcaaatacagttgattgtttccagtctctgaatcataactacctgggactgctgtatagtgttcacctggccagaggtgcttcttttttaagttttcagaagacaacatttgtacttcttaaaaaatgttatttgaggattaaaacatgaagacaaaagaagaaaaagaaaaccactagtactttagacatgttcagatagtcctaacactattaagactctattcctgtgtacaataaagatgattttctggcctgtggattaaaaagcatggaaatactcaagagcatcgcttaaaattttttcttgtactaggagaaaatgtttgacagttgtatttattaaatatttatcaagatataatacctttatttttataattcctgattactttcaaaataacatattaattttaaggataaccttgggagacagcataattctcatttttcaaatgagaaaattaaggttcagatgttagattagttttttagtaatgccgtaacacggtactacaaacaacagaaatttattgtctctcagttctggaggctagaagtccagaataaggtattagtaggtttggttctttctgagggctgtgaagcagaatctgttccatccctctcttcttgtcttcatctgttctatgtctgtctttgttcaaatttcccctttatataaggatagcaatcatattggattaggcccagtcctaatgaccagatcttaacatttgcaaaggccctatttctcactaaggtcgtatttacaggtataaagggtgtagactttaacatctttttggggaagacacagttcaatccgtaacagatgttaagtcctttcctctcctaaatagtgtctcgtaagtaggaaagtttgacatagcacattgtagtgccactaaaatggtagttttaaaagaacatgacaatatatttataataccacatttaaaattcattttctaatactggcttatgtctggggagattttattttaaattaactaagtttctaaaatattaatagaattttgggttgtaatggtttcaaactttttcttcaaataataagtaagtgatgacaccaactgtgtaaagttattcaaaacccagtgcttagatctggctttatgtctgaacttccattaataaaatgtagacttgtaaaatgtggactcctctataagatcttgaaatgtccatcagaatactgtttaaattgttgcaagagcaatctgacagtggaatatctgtacatttcatatttatgtaaaaattgtggttttaccagtgttaatacacatcttgtgactagggatttctgagtgttggagaggtcaaagccatactaggataaccaaaaaaaaaaaaaaactgtatagtggtttgttcatctgtttcctttttctttctttgctgtttttttaaatttcaaaataatttgagagttacagaaaaaatgaaagaatagtgcaaacaactcatcctggaaccttttgagagtaagttactgacttgatgctctgtcacccccaactactttactgtccctacaaataaggacattcttcttcatagccacaatacaaacataaaactcagaaaattaacattgacaggttactatcgactaatccgtagaccctattcaaattttgccacttgtccccaaaatgtcccttacaccaaaataatccaatccaagactgcacattggatttagttgtcatatctctttactgttgttcaatctggaatagttccataagtctttttgatttctagggtcatggcactttggaagaatacattttgtggaatgtttttgaatttgggtttacctcatggttccgcatgattagattcaagtcatgccatgcatctttgacaggagtgtcatagagtgatgctgtattcttattgcatcctttcaggtggtgcaaaatttttatttgtttctttttttttttttttagacggagccttgctctgtcacccaggctggagtgcagtgatgcaatctcggctcactgcagcctctgccgcccgggttcaagcaattctcctgtctcagccttccgagtagctggaactacaggtgcacaccaccacgcctggctaatttttctatttttaatagagacggggtttcatgatattggcaattctggtctcgaactcccaatcgcaggtgatccgcctgcctcggcctcccaaagtgctgggattacaggcctgagccaccacgcccagcctgtttcttgactgattacgttacctttgatcgcttaaggtgatgtttgtcagtcttgtcttctgtaaagttgtgcttctctttgtaattaataattattttatggggaaactgtaaattttcatcaccaagttttcatttactagatttaatagtggtcctctctccctcccttcctccttccctggtctcactctgtccccaagctggagtacagtggcataatcatagctcactgaagcttcaaactcctaggcttaagagatcctcccacctcagcttcctgagcagctggcactataggtgcatgccacaacacctggctgacttttttgtagagacaggatctcactatgttgttcaggctgatctcaaactcctgaactcaagtgatccatctgcctaggcctcctaaagtgctgggattacaggcatgagccaccgtgcctggccttttgttatttcttgactgaacttattactgtgatggttttcaaatattgatttcccaattatattattctacattatttggaatcctactataagggaaagctttctcttctctatatttatatctgtatggactcatgaattcctttaagcaatagttataattcattcatttttttttccttatccagattgtctaaaatttggctaatgggaatgccttcaaactggtcttgtatctttttcacatattcccataattttttaaagtgcttccactagtggttttttttttttttctttgagaatccctgttttattaatagtagaaagtagcatttagaagtcaagatgtgggtgccaagtatggttattgctgtaggggtactattgcccccaggcactccatggacagaactagagaatagaatatatgtatatgtgtgtgtatttcacttaaagctgtgtttatttttgcatttatatattttgaaaaccattgactttataccaaaacttctaattccaatttagtattagagagttgattctagtttttttctctgtttaaggttttagttcctttccccaacagtggtacacttcactctcattatccttaaaataattacttactacagtttctctctccatataaccagtctcctcattgcttctccccactcactttcctaagcttggatgcctgccttactcagccccatctaatgacttttggactgaattatgaaaaaaagttcattttttaatgacaaatattaaagtaaattggacaaatttgcttctactacaccacctttggttaatttgcttcctctattcttatttatttttaatttggaaccctattagttccatgttgatggaaattctttgagatttttaaaattaagcttaattaggcattttatattatcttaatcctactcttaggagctgttacatttaaggtgttaaagataattagctggctaactagagatgctctgaacattgattatttttaatttcaacgcatataatcagtttaaaatgaattgctttcgttatatgaaaacattccatcatttatgaagaacaataaggactttttactgtttttaagtcaattctggtctcatttacctcagctctaaattcttttcatagaacattatttatgaacaaataatgccagaaaataagatgaattccaaaaaaatcaaggagttactatatgtgcgaagatgatttatgtgcagattttttcttattagaatggtctagggatattgattaactttggaagttgttagcaaaatataaatagcaaatataaaaagaatatttaactcctggactgttagagaggggaagaaaggggaataaagaaattgcatttaatattaaaaaccaggaaaggggggaagggagatccacaacaaagaacaactaaagtaaataaaaactgtaaaatgacatgatgggaaaaggccaaatatatcagtaatcacaaaggaagtagtaaatgggttaaacaaacctctactcagattggatttttaaaaaatgaaatgaaaatcctatctatttcttttcataagtgacatacctaaaaccaaatgacacagaaaagataattaatgaatctatggagctatgccagtcaaatagtataaaaacaaaagagctgttataacagtaaattctgaggccaaaaaaaggagggaggtagataaaggagaataattttaaagtgataaaggaacagtttaccaagcagaaatgtccatgtacgtaaaaatgtttaatataaaatgcctaataatcaatagacataattaccacgatgacagagatgttaggattatctgacaaggattttaaagcagctgtcataaaaatgcttcagtgagtaattatggacacacttgaaacaaatgaaaaaaatgtggagtctgagcaaagaaataggcctcagtagatagaaaatacaaagaaaaactaaatagaaattttagaacagacagctacaatatctggattaaaactcactgtgtaggcttacaacagaatggaggagacagagtgaactggaaggtggaacaatagaaattacccaatctgaacaagaaagagaaaagagaacaaataatcagtggaccctcagggacctttaggactacaacaaaaattcatctgaatgctgggaagagaggagaaagagggtagggctgaaaagtactttcagaacactgactgaaaactccccaaatttagtagaaggcatatacctatatagatttaagaaactgagcaaatttcaaacagaaaaatttcacaaaacaaaaaaatctccaagatacattataataaaactttatataaactggagacaaaggaaaaatcttgaaaacagagagaaatgacaccttacctatgggaaaaacaattccagggatagtggatttcttagcagaaaccatgcaagccaggaggccaaggcatatttttcaggtagagagagagctcagactcccccaaatctgtatctagcaaaaaatatccttcaggaatgaagggaaaatcaagacattgttaggtgaaggaaaagaaagaaaatttacctccagcagacctaccctaaaagaatgactaaaaacaaaagagaaatgtaatcatgttccatataacaatgtttcagtcaatgatggacagtgtatataaccgagatcccataggttataatggaactgaaaaattcctattgcttggtgatgtcttgatgattctggccctgtgtaggcctagtctaatttgagtcttagtttttaacaaaaaaaaatttcaaatagaaaaagctcatagaaaggatgtaaagaaagaaaatattttttgtgcagctatacaatgtctttgtattttaagctactatgggttattacaaaaaatcatttatttatttatttatttatttatttatttatttattttttcttttggagacagagtcttgctctgtcgcctaggctggagtgcattggtgcaatcttggctcactgcagcctccacctccttggttcaagcaattcccctgcacaccaagcgtggctaatttttttttttgtttgtgtgtcttttttggagatggagtcttactctgtttcccaggctggcgcactctcggctcactgcaacctctgcctcctgggttcaagcaattctcctgcctcagcctcctgagtaactggaattacaggcatgcgccaccacgctcggctaatttttgtaattttttaaatagagatggggtttcaccattttggtcaggctggtcttgaactcctcaccttatgatccaccccccttggcctcccaaagtgctgggattacaggcgtgagccaccgtgcccagccaatttttttttttttgtgagacagagtcttgctctgtcgcctaggctggagtacagtggcacgatctcagctcaccgcaacctccacctcccggtctcctgcctcagcatcccaagtagtggaattacaagcatgtgccaccacgcccagctaatttttgtatttttagtagaaatgaggtttcatctcgtttgttgttggccaggcgggtctcgaactcctgacttcaagtgatctgcctgcctcagcttcccaaagtgcttggattacaggcatgagccaccacacctggctaaaagacaaattttttttttaatgaaaagtttataaattaaataagttacagtgagctaaggttaacttattattcaagaaagaaaaatatatttttataaattgagtgtagcctaagtgtacaggctttctctagttgacactagtgtacagtaatgtcttaggccttcattcacattcactcacaactccttcactggctcacccatagcaattttagtcctgcaagtcccattcatggtaagtgccctatacaggtatactatttttaatcttttatactgtatttttacggtatcttttctatgtttatgtatgtttagatattcaaataccgttttagaaatacttgttagaaatgcaaataccattgtgttacaattgcctacagtattcacactaacatgctgtatagatttgtagcctaggagcaataggctatgccatatagcctaggtgtatagtagcctgtaccatctagttttttgtaagtatgttcacacagtgatgaaaccaccaaatgacacatttcttagaatatagccccattgttaaacaaagtatgactatatacttggttgtaaatccaacaaaacatgtacaggaagtgcgtgctgagaaccacaaaatgctgatgagagaaatcaaggaagatacagagtaagggagagatatatactatattcagggattagaaggcttaacataggaaagatcagttctccccaaattgatatacaggtttaatgcaatttctatcaaaattctcacagactttttttctagacatgaacaagaatagtccaaaattaataggaaatgcaaaggaattgaaatagctgaaaaaattttgaagaaaaataaaataagaagagtcagttaccccaatttcaagacttattatatagccacaggaatcaagcctgagagtattggtggagggataaacacagatcagtggaacggaatattgaacccagaaattgacccagagatgtatagccaacttatttgtgactaaggtacaaaaacaattcaatggagtaaggacagtgtttttgacaaatgactgaagaaaaaaacaaaacagaaactcaacctaaacctcacataaaaaaacaaaacagaagaacatcttcaggatgcaggatttgatgaacagtttttaaacgtgacaccaaacatacaatccataaaaaattgatgaattggcttatcaaaattaaaatattttgctatgtgcaaacctctgttaagaggatgaaaagacatggtccacagtgggagaaaatatttgcaaagaacatatctaataaaggactcctgtctacaatgtataaagaactttcaaaattcaaccctaaggaaacgattcattagaaaatgaaatttttggatttttttagaacacctgtaatcccagaactttgggaggctgaggcaggtggatcacaaggtcaggagttcaagaccagcctggccaagatggtgaaacctcgtctctactgaaaatacaaaaatattagctgggcatggtggcatgcacctgtaatcccagctacttgggagactgaggcagagaattgcttgagcccaggaggcagaggttgcagtgagctgagattgcgccactgcactccagcctgggcaacagagcaagactctgtctcagaaaaaaaaaaaaaacaaaacttcaaaagaaagaaatagacatgtcactgaagaggctgtatggatggcaaataagcacataaaagggtgttcagtattactagccactagggaaatgcaaattaagatcaccatgagctatcactgcacacctactagaacagctaaaataaaaaatagtgacaataccaaatgctagtagatttggagaagcagatctctcacattgtttgtgggaatgtaaagtgttacaggtattctgaaaaatatctgacaatttcttaaaaaatgaaacagttcaggcatggtggttgtcgcctgtaatcccaatacttaggaaggctgaggtgggaggatggcttgagcccaggagatccataccatcctgggccacacagggacaccctgtctctacaaaaataaaaataagccgggcattgtggtgtgcacctgtggtcccagctccctaggaggctgaggtgggaggattgcttgagctcaggaggttgaggctgtagtgagctgtgatcacaccactgaactccagcctgggtgacaaaagtgagaccttatctccaaaaaacaacagcgaaatccctaaacctaatacacatagagtttggatatttgtccccacccagatctcatgtcaaattgtaatccccagtgtcggaggtggggcctggtggaaagtgtttagattatgagggtggatccctcatagcttggtgcggtcttcttgatagtgagttctcatgggatctggttattttaaagtgtatggcaaccccactccccagtctctgtctctcttgctcctgcttttgccatatggcatgcctgctcctgccttcactttctaccatgattgtaagcctcctgagatctccccaaaagcagatgctgctatgttgcctatacagcctgcggaacctgagccaattaaacctcttttcttatgcattacccagcctcaggcatttctttatagcaatgtaagaatggcctaatacatacatatgccctatgagctggcagtctcacttctgtgcatttatcccagagaaataaaaaattatgttcacataaaaatatgtatacagatgtgctttacatattatatatgagtcctgtatcagaaatgtgctttgccaatatttttccccagtgttgacttgtcatcctctttacctcctatgtacgaatgtttacagcaggtttattttaataacctaaaacttagaaacagccaaaaagtccctcaataagtaaatgcctaacaaacagtgggacattgctgagcatggtggctcatgcctgtaatcccggctacttgggagacagaagtggaatgatggcgcttgaccaggagttcaagaccagcttgagcaacatagtgaggacttgtctctaaaaaaaattgttttttgtttgtttgtttgtttgtttgttttttaattagccaggtgtggtgacatgctggtagtcccagctacttgggaggctgaggcgagatgatcgattgagcccaggagttcaaggctgcagtgagctatgattatactacagcactccagtctgggcaacagagagataccccatctctttaaaaaaaaaaaaaaccctgaaattaaaaaacaagcaaactgtggtacatccataccatggaatacttaatattcaacgagaaaaaggaataactattgatacacaccaaagctttgttggatctcaaaggcatacataatgccaagtaaaaaatgccaatctcaaatggtcacgttactgtatgtttccatttatataacattaccaaaataaccagttatgaaggtggatagcagattagtggttgttagggattagaaatagccagagggataggagttggtgtgactgtcatggggtagcaggacggaattctttgtgatgaaatagttctgtatcttgattgcaatgatagttacatgaacctgcacatgtgacattaaaatgacatagaagcatactttatatcaagagcaattgtttggatttaatataatggtgtagttacataagacgtaaccagtggagaaattaatgaatggtacatgggacccatctttgaagattcctttgcatttctagtaatttcaaaataaaaagtcaaaaacaaaagagagggatatcatagttgctataggatttcagaagaagaaatagttccttgataactaggagaatgagggaagacctgaggccatagcttttgaatagtttttataggataggtagacttttcacgaaacaatacagggaaaagaagggtattttagacagatcgaggttaatgtttatggaatgactgccactgtattattattaagaaatgttagtaacatctgattagtctgaagaataattaacttaatgaggaggaatgtatctttagattttatatctgatatagaactctgagatatttgttacccttgtggtgtcacacagattctggaagcctgagtgtaacagataaagagagaaaacataaattaccagtatcagaaatgaaatggaacagttcaaaaaatggatgggaataatcaaagctgcctgggttttaaacaaaacaaggcttattttttcatggatttaagaaattgaatcagagaagaactcacattttatttgttgaaataggataactctaatattatttttatttttttgagatggagtctcactctgtcacccaggctggagtgcagtggtgcagtctaggctcactgcaacttctgcctcctgggttcaagcaattctcgtgcctcagcctcctcagtagctgggactataggcgtgcaccaccacacctgactaaattcttgtatttttagtagagatggggtttcaccatgttggccaggctggtcttgaactactgacctcaggtgatcctcctgcctttgcctctcaaagtgctgggattagaggcatgagccaccgtgcctggctagaactctaatactagacaacaatgtcaagacaaattactatatggtcctgtgttaaaactctgtagtgacctattctttttctccctggaatgttcacagtttgtcattacaccttttggtgattgcttaatatttctattattcagttacaagccttctgaaacttgtccttgtcgagaccagctcagtcgtggagaccctaacccagtggcgctagaggaattaaagacacacacacacaaatatagagtgcagagtgggaatcagggggctgacagccttcagagctgagagccacgaacagagctttacccacatatttattgacagcaagccagtaataagccttgtttctatagattatagattaactaaaacaggaaacaaagagatggactctggctagttatctgcagcaggaacatgtccttaaggcacagattgctcatgctattatttgtggttcgggaatgccttaagcagttttccatcctgggtgggccaggtgttccttgccctccttccggtaaaccaacaaccttcagcattggcatcatagccatcacaagcatgtcacagtgctgcagagattttgttgatggccattttgggagcctgtctatggccagatttgggggcctcttcccaacatgtctcccctttttgtttttgcaagatgataaaagcaaaggtggctttatcacagtgagctacttctcgcaggagtcgggatctgcatctgcagactatacacagacaacacagattaaaagcacgatcatcattgaaatcacagagtctccaagagtttttatccattttaacgggttaatagctgctaatcatttgcagctccttcaagcactccagttcctggcattaaggtcacgtgtgcctgggatgctttaagtatttgttcttttaattttgcaatatccaaagacaagtttgtagagtgtccttctagatgcttttttattctttcccaaattttgatcttattaagagccattaatagtttccacaaatccttatgtttagctcctacagtgggccatatcatttgaggttgaggtgccactagaccgccatgttttcagataataggaactcttgccatacttcttaccatttctaccatttgaccgttttgtttagaggagctgaacatagtgtggccatggcacgcagactgagaggtgcagttcaagctaaacatccccttaggggaccaatcaataatgatgccataggaatcattgctcagcacctctgcctgttctgcaatgcaatcttcccaaacaagtatgttcattttttctgaccaggtccaatcctgtttacaaatttgtttttgagggccgtatgcctcaattataagagcagatttattatggtaaatactgagaccagaaagcatgtgtaactgtgtcataaagtgattatgtccaggcattatttgccagccaagattgatagcgagggggtaggcaactagtggcctttctcaaacagataggcggacattcaaatcctaaacaaatattcataacagttcttttctcatgtgagtgagatgggcctctaacatctgtagcactgagcatccaagagctatcattagtgtatacctccactgggggggtccagccaagttacaggccatagaagtggtagaaaaggtaaatatgcccaataagtataattgttctctgtgtcagcctttgctaagggaatactcacggtattggtgatcaccgctatcatagctatcattagattgattactcattgtgactggttgtcctgctttcctcaggttttcttccatcatctgtgacagcttcttgatctgtccccaggtaggtggctgtatttgacgggtgttgctcatgacagttgaggtcctcctcagtgtcattcttgacatggctgcaaccagggggtttttgggatcctcccaaaacctcttcctgggtatctggctcatagtaaggtttcaggtgtcttgatggtatccagataggctgctggttttggcctggagaaacacaagcataacctctaccccaacttattattttacctgtttcccaactttttgttgtcggatctctccaccaaaccagttgttttgcttctgtctttgcagctggtttctgtagatgctgtttagctgctgataacatctgggctttaggcaggctcaaaaaatttaaagtcagtaatgctagattcagttgcatatgtggtgtcccgtagttcctgtttccccccttttgcttttgcaactgctgtttcagttagagattcattctttccactatggcttgtccttgagaattacatgggataccagtaatgtgtttaatattccatagagagaaaaatgtagctagagcttggctagtatagcctggggcattgtcccttttaatagaaactggaatgcccatcactgcaaaacactgcaaaaggtgacatttaacacaagcagaagactctcctgattggcatgtagcccagacaaagtgagaaaatgtatctacacatacgtgcacataagctagtctcccaaacgagggaatatgggtggtgacatccatttgccaaagagaattaggttccaatcctcgaggattaactcctcctgtaaaagatgaggaatgcaccatttggcaagttgggcatcacttggtaatagctttagcttctttccaggtaatgctgtatctgcatttgagaccagaggcattaacatgggttaaattgtaaaagtgtctggcattagatattgcagtagcaactaggcaatcagccatttgattccctgcagtcaaaggtcctggaagaggtatatgagccctaatgtgagttgatgtaaatagggtgcattctactcctaactgctgtttgcaattgggtaagtaaagtcgtcagctgctcatctgtttggaatcgtagctgagcattttcaactaactgtgtagaatgaaccacatatgaagaatcagaaatcacattaataggcatatcaaaagcagtcaatacctcaattacagctacaagttttgctttttgagctgaagtatagggcgtctggaaaactttacctttcaagccagaataagaagctttaccattactagacccatctgtgaagacattttcagcaccttcaattggtttaaatttagttgttttagggagaatctaattagttattttcaaaaattgaaacagttttcgttttaggaaaatggttatagagaatacctacaaagtcagctaagtgagtttgccaagtaagactatttgtaaaagcctgttgtatttctgcctttgtaagagggacaataatttttccaggatcatatccatgtaatttaacaatcttagttctcccatttcctagcatagtagcaatttgatccaaataagcagtcaaagtccgtgaattagtttgtggaagaaaaagccactttacaagatgttgctcttgaacaataacaccagtaggtgaatgctgagttgaaaaaattagcaaatctagagtcttctctggatctattctatttatttgagccttatacgcttgcttctcaattagctgtaactctgcctcagcctcctttgttaattgctgagggttagtgagactaggatctcctcaaaggatagaaaatagattactcatggcataggtaggaatgcctagagcaggtcatgtccaattaatgtcccctagtaatttttgaaagtcatttaatgttttcaattgatcgctatgtatggttactttctgtggcacaatggtagtgtcatttactaaggtccccaagtaggggtaaagagtagtagtctgaattttgtcaggagctataattaaaccagcatgaaaaatcgaattttgcaagtgatcataacattgaagtaatatttctcgagtgggggcagcacaaagtatatcatccatataatgaataatgtaacactgggaaaattttttacgagtaggttcaattgcttgccttacataagtctggcaaattgttggactgtttaacatgccttgtggcaacactttcctataaaaacacttagcaggctacaggttgtttaccgcaggaattgtaaatgcaaactgttcacagtcctgctcagctgaggggatagtaaagaaacagtcttttaaatctatgactattaaaggtgaattttttggaatcatagcaggagaaggcaatcctggctgtaatgcccccataggttgtataactgaattaatggccctaagatctgtcaacattctccatttacctcattttttcttaataacaaagactggagaattctggaggaaaatgttggagctatgtgtcctttttctaattgttcagttactaagtcctctaaagcctccagtttctctttacttagcagccattgttctatccaaattggcttatctgttaaccattttaaacatataggttctggaagcttaacaatggccaccatcaaaaatgataccctaaaccttggcaggaactttgtctttctacttgaagtggttccttcaaaccttgcagattttttcctagtcccataccagggacataccccatttcctgcatcatatgttgactttgagggctatataattgttctggaattagaacttgtgctccccattgctgtaataaatctctccccaataaatttataggtacagaagttataactggttggatagtcccaggttgtccattgggcccttcacaatgcaaaatataactactttgatatacttcagaggctttaccaactccaactatgttaaattgagcagattgaattggccacgtggacggccagtgctgtagagaaatgattgaaatgtccattcctgtatctaccaaacctttaaattctttaccctgaatagttatttcacaggtaggacatttatcagtaatttgattcacccaataagttgctttgccttatttgtgcttccaaatcctcctgttcgtgtagtttcacttttccccatctccatatatgacacaatcaggagctatgctatatgctctcctggctctgctttccagggaacagaagtagatataacaatttgaatttccccattgtaatctgaatctatgacttctgtacgtacttgcactccttttaaatttaaactagacatacctagaagtaatcctaccatcctcactggcaagggttgacagattcctgttggcactttttgtgggggttccccaggcagaaggctcacagcttttgggcagcataaatctactgcagcactaccggctgtggcgggggacaggcattgtacaggggtgagggaatggcctgagccagaaatgccccggtttgggcgctacttgccgagaccaggtcggtcatggagaccctaacccagtggcgctagaggaattaaagacacacagaaatatagagtgcagagtgggaatcagggctgacagccttcagagctgagagccacaaacaaagctttacccacatatttattgacagtaagccagtcataagcattgtttttatagatttagattaaaacgggaaacaaagagatgggctctggctggttatctgcagcaggaacatgtccttaaggcacagatcactcatactattgtttgtggttcaggaacaccttaagcggttttccacactgggtgagccaagtgttccttgccgtcattccggtaaaccaacaaccttcagcatgggcgtcgtagccatcatgagcatgtcacagtgctgcagagattttgtttatggccattttgggggcctgtctatggccagatttgggggcctatcctcaacacgttcttgtcttcccaattcctatgcctgtgcctgaaagcacttagtaaatacttgtggaatccattaatgattgaaatcagtgacttggcaaaacactttaaactagaatgaaagaaagacagttatagaagtaaagaaacagtatggtaagataggatcatgtaggataggctagacagataagtttagtgaaatggtaaaactttaatagagctacacaaagatttaagcttttacaaccaagaaattcaggattggattttgtaatagatttagttttaaagaatgccagattgttagagtgaacagtagatgagctatgtatatagctgtaaaaatgtaatatagcacaggttaaaagagaccagaaacatgtcatttcaaaccgctttctggtggagtagctttctcagtgagccaccacttaaatgacttgatgagattaactgacagcccattcctgtttgatgcactatctgattccctatagcatgctgaagacttattccatggtatgtctaccagttgagttgtaaagttattaagaaccatttacttgtttgtgctcccaatactgttcatgctagttgtactaattttaatcacactatttatttatttatttatttacagatggagtttctctctgtcacccaggcaggagtgcagtcacgcgatctcggctcaatgcaacctccgcctcctgggttcaagcaattctcatgcctcagcctactgagtagttgggactataggcgcatgccatcacgcctagctaatttttgcatttttagtagagatagggtttcaccatgttggccaggctaatctcgaactccagagctcaggtgatccacctacctaggactcccaaagtgttgggattacaggcattagtcaccgcacccagcctaattacacaatttaaataactatataaaccaaggaaaagaatagaaaaagaaagatgatgtttctgtgaaaattaagttaaatgctttggaaagatttgataaagggtaattactaaaaaatactgaattagatgtgtgcaagagagctataaaatagtagggataaattattctaaaaaaatagaaaagcattatggactcagattgcctcatgtgtcatataattcttgccccacttttaaagcagtgttttttaatctatgagacatgaagtcaatttaataggttgaagtctagaacacatcgcaatacatttatacctggaaagaagcattgttctatggaacttttcttgagtttttagtatttagtctatacatatatgtacaatgtaaaatgtgactttcagtgaaaaacgtaaaaatcttttgagttttttatccaaactcaaaaggctttggcccaaaaaaattggtgaatgaatgtgtatttatatgctttgggttaaaatacaatcattatgtacttgtgtttatgatacttaggttgaccattttgttcagccaaccaactactgatctcagtctcatgggataagaatttttacatattttattttacttgtcttcctctcatgccctccatattgtgcctgagtccccaacccccaccatacctcggctctctgtttagtagctatgtgaccctaagggtcattaactaggcctcagtttactttttatgaagtaagattatccttcagattgcttgttatttggcagtgcttaatagccacgttgataaagtacatgtctttcatggtatctgcccatctagatttttagtaaatgatagacattccgttaagttattctaaaagatttttggtggggggaggggacactgagagccccataatgcaaccttagagggtatcatttacatagtctgtgatgtagttgacaagaatggtggcagtgccaatacctatcacttgattctgagtctcaaattttcaagtcctggaatgttgtttcatatttggtgggcattagtaaaattattttagtttgtatgtgtgtgatgggtttgttggactttttttgtaaataattattgataatgcttgaggtactaagtatttttattacagagaattgaaatatcattaagtgttttctgtaagtaagttaataggacactaaattattggtagattggaaaagagatgaaggttggaaaggatattggtgtactgttgagattggctggggtgaaaccagtggtgctaaaagatgcagacaccccccatgatatagaaaggaggtaacaggcaataattgttgagtcagacatttctgcttgttcaactagttatatggtcagtacagaatagagggtacaaatggctattcatatagaacatgaccaggctggatgttaatgatttagtaaggtagaatataggccgatctcagttcactctcacataaaaggtgtgttttaaaacactagtttgtgatttagttgtcattgccctcaatttcatttctaatgatacctacactggcccataagatcatgaatataaaaatattttaatactagtagtgtcggctgggcatggtggctcatgcctgtaatcccagcactttgggaggccaaggtgggcgaatcacgaggtcaggagttcgagaccagcctggccaacatggtgaaacccgtctctactaaaaatacaaaaattagcctgacttggtggcaggcgcctgtaatcccagctacttgggaggctgaggcaggagaatcgcttgaaactagaaggcagaggttgtagcaagctgagattgtgccactgcactccagcatgggcaaaagagcaaactccatctcaaaaaaaaaaaaaaaactagtagtgttaaccgtgaattctgggtcctggaagagcgtttgtcccctcttttagaaaataaaaaaaggctacattttaggcgtaattgtgaaatacatgagtttgaatttgccctttcagctcctttttatacttccatatgttactactatttcctattattactaccttctatgaaccctttgcccacattaccccacccccaatccaggtcctctaaacatcagttattttatcatttattggcctcttctctagtagaaacaaccattgccttacaatcaactcctcaactaggtgttaaatgaaagcagtgggattggattaattcatgctcaagtgtgaatgactgacaatcccacaaacctctcaaaaatgattttcctttgtacaacgggtgttctttctaggttaagttttagtctaattgattctttgctattatttcagacagatgaccaagtgaaatggacatttgaactttgtgggaaaagctgtcattttcttcttttggacataaatgtgccatggttggggagtacaggcaagagacggtgacagtccctctcccaatccatctgtagaggcttggacaaactcctggtatttaaacttcccctctaaaattagtagggtacctaggtcaagggtggtagaaagggacttttcttgcctttccttcccactgtagcaatgtgagcttttttttctgggtgagctttgcagtagaggggaagcggggggtcccactctagatagtagcctgtgtgggctggtaaactatagcctccctgctacaggtcttgtgggactcccttagcctgaggaggaggctctttcactaggaaggtgctgctcctgttgggtacagacacactcctttgttagcaatgattgtctggctgcaagtcatccttagctaatatatgaaagaccacactcacagtagaaaggtagtttagagatgttattacataaagtagaaaagggcagatggtaagttgcagaaatatcccataataaatgcaaataataaattttaaatttcgtaaaggcggaagaggagggaaataaacatttattgatatctactgtaatctagtcacattcatcattgcttttcatcttttctcaccaaggagaatttgtataatccaacatattctaccttaaaaactcatttgaaatttgtgttctcttctataatgtattcttattttaatacaaagtggtgtgaaatattaaataagattgatgctttcaaaagatggacatgtttatccagtgacttgatgtctgccctggcacaactgcatcacattcctccagtccacgctcttgtctgagaagcatgaaagcatttatctcacaataacctcatgaaagggatatcatcattttataggtgataaaattaaggctcgaagaaggaaggaacttaaacaggtattacaggtattaaatggctgtgttaagtttctcccccaaagtctctcctcataagcattttgtgattcagtaaaacagaaaaactggtaatgcagagtgctgatccaaaagtttaaggtttttggtcctctactgacttgcaagggaatctttttaaaggccccttgttaaaatctgtctttcatttcctgaagactagttctaaataaaaacagttattaatgggctgacacctttcagaactctcctcaaatctagtgcactcttctgtgtatctgtacacacctgacttttaaacacaatgtctttgctgccgtttactggtttcttcactacacggaaaacaaaccattcagtctgctgctttaccacctctcagcaattccctacgtgtttaactcatccataatgcataggaatagccaagagcacagattctgatatcagaaaattctagttttaaatcctgattccgaattactagtgtgacattggataaagtgttttagttctctgtgcctcagtttccttactttaataatatataaggaaagaaaggggtaataatgcttattactccatggagattttataaatctcctgaattgtctgtgatgattaggctgttgtcattgtaatgcctaaaaaattttgggttgatgacttaccttgtaaatatactttaaattgaataaacatatagtttagtaaggattatatatatgtatgtatgttcattaagtgaaatatacttgagaataccaagtaattccacaatttacatggcccaccctttgacaatagagattctaagtaacaaactgtcttctttctacttgagatttattttcatgggggaaggatactgcataatatgtagcattcaactaatctattctgttaatttggtagtataaaaagatttgtagataatgaatttctatactctttaagatactttatacaccttgcactgcttctgggtttactgttgcctcgttttaaagtgggactttctcttgacggaagtgtgttaagaattggaaaattccctatcagtagactagcaccatcttgacagccttgtgttctgcttctaccttgctaattgtttccttgggattatttggattgtgtagaaagctttttgcaaatcctcttattactgaagtcattgttgccagcaggaataagattaaaggtgcttaagtctgtagggttgtttctaatttgtacgtgtcatttcagtggcattttaacagaactctgtctcctgtacctcccttctcccttggtactatctccagttaggtccaagaagccaggccattggaagaagtctcattttatcctcctaattattatgctggcactcaggagataatttttcccttcatgcactgccaattaatatgcaaatagcctgataaatatttatgcaacgatttaaattatgcagggagtgctttcagtatattctgtaaatgaattgttcatggacttcaaagtgctggctgctgtgctaacgaggagagatttgcataaggccctaatcacgcgcatactgattaagcttcattatggaaactgccagctgcaatctttgtttctattttattacaaaaagaggaactttttcatgcttcagttgccttgacaatgtcagtcctagctggtaggagagactaaaactcctctgagcaactgaagtttccttattcagttgaagattgctatggtgtaacagaagttgtattttgcttttccccttaatccactttccaccctacgcaacccccctcttttcgcttaagaacatactgtagatttgttagaaatagtagtaccttctttccccaccccaaactgctacctgtttcttccttgtttggactctctgctcctctagaagatttcacagcaatgctggactgcagtgactatgttctaggtgggtaccagcacagttcttttcttagaagctttaatatggaaatagagtgtgtcgggttgactatgcataaatgcttaatcgcatatgcagcctgtggcgggggagggggagagttggactgagcagggaaggaggaaagcatttgcaaagcacaagcttacttgaatttgcagtaggtccctccctgtgactagctcttctgattcagagggtatcgttagtaaatacagttaatttagagttcagctcgaatgaatatttttgctttttggaaattcctattgagaacatttcatgtagttataaaaacatcttaaatctgaaacaaggcatagaactgtacatatataatatatacatattaataaaaatgtttttcatacctaatgagaacgtcttatacaaaaaccaaaatgctcagtgaaaaataaggttgagtcacaatgcagaatagtttttataaatgttaataaagagggtaattgtactggttgctgcaacagatctgttgatcgatttccagattttagaaactattaacttttcaaatttttgctaggattagtcctctttttaatttttttaaaatcaactatatactctagataactacaactttaaatgttggaaaacctttttagagttttctctgtagaacagcaagccttttggagtggaagatgtccagcttaaatttgttaaaaccatctttggtgatgaagatttcaaataaatcaaggcactttgatttttagatatatggtggctaatggtggtcatattttgtgtggagttatgtctgtttatatgcagaattattgagacttttttagttactctagtcacctggaaagttaaatgatatgaactccgggacttggatatcttacatttaaaacttttgcaaatgacttttttcctatattgtcattttctgcacttgaaaattaaagctgctcctgtcaccttcatagttgccaaagataaagtaaaatgatacttctgaaaacgtttgaattcttatgcataaggcatggcctaaacccagggtagcagtatctgcccagcacagtaaaagccactatgtaaagagtgaatgacagaaacaacaaatttatgtcaggaattcaatcttgtatttactctttgacatttacttagttaacaattcaaaaaaaggaaagaaaaatacctttttggaatatttttaacacatcattttagaagtagaaattacatctcttactttcagttaatagtaagtattatttaaacagtcttcccattgtgcaattttatttttgtgtgtatgtgaagtaatgttttatttttgtgtgtatgtgagataattttgttaaatgcttttgaagctcttgacagttcagtagaagaatctgagatgattcacttaaaatacctgtgacatagtctttatagatgggaaaattagaatatgaattgtacaaagtcaggctcatgacttgttaagaattatgcttatttctgcggtgcccacatatgtgagaaaactgttactctttttatgaatgttaactgattgatcattttttccactttcctttaaaattcatttaaaggaagcatggagcagtatgtatgctaatggtatattctattacatttgttgtgatctctgttgactttcatgagattttggttgtcattcagaaagctgatttttcactaagttgtacacctgttcctttcaaaccttagtatgctttcagatgatatttaaatttctctggacagtgagaagaaggaagttgtagaactgccctcatttatgaccacaaacatatgaattttaaccctttgaacattagaagaccaaaccaaagttatgacagaactgcctaagcccataagacaagcatcagttacagaaacttttactgtattggaaaagctattacacatcttcttgttggaaatgaaacttataaaagaaagactcctgattttttttctcatctgttatgcatggggataattcgactgtaaagaacatggttgagaattctgtctagtgattgttttgattttctagttagatgtttaagcagatgaaaaaatgtgctctttggtcaaaaacagtatagtttaaatatttgttctctgttaataactaaagttaaatggttcttaacttatttaaccactaaataagttaatgtgggtaaaggcagaacttatttgacagtaaacttgtttgatcataaatattctaagtttgagtttacagtagtagaataagagatatatttatgtatattccgtttcttaccctttcaaagacttagaagaaaagcagagttcttgtctcttctcttaatgtattttctgggatacctaatattgcttgatgaaaacattttactgtggaaataaaccttcattaagtagataacccagaaatgataaactcaaattagcagtttcatttaggatattgaggtagtattactttaagtgggtgtggttgtaatgcagttttgaaattattagctatatctgttatgccttacggtacaacttcttgtgctggtttatagttgaggtatgaatttaatatgttctcactttgacttgtttagtttggttggggaggggagtaaatttagagataatttaccttagacgtgttttcttttagttcataggttgagttactgtcccatcttttatcaagattaccagtgggttgttttggttataatgaatgaatatcattgcatatagaaaaagatactttatttgggaataacattttattatgtgaggtgcttcccccctttccagttttacttcatgttaaaagcatttattccttttacatatcaggctttctaattttcttcaggttacagttctgctgtctttctttaaagaatcttaaaattatttaaaaagacagtttatttgtgaatcccttcagggtctggggaattttgaatttcttccagataaccttttattataatttctagtattttagccagacatgtatacactgggtcttcttaaactatatgactataacattagttaacccttttctctgccacagttttgcctcctcaatcccatctccatccccagttttttaaaaaccttattctcctctgatttattgcagactcaagaatgaacaatccgtcagaaaccagtaaaccatctatggagagtggagatggcaacacaggtaagagttttctgatctagctttttaattaactctagtagagcacaaagaagaaagtttccatgtaactaggacttgtatttggcaaatacagaccaatttgagtattgagttgtcaaatatgattcagtcctttaggaactgggagggattatgtttgtttaagattacttaactttcttctgcaggcagcttcgttgttttgcttctgtctatcagacaaactatgcagaagttaggaaaactgtcctttgggtcagatagttttggatatgaaatatgggtttaccacttactagcttgtgactttaggcaatttccccaatctttttgagacttaatttattcaattacaaaatgaggataatatatttcaggttattgtgagtattaaaggagatgatatatgtggcatgttaagcaaaatgccagctacacagtaactattcagtaaaatgttttttcttacagatgttaatcaaaatagtaaattttatctgccctacctttgctataaattatattaaaagttatgatagtaagtagttatagacacatacccatttctaatacattcttttatttggtaatttaaaaaaattatacttcattaaaccttttatcaagagaaaattatcatataaatgagaatactgaggccccatgagagaaaggtaaatctgtaaaggatggtttgtctccacggctcatactcttgagtcagtatattgcttagaggatgtaagactatgtatctttatcatctgccagagaggatacagggacttccctggtttctggtaaaggtataaatcaaaatatgaaaccaaataagaagacagttatgggcaaggatgaacagaaagtacttgcttctaaaaactaggtttttcgcttgcagagagggatcccttttgacttatcattttaaaaatgcttaaccatgggcaatggtaagagtgagaggcactcttaatttgtggtaaatggctgagttggactaatgtagcagttttcctgcctgtatgtcttttgctgtaaactctcctatacctggagatgcttatgttaatctctaaactgtacatacctctttatgtgaaactgagctgtggggcttccatgttcacccctgttgtatttaacacacttcatagtactcttactgaggctagccaagtagacttctgtagtatctcttaagaagggaaagggcagcattgtattctgtctgaattgtcagccagtctcctttttgttacttctctgtcccctgtttggactccatctttctttcttgttcagcactggttcctatgccagtgccggtgcttcagccacctagcttaggtgtgggaaatgtttgcagagagaaatagggcagctgatccccttaagagactagagggtggggcagtgggcaggacacctgtgcctaaagaacagcttcaaagaagaaacatactttttttttccctaagggaagataagcaaatgattggaaaacactgaaaatagccattacatcagactacatggaaatccctgtatctactttaatgctactactgtaatagcagtttcagcagttaccatttattgagcaactacaacacttttttttttttttttttttttgagatggaattttgctcttgtttcccaggcgggagtgcaatggtgcgacctcggctcactgcaacctctgcctcctgggttcaagcgattctcctgcctcagcctccggaatagctgggattgcaggtgccagccaccatgcccagctaattttttgtatttttagtagagacggggtttcaccatgttggccggctggtcttgaactctgtgggcattacctgatttcgagttaagttattttgacaagttagataccattatttcaaattataggaaattgaggcacaaaaccagccaggaaataaagtcaggtttaggattcgcagcccacatgtaagtttccccatgaagtgcaataaaataaaactgaaaatttaagcaacacattgtgtatgtccagacctgtataaggtaagttctgactggagcacttgttgtaaccgtcttgtgaatttcttgcctcgttttaatatagaatgtgtggcagactggttcctatcagacttgcatatttacttaccatgtttgatatattagatataaaattacagtttatttagataattgtatgcttacaaattgatttttatttaagcatataacaaatgagccttcagactcttgagttgttagttaactattctttttttggtagtttatgaaagcaagtaaaatgtttaaggggaagaacgcttaacattatagtaaaactgaagcctcacaatttctggattcagaatatgtttgtgtagatcattttttcctgaaatgtttacaattgtaataattttgatttgtgacactttaaggagaatgatattgtaaaattattttaagattgtgttgatacgttaattctataccttctgtcattgattcgagaggcaaaatcaaatgatgcactttttgtcaaatagtccttttatgtttgcagaaaatttatagtttaggtttttaaaaaatgtattcagtaagtgcccgttctatgtgtaaagtactataatcagtgttattaggatgtacaatgcaaatagatgaaataaccctcagtctttaaggagttaacaattcattaagagataagacagataaataactgattctggatagattatggtaaataattcaagaggaggtacagaaaagtgccatagtggtgttaattaggtgtttctttgaagaaatttgtgtatgtttataggtcaggtggaaggacccatcagggagcaagagagtggagaaagaaatacaattaattgaaccaaggtaggggtgaaggtctaggatcagaagtgcagaatgaagggttgactctgaacatgaaaaagactaccccatgtctctaaaactggggagaagaagcaaatattatacagtaacagagaattgaaatggaagggagaagcaaaactgagcaatcattcacatcagattgcttcatttttctcattaaagtagttgaggtggtcatctgagaggaaggcagggataatagtaataataatggcagcagctactgttctttgaattcttactgtaggtgtctggctagccactttattatatatactttatgtcgtaatttttaaaatactcttacaaggttaagtagatttataaaaaggattgatgagccttttgagggtcagtctcaaagaaaataaatgtgttagcttatccagccaacctagttatacagctgatcattgaataacatggatttgagctgcatggctccacttatatgcaaatatttttcattaaatatgttggaatttttttgagatttgcaacaatttggaaaaactcacaaatgaactgtgaaatattgagaaatattgaaaaaaattaaaagatatgtaatgaatgcataaactatatgtagatactattttatcatctattaccatgaaatatcacaaatgtattaaaattataaaaccttaaaatgtatcagaacttacgcacacactcgatcacatacatggcaccattcacagtctagataaatagaaacaaatgtaaacaatacagtataaatcgtaattggataaaattaactgcattacctactatactactgtaataattttgtaaccacctcttgttgctattgcaatgatctcaagtattgtgagtatccatttaaaatgccatgtgaccctaatcatgtcacagtgaacagttcatccagtaaattgtgtattgcagtaaaaagtgatctctctatgtccttgagtattttgcatcctgtttagtgcaataacctaaaccttaaataatgccataagacctatacgaagtaccactggtggtgccagaagtgttccccaaagcagaggcaagtcataatgttataggaaaaatttgaattgcttgatgtatactatagattgaggtctgcagttatagttgccatccatttcaagataaataaattaagtgtaaggacgattatttaaaaaaaaagaaaaggaaattcatgaagccttcactgcagctacaccagcagacatgaaaaacttgaactttttgctaaatacctttttatttcattgaaaataccggcctggtgcagtggctcatgcctgtaatcccagcactttgggaggttgaggtgggcagattgcttaagcccaggagttcgagaccagcatgggcaacatggtgaaaccctgcctctactaaaaatataaaaaactaagccaggcgccatggctcatgcttgtaatcccagcactttgggaggccaaggtgggcggatcacctgaggtcaggagtttgagaccagcctgaccaacatggtgaaaccccatctctactaaaaatacaaaaaaattagccgggcatggtatagctgtaatcccagctactctggaagctgaggtaggagaattgcttgacctcaggaggtggaggttgcagtgagccgagattgggccattgcactccagcctgggcaacaagagcgaaactccatctcaaaaaaaaaaaaaaaaagctaggtgtagtggtgcacacctgtagtcccagctgcttgggggaagaggtggaagaatcacctgagcttgggcagtcgaggctacagtgagctgagatcacgccactgcactccagcctgggtgacagtgagaccttgtctcaaaaaaaaaagaaagaaaaaagagaatgcagcttttatgtgggtgcaggattgctataagaaagacatacctttggactctaatgtgatttgagaggaagcacagttgttatacgacagcttaaaaggcaggtgaaggatctaaagctggagaatttaatgccagcaaaggatggtttgataattttagaaagatgtttggctttaaaaatgtcaggataacggaagaagcagcttctgccaacgaagaggcagcagacctcaagttctcagatgccatggagaaaatcagtgaaggccgtctgtggtggctcacacctgtaaccgcaccatagctggaccccatctctaccctcaccccaccccctgcaaaaaaaaaaaaaagataagacaaaagaaggaaaatcattgaagagaaaggatatctgcctgaacaggtttttaatgcagacaaaagcgccctattctgagagggaaaaaatgccacaaaggacattgattagtaaggaaagacatgaaagcacaccaagatttaaggcaggaaggaataggctaacagtactgttttgtgcagatgcaatcgggtttatgatcaggacagccctatctatatcctattaaagactgctttttgccttcttttacagcatggacccttttatgatatgggcactgaaactaaagcacatggtggaagaaggattggtagcatatagaaacatttttagacaaatgaaaaagcaaaaaagtcagaaattacagtgtatttccataaagttacaccaagtgtgcctgcctctcctgcctccccttccagctttttgtcttctgccatttctgagtcagcaagacccctcctgttcctccttctcagcctactcagcatgaagacaaggatgaagatctttgtgatgatccacttccacttaatgaatagtaaatatattttctctcacttaggattttctttagcttactttactgtaagaatacagtatataatacatatacaaatatgttttagtcaactgtttatgttatcagcaatgcttctggtcaacagtaggctattagtatttgagttttgtgggagtcagatgttacatgcagattttcaactgtttgtggggtcgacacccttgactccgttgttcagggttcgactgtatgacctttctgtagcctagatcagcagtccaaactcaggaatgaagaaaatggaacattggattattgtgccaaaatagtatactatcaccaaaaaagaaagagatagaagggagtggtaatattttttataacatagttgtttgcacaaggatgcttccctttggaaagatggtatttccccattcttccctctcctccacctttggtaaagtctattctatgttctcaagattattccgtattgtagcatgtatcagaactttattttttataagatattccattgtatgtatatactacattttgtttatgcattcatttgttaatgggcagctggattgtttttactgtttggctattatgagtaatgttgcagtgaactttggtgtacaagtatctgtttgagttccgtttttcaattctttggtttatatacctaggagtagaattgctgggtaaaacagaatacaaacttattatcttacagtttgggaggtcagagtcctaaaatgagagtgttgtaagtgctttatttcttctggaggtactatggaaagtccatttccttctcttttccagcttctagagaccacctgcactccttggcttatggccccttcctccatcttcaaagccagatgtatagcattgtcaaatctgtttccttccctccctttcctgtccccctcctcccctcaaccctgcttccatcatcatatttccttctctaactctcctgtccccatcttttctttaaacacttactatcctgaacttcattggatttgcaaaataccttttgccgtgtcaggtaacaaattcacagcttccaggaattaggatgattattaggcccatctttgatgggctgttgttctgctttcccacaagattttctcctaaattaaagctgatcatctctattttagatgatagttggaaaagtaaagaagttgtttgaagttttacaaggtttggtaggaaaaaactaaatcaactattttgatgtaaagaaatattgagggaaaaaggaatattggacaaacattaaagttttgctcacttttaactcaaagggcagacctctttcatcagtactcctgacagatggttatctgccctgtgcctgggttcatgcactgacacagaacacagtactttctagtgttatctgttctctggtattacaactctgttttctacattcttttgaattttgtccttaggagtttgtcatcttttaagaaattaaagctcttctgaaagtcattgtcacattttaactcttttccattcatttgacaatttattacaaattaatttactataaagtagtaatttattataaaacaatttgttataatcatttgtactagaatatgatgatagtggctagcattgattaagtatttactgggtgatttaaacattttacatagattatctcatttaatccttataaaaacctcatgaaacattatttttctctttttataaataagggtctctttttataaataaggaagttgaggctcagagaggttcagtcacttgatgaaggtcacacagatagctataaaggggagcagaaccattctttttttaagatggaatttcactgtcgttgcccaggctggagtgcaatggcacgatcctggctcactgcaacctccacctcccgaggtcaagcaattctcctgcctcagcctcccaagtagctgggattacaggcatgcaaccaccatgcctgactaattttgtattttcagtagagatggggtttcttcatgttggtcaggctggtctcgaactcctgacctcaggtgatccgcccaccttggcttcccaaagtgctgggattagaggtgtgagcaactgcacccagcccagaaccattcttttaccctttgagctatgttgtttcttttttctttttttctttttttttttttttttggagacagagtctcactctgttgcccaggctggagtgtagtggcacgatctcggctcactgcaacctccacctcctgcattcatgaagttctcccgcctcagcctctcaagtagccgggattacaggtgtgcgcccccacgcccagctaatttttgtgtttttaatagaaactgggtttcaccatgttgcccatgctgatcttgaactcctggcatcaagcgatccacctgcctcagcctcctgctgggattataggcatgagccaccatgcctgccctgttgtttctttttgtctccgatgcgcaagataacagtactaagtaacatcagtgaagttgaataaaagactgattttgttctcaataaatttatcttatagagaaaacatatatgaaaatgtaatataacagaaattgagacgattcatgagaagtatatgtgaacccatgagaattcagtgtaggggaaaagtgtttctagctgggaggatcagagaaggctttggagaaggtggaattgaaactgtatcttacaggctgggtagggtttaaatcatgatgatgctaggcaatatatgttcagcatgaagaaacagtcaaagctgagatgggggaagaaatctgtcctaaatgtctctaattccttcaaaagatttccattatgtcatctgatttctagatcttttatcttttagtcattcacagaattagacagtattccaattcttcagacttcattgcagccattaccattaccttttgcttattattatctttgaaaacttaccattggcttattataattatttttataatgcaggtaaaaaggatatttaaatatattttaatataaatgttaatatatttaatcagattttctgatacttgttttgtaatgtgaaaagttgttttaaagcagctgactcatctgttgtaatgaatttacagtcaattaactgtctttttttcatctgaattatgatagatagatccaaggcttccctatcctgtcctttttcacttgcttttttcatttgaattgaaaggggagagttccctgaccccccttgcaggacatgcgacagggagtggctcatatgtttggctgcccacactcaaacctcttagaggaagggaagcacacagactggcaggtgcaggagttatggtaagcactttctgggctctggccacatgatagtgtctaggggtgggtgtctgcaactcccaaagcccaagtgggcacatgtttcagtgcactcttttagccttgccatctacagacagcttaagtgttagctcagtgatcctcttggtacccaagtccttgtgcggcgtccaggaagaatcaggtcacacatggacttgaaggatgaattcaggggttttgttgagcggtggaggtggctcttagcgggatggatggggagctggaaagggaatggaatgggaagatgatcttcccctagagtttggccatccagcagctgatttcctctttgaccacccccagtcgaattcctctcaacattcagacattccttctcttctctctgccacaccattctgctgttcttctgctctactgttcatgtcttctggagcctggggtctgggggttatatggagccacgatagtggggtatggcaggccaaaaggcaacttttgggcgcaaaaacagaaatacctgttcccatttaggaccatgggtttccaggcttgagggtggggcctttgctggggaaccaccctcttctacccagtatttccctgtctcctgttcatatcaaaatgatttttccccaggatagtatcactatatttcaggcaaatgaaaagtcaaaagaaatttgttaatgtaacctaatatacataaatacaatagtatttttggaataatatttatgggcttgtattccaaaaatactgtcatccaaagttcctagtaaccagtgatgttattaattctttgggatttactagtgctatggctggtattaggacattatatgctcatttatattcataaaagagcatgatcagatatcattttctccaagatgaagagaaagaatcctgaaagaccagggtaccagtgaatagacttgctattcttcatagtaatttaacaacttgatgccttgaaccagcactagttttggaaataatttccagataaaataccagtgttttccagaaaagcctcaaaatagacctcaatatagttcttgttaaaccagaatggagcatttgcaaatttcagacacttaaggattattttccttttgaacttacgtttatccagaggccatttttaatattcttactgcttttattattattttaaaatttattacatattttattgtgtagactacattctgccctggccaagctgctcttataagcctgagagtagaaatactaattttgtttggagtacctttatagctaatttttaattagtgggtcattgaaagtggctgaagcatttccagagagcctcaggagctcagtgaaggatcttggtggtttagaagcaaataccaaacacctgtaggaaagatagacctccctctagtgtttgatttaatagatgtcagttacaggatatggcttctacaagattctgatcagtacgtattgagaaacttgccctggctctgcccactggtgcacatggggattttaaaactttaggtcaggggtgggggtcaagggggagaagggcgctataattactgaagctgtgcgaataggaagtgacatctgaattaagattatacttttgttaaatgactgaataagcaattgatctttttgccatgaggtaacccagtaacaaatttagaattttaaaggtagtatccatttttgttcattactaatagaaattgagaacattaaagagagggtttgtttctaaaatgctgttttcagtacagattattagagattgtctataattttctcccttagagagcagcttagttttatttcatgttacttttttcattttttttcctaacagatattaaagaatttttggtataaaagaattttccagccatgttatactttacatcttgcttgaagccaaaaactagactacattattctttcaattagatccattatataacatcctggcatagagcaatggcaatagaagccaggggtcaatttttttttttttttttttttttttttttgaagaaggaaggaaagggagtaatttaaaatgaatacttgtatttgcctcggggctgggagagatgtggtagcattctctgagtaggaactgtactgttggggagtagacttgacaatgagatgatgaaacatttcagcactgaaaatgttgtacttggggtgccttgtggtgcttgcaggtgaagatgtgggcaattgaagatagagataggttcctgaggagaggtgtaagagtctttaacagggaaatgctacggggaggagagtggaatcagccaagaggaccaaggacggagctcttctaaggtgttgaaagggctggtagaggaagaggagcccatgcctttgttgtcgaataggatggacactgactgcatgtggctctttaaatttaaattaaattaaattaaattaaaaattcaattcctcaatcatactaaccacatttctagtgttcagtagccacgtgtagttagtgactaccatattggccagtacatataatagaacatttccattatcacagaaagttctattggacagtgcttaagtagactaagaaataacaaccatggagatcagatgtgaatcagaccagtgagctcatggagttagcatttagtgtggtcaagtcctgccataggagccttaaaatgtgacccttgaatttgacaattagttactgtgggccttttaaagattttagttaagtggtttggaaagaaattgctgtggttaagaaagtgaatggttgtgtaaagggaatgataaatgtaagcaactcttttcatggaagctctatatggggctatatatatgtatcatagtggttaagagctcagaccctgaaatcaaaccccatggattcatatcttgctcctttcacttgctagttgtgttaccttaggcaagttacttttttcatgttagagtttttcttagctgtaagatggagataaataataatccatctcatagtcttgttgtatacacggaaagcaagtaggtatgtggcacagtccattcactatcagtgttagctatctattaggaggaaggggaggatgatagagaaggaaagaatgggaggggacgttagaagggcctcctagtgaagcaatttgaatatgtttagatgctaagggaaaagagccagtgtaggaggggagtggcaaagaaagaacagatgatgcagccataaaaaggaatgagatcgtgtcctttgcagggacattgatgaagttggaagccgtcatcctcagcaaactaacacagaaacagaaaacgaaacaccacattttctcactcataagtgggagttgaacagtgggaacacatggacacagggaggggaacatcacataccaggggtgagggtgaggggagggaacttagaggacgggtcaataggtgcagcaaaccaccgtggtacacgtgtacttatgtaacaagcctgcatgttctatgtatcccggaacttaaagtaaaataaataaataagaaagaacagatgagtcagggatccatttttgaggagaggggaggtgttgggtttcagagcacgtggtggctgaagtagcctaaagtagaagattcctttttttgttgttttttaggtgagaaatgggagagtaaaggagataaagacagattcagatagtaagttttcaggtagaagggaatgtaagaaagcagtctagagaggattaggaacagtcaattagggatttccttgtgatacagggaaaacaaaactgggaatagaatgcaataaacaagtctaggattaaaataaacactatcagcaggatttgtagcaaagtgtcataatccaagttaggaaggctgacatcagataaactcagaaggtaaagagcattcattgtgtttctgaggaaggcaggaagctgctaccgtttaactggctcacatcctacagggaaagatgagcaagggagcctctgactaggttgagaggcagaacagagatggagcaaggtcaatgtttggtaattttctccaccaacaaaaatattaataagattttaggatattaaaataaggtctgtctttctggttttcttggtcttcaaatatatttcatttatgttcaatatttaagttatttgaaaagtctcaacagctggtaagtcataagacacttatttttctacaattaagaataaagttaagagcctggaatagtggctcacacctgtaatcccaacactttgggacatcaaggcatgaggattcctggagcccaggagttgaagactagcctgggcaacatagtgagacccgcatgtctacaaaaaaaaaaaaaaaacttaaaaaaattaactgggcatggtggcacatgcctgtggtcccagctacttgggaggctaagggaggaagatcgcttgagtctaggaggtcaaggctgcagtgaaccatgattgcgccactgcactccagcctgggtgacagagtgagaccctggatttttttttaaaaaaagaataatgttaatgaaaacctgttttaactgagtctttcatccagatagacttaacaatttagcaaacagccacctatagaaatcttgtcatgcatcactgataatgcattcatctctaaggtgatgtataaaagtaattttaaaaatacacatactattattacttaggaagtaaaggatatacaatccaatcattacaatcaagtacaatcactgtggagatttttagcagataagtaatacctatccattctatagatcagcagcccccaacctttttggccccagtgactggtttcatggaagacagtttttccacagacagcgagtaggggatggtttgggggataaaactgttttttacctcacatcatcagtcattagttagattctcataaggaatgcaccacctagatccctcgcatacactgttcacattacggttcacgcgcctatgagaatctagtgccactgctgctctgacaggaggcagcgctcaggcaataacgctatcttgcccaccactcacctcctgctgtgcagcctgttcctagcaggccacagattggcaccagtcttcaacccaggagttggggacccctgctatagatattctgtgtcatgaattttgattatgcttcttacttttgtagtggcttagaatctttctgtggttttgtttctgtgataagtgattctctttcaggatttccattatcccagattcttcccattttatggcagctcagatggaagaaacgctctccacacaaacaatctaaaaaatgagcagtagctaagttttcctaaaagatcttttagctattatttatgtcctgtggttgcttgactttctgtgaacttcatttggaatttgtccttgcttatcaaggtgatgtagtgatgggcacagatattgtcattatttcctatagggtgtcggaaatttagtctattggtaattttgccttgactgccttaaatttacttataaatagaaatatgtgaataatgtatttttcctctttattatgtaggtttaattgaagtagtatattattttcattacacattaacatgtagtatagtactatctcaaatataactgctgggtgatgaaaaatagccttcacaaactcatgttccaaaatttctcaggcccttattcaagaaattgttaatcttattttcatgtgcacttctaacaggggtgcatttcataacagatcataagcagccatttatacagacgaggctggctgctctaggaaagtaagccagtagagcagaaactgtcagatttataccagaactgcagtcttttattttcttttttagattgaggtgaaatgcgtaacataaaattaactattttaaaatgaacaattcagtggcatttagtgtattcacagtgttgtgcagctaccaatctatccaggtccaaaacattttcatcacccccaaaggaaaccctataccccttaagtagttgctctccattttcccctctccccagcccctgacaaccaccaacctatagtttgtctctataaatttacctattctaggtatttcatgtaaatgaaatcatatggtatgtgaccttttgtgtatggcttctttaacttagtataatgttttcaaggttcattcatgtaatagcatattatcagtactcattccttttatggctgaatggtattccattatatggatataccacaatttgttggtgtccctttgtctcttgatggacatttgggttgtttccactctctttggctcttgtgaataatgctgctgtgaacatttatatacacggatttgtttgagtacttgttttcatttattttgggtatatagtcatgcataacgtcagggatacattctgagaaatgcaccattgtatgaacatcatagagtatgtttcacaaacgaagatggtatagcctatgacatacctaaactatatgatatagcctgtttctcctaggctacaaatctgtacagttagtatactgaatactgtatgcaattgtaacacagtggtatttgtgtatctaaacatagaaaaggtacagtaaaaatagggtattataatcatggttctattgttgctgatggaaatgtctttatatggtacgtgactgtatgtctagcagtgaagttgctgggtccactttttgatggtccttcaaatagttaaacatagaattaccgccaaacttttttccatagcagctgaaccattttatatttccacaatcaatgtacaaggattccaatttctctgcatccctgccaacacttatttcttctttaaaaaaattacagccattttaatgggattaaataatgtactttaaaaagtggcaactcttcattcattttccccaggaaataataataactgaaacctcctccttttttccaatgtttttgtgtattttcctctatcttatagtcaaaatatcttgtaataatgagatgagaatgggcaataataaattgtgtttacatctaaggcagttagatgtttgacttgtcaccttggttgtttgtgccttgctctcttaccctgaactacctgtatcacctcatctctcctacatcttagccacactaaacctctcaaaactctttgtacctttctaagagcaagtaagtgctctgctttgcatggcttgaggacagtgacagtaccttattcttttttgtgttctaccttccactttttttagataccacttttcatagatatcttattttttttaatagtgcttgtcttttgtattacttatttacttgtctgccacccaaacctaactgtgagctccttgtagtatgggaatatgactttgtaaccctaggacctaacagggtatttaaaattgttaaaattcttagattttattttttaacgtggccacggtgtcttctacttttggtatagaaatgcttggtattttcttccctcactcaaccttttccaattaattccatctcatcctcttaagattcatctgaaatgttgtctccaggaagcttccctgaccttgccttctccctttccccttaaagtcttcttttaatgttcttgtcagtagcctatgtggtatctgttttatactttccacattgtatatatatttttatgaatatggaattcataaatgcattacttgtgcaccccggccagactcgctatcccttttcctctttatttttccatagcatttatttgtatctgatattcaatattttttcatttttattatctatttcccaactagaatgtaagctccacgaaggacattatttttgtctctccactgctgcatctctgacacctggaacagtgcttgctatacagtatatgctcaatacgtattttttgaatgaattaatcagttaatgaataggcctgagaactacttaagagcagtgactgtggtgtattcatttttataacctcagcatctggaatatcaattctcaataaatatttattgaatacagcatttatttttacagcaggatcttttgctatgtgatattcctggttctcatttgttgttgtttttgtttgttcctaaataattatataaaaatagaaaatgcacataagcaaaaataattgtttcattcaaaataggagatgattcagtcatagtcttgtgtatatgggcgtaataattttatctaaagccatttcttataaaggtaaaactgttcattcaagggaagagaaatttctactgaactgtaaacatgaacacatcagttggctaagatttaagaaaacagctgaatatttttatattcatatttcaaagtaatcattgctttggagtagattaaaaataaaggttgtatagggtttcaggtgagttttgattaataagaaaagattacatacacatcaagttagattaagttcccaataagccaatgatactaagtattattgggaggcaaagtcatttcagaacaggtgtactatacttaatgtagtttcccttgccccctgcaagtaggatcatatcagatgagagaataaaaagagtaccttgcctttttacatattcaggattttggtctccgttgagaatgaatcttttttgttcttttgttggaaatgggctatttacaaatattttccagggttccagaaaactcagttctctgcaaccaactttcttactctgatttaattctattttgtcgtctgtgtgattctgatacttagtctgagacctatagtaacaaatgtatttccatgcatttagctaaagaacatggggaactgacattgcaaaagacagattttttttctttttaaagtgtcatgatttccttcagatgtagctaggtcctgaacagatgaggcaggagaattgcttgaacctgagaggtggaggttgcagtgagccaagatcttgccactgcacttcagcctgggcgacagagcaagactccatctcaaaaaaaaaaaaaaaaagaaaagaaaatgtattatctgtgttaggctgggcacggtggctcatgcctataatcccagcacttcaggaggctgaggcgggcagatcacctgaggtcgggagttcgagaccagcctgaccaacatggagaaaccccatctctactaaaaatacaaaattagccaggcgtggtggcgcatgcctgtaatcccagctactagggaggctgagacaggagaatcgcttgaacccgggaggccaaggttgcagtcagccgagatcatgccattgcactccagcctgggcaacaaaagcgaaactccatctcaaaaaaaaaagtattatctgtgttttaatttctgggctcaaaaggttgatctgttttgaaactattaatgttggccagtcatggtggctcacacctgtaatccaagcactttgggaggctgaggtgggtggatcacctaaggtcaggagttctagaccagcctggccgacatggtgaaaccccatccctactaaaaatacaaaaaattagctgggtgtggtggcacgtgcctgtaatctcagctcctcaggaagctgagacaggagaatcgcttgaaccagggagacggaagttgcagtgagctgaaactgtgccacttgcattccaacttgggcaacaagagcgaaactctgtctcaaaacaaacaaaattagctgggtatggtggcacatgcctgtaatcccaactacttgggaggctgaggcaggagaatcacttgaacctgggaggcgcagggttgcagtgagccgagatcgcgccactgcactccagcctggtcaggaagaatgaagcaccatctcaaaaaaaaaaaaaaaaaaaaaaaagaaagaaagaaaaaaaagaaaagaaactattaatgttatatcttaagtaatgattaaacgtcctaaggaaaactagattttataggagttaagattttggaaatattatttataattaggctggcccttaaagtcttcttgaaggaagtagattccaggctggatatttcataatgactaggattttcagagctagagaggagggtgaaggatatctgcattttcatcctatttgagggtttcaccttagctttctccctgactctcctctcctccctcccacctcttcttttctccttctttccctaatgtgtaatgtttcctctctcatttatacattttaaaattaatgttcataggatatagatttccattctcatttgtggaaaaatgacaacaggaataggataaaggagaggactgtcctcccaccgcaaaaatagatgcacacctgggcagaattcaaacagcagaagtgtgtctcttttaagagactggagactgattgctttggagatgacattgaaggataaattgaaaggatgcccattttaggaaaattttagcaataaaaattaaagctgttatcacaacttaatggtaatactcatcatggtagagaatttgaaaaatacagaataatgtattcactattaacattttgatgcatttcctatttgaagacgttttttgacaaagttgtcctttataaaatgtaatatttcttgtgggctataaaatttgatttgattcctttttaaaaactttattttaatgtaaaagaaatgtagttgaagtagctagctgtgagatagatagcaaaggccagaattctactactttgtcatcttatgtccccttatgagcctgatcatggcctcaattactgatttgtcacttagctaatatttgtgaatgagcattgaattggagtccttcgtcattggatggtttagtagaaagggcaattgggagagagttgaggcaggggtgctagacaaatcggtggaaggctcggaatttcagtctgagctcaattactatccagcttggttatttcagtggaagtatttctgtatattagaaaaaatttcttatttgtaaaacaaggagcttgattagttctttttaatgtccctttcagctttaccatttccaaaatatgaaataaatagaatcatgtggatgtaccctttgaatctggctgcttttacttagtatagcgggcttgagattcatattcatctgtgtcatatgtactttagctcaattttatttcttccctcactcccacaaaatgttgaggaagtaccaaatgtgttttcgtagtaagaaggtatagattattgcttttgggttagagagatgggaaacatgaaagaaaatagcatttgagctgagcgctgaaagacatttaaatgcctgaatcctgtgcaaagctgagtaatatgaactgttcatgaagggaagaaacctttgcctatttgatccttgactgctggctatgaagagaaaaacagaactttctgggagatgaggactctccagtgcttgaacttaatataaatccaactgtctctcagctgggtcttcactgtcactggtgctaaccttggattcacctctaatttattccctgtcacatttttcattgcatatttccagtcttctctatttctgttttgctctttcgttttctgaaaatatctgccttttgattactgaaaaaattgtagctgtctgatttgagcctcaccacctccctcttcaatactttacatttttctgtttttacctaccttctccttttttttttttttgcatctgacaaagaaatatctctctttacccccaccgcctccattatttgaattgtcttctcgtacccttcaggtttctgccctatctttcaaccgctattgttcttaccttttcagcatatcccttccacagactctttcagtcttttaagtttgctcaggttttatcaacctcaagtctttccttccaccctatctgcccctttgaattatcatcctcacgctgtcccgccagtacctgacttatgaaagaaacgatcatcactcaccaccttggcttcattattacctgcttttgcctttattccttgcaatctggatgtgtacccagaattttgttgcacttttttttattgttgattcttttacgattttatgcaaaagtaattgtaaaaacttgtatgtaaacatgaatgtagcgtttaagtactcatatctaccactgtggccataaagtagaatgttaccattcctcagaaggcttctgtaggcccaccctgaacatattccatttttctaccacaaaaataaccactatcccgaagttagcgttaatggtgacattgcttttcactcaaaatatttttccatctacatatttatcctcaaataacacattacttagatttgcctgtttccataatgaaattgaattatactgtaccatggatattttattactgatttcttttgctcaacattatgtgtttgagattcatccatgttagtacatatacctataattcattttcactggatataatatcccattgtatgactacattagaatgtttgtttattccattattgatggacatttgggttatttctaggcttttgctattacaaataatatggctataaatgactttgtacttatctcttgatacatattgtgaaaaagtccccagagtattttctttatttttatttatttatttattttttgacagagtctcactctgtcacccaggctggagtgcagtggcacaatctcagctcactgcaacctcggcctcccgggttcaagcaattctcctgcctcagcctccctagtggctgggattacaagcaccctccaccacgctcagctgatttttatatttttagtaaagacggggtttcaccatgttggccaggctggtctcagactcctgacctcaggtgatctgcccgtctcggcctcctgaagtgctgggattacaggtgtgagtacccagagtattttcttaatagtgttattgctgaacttgttctaatgttacttagtactgccagccagttttccagagcatttgtactggtttatactgctactaatagcaactgggattaaccgactttgcaattttagccaatttatcaggtgtaaaatggtatctcattggggttttaatttgcatttccatagtttccaagcagattgaacatcttttcctgtgtttatgggccatctgtgtttcttcctttgttaaattcctgttcatttatcttgcctattttttctgttgggttgactttttcttattgactcataggagttctttgtgtattctgaatactaatcctttgttgtttgtatggattgtaaatattttcttttttcaattcactttatgtagccctttgatgagcttttaattttaaagtagttaaatttatgtgttttcatcttttggttcttgataaagaaattcttcactttcccaaggttagaatgatattcttttatgttatcttctaagaatgttatagttttgcatttcacattttggcttttaatccttctgaaattttcatttttctttctttttttttttttagtatagtgtaatgtgtctagttttttgttttttgttttttaaatagatacccagctacccctttattaaaaactccaccctttcctcattgatctgtcatctttcatcccttcctcacctctgtcatgtttcaagtgttcataggtgtgtgtacctctgtctctagactctgcactggtatatgtgttgatccctatgctaataccacactgcctcaattattattgctctctaaatgttaatatcttgataatccacgtctccatgttttaaagaacatcttggccccatgccattctatgtaaattttagaatcaacttgttaagttctacccctctgctccaaaaaaaagacagagagaaaataatttattgagattttcatatgaatttactttgaatccataggtcagtttggggagaactgacatttttacaatattgagctggcatctgtctatacaactggcatactataataactgcacatttttaattactattttttttcactatgttgctcaagctggtgtcaaactcctggccttaagcgatcctcccacctctcaaatctctgggattataagtgcgagcctccatgcccagccatgtctttgtttttaaataaagttttataattttctgcctatggaacttgctgtattttgatagatttattttcaggactttgtatcttttaagtgtttataaataaaatctttaaaaattgttttcatttggaatatacaaagacaattttattattattattattttttgagacagggtctcactttgttgcccacactggagtgcagtggcaggatcatggctcactgcagcctcgacttccctcagatcaggtgatcctcccacctcagcctcctaagtatgttacttagtactgggactatactgttactaagtagctgggactataggcacgtcccaccacgcctagctaatttttctttttcttttttttttttttttttcttgtagaggcggggtttcaccatgttgcccaggctggtctctactcctgggctcaagggatctgcccgccctggctcacgcctgctaggattacaggcgtgagccaccctgcctggccacaaaggcagttttaaagtagattttgtgtgctgcatcctcattaaactctcttattctaataataaattattagattccttagaacattctgtacacacaaatcacctgcaaagggttttattttgttttttccaactcagatgttttcttttttgtcttgttttgctggataggccttggagtatgatagaagtagtagtagtgttaccagtggcaaatatccaagtttcacagcatcaaatgtgttaccggtagaaggtatttgagtcactggcggcaaatatatacgggtctgcagcaacttcaattcttgcctcctcagaagaaagaattcgactgaggggcataaggcagcagaagagaccaaggcaagtttcagagcatgggtggaagtttacttacaaaggctttagaacaggaaagaaaggaaagtacacttagaagagtcccaagcaggcaccgaggtcaagtgcagtgtttaaccttgatcctgggactttataggctggcccctttcccatgattcttcccttgaggtgggctgcccacatgtgtagtgccctccttacccttgggaggtgagcaggcgcagtgtgtttaggaagttgtagacatgcccatctgaggttttcttcccttttctggtggtgtgcccccagaaggtcatattccgccattttgtctcttaatgcacatgctcaagaaattacttctccctggtccctgccttcaattaacactttagcacaacaggtgtggaccattaggaaatggcctttccctgaagccggctgccaatttatcacttaggcaatatgaaaactgccagaccatcacccgacattcctagtgggcaagggaagagccctctgccctgctcatgcctgtctacctattgtaacagtaactggcccccttatcttcttcttaatcttaaaggaaatgcttttaatttttcaccataaactatgatgtttatttattttaatgcttattctttatcaagttaaagaaacttgtattcctatgccaagattgccccccctcccccacgcctccccccccaccccccccccacccccccccgcttctttgtgagacggggtctcactttgttccccaggcaggagtgtagtggtgtgacgtgggctcactgcggcctcaaccttctgggttcaagcagtccttcccctctcagcccaagttgctgggactacaggtgtgcaccatcacgcctggctgattttggtatttttggtagagatggggtttcatcatgttgcccaggctcatctcaaactccagagctcaaataatccacctgcctcagcctcccaaaatgctaggattacaggtgtgagccagcacacccagtccttatgccaagaatttttatcataagtggatattgtatttgtctaagagttttatgcatcttttgagatttctatatgattccaccccgccctttattgaacttggtgaatcttattaattgatttttttttttttttttttttgagacagagtctcactctgtcttcaggctggagtgcaatggcgctatctcggctcattgcaacctccgcttcctgggttcaagcaatccccctgcctcagcctcctgaatagctgggactacaggcgcacatcactacacccagctaatttttgtatttttagtagagatggggtttcaccgtgttggccaggatggtctcgatctcttgacctcgtgatctgcctgtctcgaccttccaaagtgctgggattacaggcatgagccaccgcatctggcctaattgatcttttttcttttctttttttttttttttttttttttgagacggtgtttcgctcttgttgcccaggcaggagtgcagtggcgcgatctcggctcactgcaacctctgcttcccaggttcaagtgattctcctgcctcagactccctagatctaccttagccataatattttatattagtagattaggtttgctattattatttagtattttttcatatatgtttatgaatgaaactggcttgtatttatatttttcacactttatcaggttatggtatcgaggttatgctggtctcataaaatgagttagaagtgtttctggttttgttgttctctggaaacgtttgtggaggattagaattatttgttccttgaatttttggaagcacttgggtaaaatcaacaaggctttttattctcttgggaagatttttacttacctactaattcagtttccttaaatgctgtgggactctatggattttctatttcttcttgagtcagtcttgataaattatattttctatagagttattcatttttaagttttaattgtattgacatgaaacgcttcacaatatattcttaatctttttattatctgcagcttttttttttttttttttttttttttttggagacaggttctgactgtgctgctcaggctggtcttgaactcctggcctcaagtaattcttctgcttcagcctgtctagagtgctgggatacaggcttgagctactgcacctgacctgcagcagtttttgataggcctttttgttacacttaaattgtttgtttgctccttctctcttattttcttgttccatcttaccagaagtttatacgttacaaagtgacaagattcttttgaaagaaccaagttggtgtttctattatgtggaagttttttttaatggtattcattattggtcttacctttattattacctttccctctattttctttggatttatttatttctcagtgctcttatccttatcttctctgtaccatttaatagtattaaaccactccatccttgtagctttctcatccctggctcctgaaacacactagactttttttaaaaaaaaaaaactatttttgttttagatgtagggggtaaacgcacaggtttgttacatgggtatatcgcctgatgctgaggtttgggattctaatgattctgtcacccaagtagcaaacctagtaccgtaggtagtttttcagcccttgccttctccttcccttcccccttttggaatccctagtttctgtttctgtctttgtgtcttatgtgtttaactcccacttaaatgtgagaatatgtggtatttggttttctgttcctgtgttaattcacttaggaaaatggcctccagctgcatccgtattactgcatggattttgttctgtttatggctgcatagtattccacggtgcatatgtaccatattttctttatctaatccactgttttgggcacttgggttgattccatgtctctgctgttgtgaatagtgctgtgataaacatgcaaatgcaggtgtcttttgggtagaacgatttatttttctttgggtatatatccagtaatgggattgctaggttgaatggtaattctgtttttagttctttgagaaattgccaaactgctttccacagggactgaactaatttgcattcctaccaacagtgtgtacgtggttttttttttttcagctttgtcaacatttgtgggtttgttttttttttttttactttttaataatagtctgcctagtgtgagatggtatctcattgttattttgatttgtatttctgatgattagtgatgttgagcattttttcatgtttgttgacttgcttgtatgtcttcttttgagacgtgtctgtctttgcctgctttttaatgaagttttttttcttgttgatttaagttccttatagattttggatattagtccttttttggatgcacagtttgctaatattttctcctattctgtaggttgtttattctgttgatagtttcttttgatagttggttttggccctcagtgtacctatctcctcagtcctgtctctttagtttaattaaatccaagttgtctgtttttatttttgttgcgtttgcttttgagtacttagtcataaattctttgcttaggccaatgtttacaagagtatctcctaggttttcttctggggtttttacagtttgtggtcttacatggaagtatttaatccatcttgagttaatttttgtatatagtgagacgtagcggtccagtttcattcttctgcatatggtcagccagttttcccagcaccgttatagggtgcctgttccccattgtttatttttcttgactgtgtcaaagatcagttgggtgtaggtgtggggctttattttagaggtctctactctgttatattggtctgtgtatctatttttgtaccagtaccatgctgtttcattaagtagccttgtagtatagcttgaagtcaggtaatgtgatgcttctggctttattcttttttgtttaggattgccttggctattcaggctctttttggttctatatgaattttagaatagtttttttctaattatgtaaaaaaaatgatgttggtaatttgataagactagtgttgaatctgtagattgctttgggcagtatagacattttaaaggtattgatttttccaaccctcgctcatggaattattttctatttgtttgtgtcgtctgtgatttcttttaacagtgttttatagtactcatagatatctttcacctccttgattagatgtattcctagctgtttttattttattttattttattttttatttttttcaattttgtggctaccgtaaatgggattgtattcttgatttggttttcaacttgaacgttattcatgtataggaatgctactgatttttgtacattgatttcgtatcctgagtctgctgaagtggtttatcaggtctaggagtctttgagcagaatctttatataattttacttctgcttttcctatttagatgctgtttatttgtttctcttgcctgattgctctggcaaggactttcagtactatgttgaatagcagtggtgagagtggacatccttgccttgttcttaggggaaatgctttcaacttttgactgttccatatgatattggctatgagtttatcatagatggctcttattattttgaggtatgttccttcaatgcctagtttattaggagtttttattataaagggatgttagattttattgaatgcttttttctggttctattgtgatgatcatatggtttttgttttaattctgtttgtgtagttaatcacgtactgatttgtatatgttgaaccacccttacatcccagaaataaagcccacttgatcatggggaattgactttttgatgtgctgctggatttggattactaatattttttgaggattttcgcatctatgttcatctggatgttggcctgtagtttcctttttttgttgtatcattgccagatttaggtatcaagatgatgctgctttcatagaagaagttagggaggagttcctcctacttgatttttgggggatagtttcagtagaattggtacgagctcttccttgtacggctggtaaaatttggctgtgaatctatctggtccagggattttttggttaagtttttcattactgatttcgtttaattactcattattgatctgttcaggatttctgtaaacacactaatcttgaatggttttttttctacttttccaactgctccttctgtttctctgtgtcttcatgtctcctaatgtaggtgctcctattatgtctcctaatgtagggtgctccttttctcccaggcacacaaaaccaagtgctatttggttttggcccgcaatgtacctacctccacatttctagctcatacttaacttccagttggggtatgtgtgtgtgtatctgtttctctctcctttccttgtagtccaatttaggtctttatgttttacaagaatgatttccatgtaataactactttcttctacttctcacctcccagtggagcctcagttgccacagtaaaagaggttaacctaccttagcaccttaaattcctctatttatctgagtagttgtctaagagtattctttttaccttactacctttgaatactgttttgtattctgttatgaggtggttagtccagtgtggccacaataggtgacataagaaaagctcaggaaaacaaagtttattatactcacaggtcctagagacaggaggcacagcacaccatgcagggtcacatggggaagacaccagagtggtgaggaggcagaatataggagtgagtggaaggtttaggccactacctttgctggagtttctaaaggggaatagttaggccatcacctttttgcagtggcatgatcgtagctggttgcagcctcgagctcctaggctcaaaggatccttcctgcctcagcctctgagtagctggaattagaggggaaagctacccactggctctaggccactacttttgttggggtttctgtgggaaagtcaggacagagtaaacagtttaggattggctaatttgaataattttagagggctttgggaccacctaggggtcgtctctagttgcccagtacctggccctaggatgaaggcagaatattgcctgtagagtctgattgaggaagtatagctctagattggttagtttgtgtatcaaagacatgctcctgactgggccctttgctgtctccaagaattgactaaacctgggaggggcagtctctccccagccagaaaggtttttatgatgtcaaaatatcataatacattaaaaatgtaagaacattttacaatacagagaccatgccttcagctcctcctcccccccaaggcagaaccagggcacttaaatactattaccagtagaccattgtaccagggatactagacatcaatgtctctgttacttagtgctttgtgacttataagaagctttgatagcatttttatggcaacttgaaagtggaaccagtatatagaattttcacaaactccatgagagtggaatatttggttctggaagacctcctattagtagtgtgttaatcttttaagtgcttgtctcggtttttcaaaatctcatattcttttagtcttgttgatttatttaatatatcttgagcatgtttctctaatggtgaacagtctctttttcctccagttttattgaggtatgattgacaaaataatataatgctgtactatcttaaaatctccacaaagggactgatatcctgcatagagatagagataacaactaatgacaaaacgcatgactttaaaatagtgaaacttctacatgtggcttatggaagtgactacttacttgactagaatgtctcgttgtggaaaaaaataaaaaataaaggaggtgattctaattacattttattttcacgcaagttttcaattacttgacacaagcatgcattcttaattttactaactgtatatgtctaagtagttctgtagttttctatttgtggaagactttaggaaaaaatagaagcgattttatgatttttagaaagtgaaatattcatacatatcttttataattatctcaaggaaacaaatagggctctgcttcatgttctatacctaattattcattcttatttaagtaatacatctgccagaaattaggatgtgtatattggcagacgttagcactgtcttacaaacactgctgtaaggttctaactttgtgctcttctgactggtttgctctggatgtgtgtgcacatgtaagtgtaaggatgggaagaatgggatgtttgagtggtaggaaatggaagtgtagaaccatatccatggtctagacaattcttagagattcctgtggcctattatattttattcagtacataatgttctggctttttaaaataataactggatatagtaatttgaaaacaatgtattataatcccttagaaaatatttctgggtgttagggtggcatgtctttccataaattagccctattctaatatcagatcacagcagaagtggttaaaaagctcttgcatggctcacgcctgtaatcccagcactttgggaggccgaggcgggcggatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagctccgtctcaaaaaaaaaaaaaaaaagctcttgcataacatttttttttctttctttctttcttttttttttttttgagacaagttttagctctattacccaggctggagtgcagtggcgtgatctcggctcactgcaacctccacctcctgggctcaagccattctccctcagcctctggagtagctgggacttcaggcgcacaccaccacacacctggccgattttttatagagacagggtttcaccatgctgcccaagctgacctcgaactcatgagctcaagccatctacccaccttggcctcccaaagtgctgggtttacaggcataagccattacacccagcctcgcataacattttgaaaaatataattacagcagggcccttgctaatgagatacatgcagcaatctgttgtttaggattaaaggaattagtacagctattgttttctttatgcttatcatggagaaggttgctttttgccatcagattgctattcattaaagtgttcagagttaataataagtctttcttgctcttggcaaagtcgccagtgaatttcttctgtctaagccacatatcaagtaagctgaaaaatagaagagagcctcagggtgtctttgaactctgttcctgtgctagctgctccagttgctgcattcacatctgaattttcacataccatcttatgattgtaatttattatttatatttttgtttctgtttcttaagctttatcagtgtttgtgtacttgtcatgcagtcctgcttttagaagataaaccagtttactgtttcctttcttttgaatcccttctccttggaggtacttagaaaagtacttatgcaaaataggtgcctgatgaatgttggtaactgaaatctagtgctttatttcatttatttcttttaatagttgaaattattttgcttgctttctaggcacacaaaccaatggtctggactttcagaagcagcctgtgcctgtaggaggagcaatctcaacagcccaggcgcaggctttccttggacatctccatcaggtaggaatgttctgctcaaccatcagtgagagtgaaagatagaggcgtaaagtactggggcctgaggaagttatttcagaatgtgggaccttttaaattatttaaagcctagtgctaattgtgtaattgtgtcattctatttggttagtatgaaatcctatggtttagttgagtgtatagtcattgaccccacaggtgtgtgggaaacaaaagaattccttgttgtgaatggaatgtgtataacaactggtttattgtttttataagtgggtatctgtggtggctatctgatggtagcaaattatcaaaatcatccagaaagatgtagctaccattgcctgagacctgctgtgtaaggctctgagctccaagctcatttctgtcctctaaaacagttccagaccatgacagttgatttgggcaactactcagaggcttttgcttgactgtgacccccgcaccctagtttgaggttcaaaagactctgcctcaactttattaccctatgtcacaacatttttttccctgggtctaaaacagaccatgaattctgttcattcatgctttagctataatgtagagggaatgggaataaaaaaacaaacactggctactcaatagttttggaatatggaagctggttgaaaatggaaaacagtgaaaacagttgggagctagattatcagagtgtctcaacctcttgacttatgttcacaattatatattagaccaatattttggtggtctatatgtgttgatagtaatggtgctagtgatggtgcctaatgatggtagtggtagtgattcagtgaaaaacccatatgtacataagacaggttacatattaatatactgagttactgagcactgaatatatacatcttactaaagtcttttcatcaaaatatgtcatcagaccacctaaactataaaagaaattcttctacttgaaaacaggtaaaatcctggaagctgttctaaagcccatttatttgttcacagactcaaatggatatcatgtaggcagcagttattatctgttacagtgaggcctaatggaacacttttgctcaggcacatagcttcgtttatatctttgaaatggaaaaactttgacattaacttccagataaaatattaaaatgaattaacatctaaaatgaattttaaaatatattttaaatatatcctagaagaaaaaaatgttttcatgttgattttttttctaagaacatattcaagcctccagtaatttttctgggttcctaagaggaatagcatttttgacagaatttagtcaattatttgtcacctagtaagcatctttatctggcttaaatatgtgatggtccaaatgtattaaaaaatcactgagggtgcacagatgatgtgcagttttctctgcaggatccttctggatccaaattccaagatgattgcaactctccctgtaccagctccaagacctctagatctagccactgattaccaaaatcacagacccttcaataccacccagaccaaaggactgcaaacaaaagaattttatttgaaattgcgacaccattgaatctcccatcaagacacaagtccttgcatctgattagctacataattaacagtgtgacacttgccttctatttccaagccccttattgacagaattagcaccttgaacctttccttaccataattataatatacatacacaaaatcgatggctttaggtctgttgccccattaactataagttccatgaaaatggaaaccttttgttgtttacctgtgtcccagcatttaccaaagaaccccataatacaataggtgttcagtaattatttgttgaataaagtcatagatgactaaatggtcaagtatgagactactgaggaagaaatgattagcttaccctgtacaatctaagacatttctctcagggtgatttttgagctgagtcttgaggggtgttggaaactagctaaatggagttggtaaaggaatgctctcttctttttatttttaacttcctattttaaaaaaactttcaaatttgtaagagttacaacaatagaacagtgttcatctgaaagcccttcacctagaatcaccagttgttactattttaccatatttgctttataccatatgtgtatatgtatgtatgtacacatacaaaatacattttgcttttaccatatgtgtatatgtatgtatgtacacgtacaaattttttttttttgaaatgaggtcttattatgttgcccaggttgatctgcaactcctgagctcaagggatcttcttgccttgcatctaactgtgattataggcgtacaccatggcaccgagccaaaaaaaattgttttttgctaacccctttgaaagttgcagacattataaccatttacttctaaatacttcagcatgtttttcctaaaaacagcattctcttataaaactgcagtgcaaatttcaaattccagaaatttaacattgatacgatatcattttccaatattggcccatatttatatacttcctgcccacaatccagtccatactttgcgtttagctgtcatgtctgttaagtcttcttcaatccagaacaattcctcagcatgtctttgtctttcatgatattggcatttttgaagaatagaggccagctgtttgatagaatgcccatttaacttgaatatgattgttccctcaacggctgaacccaagttatgcatttttgaaaggaatacagcagaaatgatgctgagtccctctcggtgcattcagaagccgtatcatattgctttgtcccattattgtgatattaagtttgattattttattaaggtagtgtttattagatttgtccactgtaaatatgtctttttgcctcctggtaagtaatactctgtgaggcagtactttaaagactgtgtaaatatcccattcctcaacagacttttaccctgaaacgtaataagtaaaaatcacataaaatttttatcttcttcaaatctttgtacctgaagttctttccttgggctctttgacttcttagcctttaggccttaaacatattatctgttcagataggcctctcctgattacactgtattttaaatgtgttctacatatgtcttcagattttggttttttgtttttgtgtttgagggttctcatctactaacaggactagcagtttcaaataaaggacatagtagtcaattcattttagctcttaactcttcactgagctccataccaacatttatatttaatctcaggacatcttgatgctatctggtgtatacaaaatggaactcattatcttctctgtccctgttagtggtactaccattttccagttgcccagatttgaaccctggaataatgcatgactctctttttttaatctaaatccagtcaggatccttatgtagtgcattgcagagactttcatgtttcctactttttattcccactgccaccattctagtttagttttccatttattctagcctagtttatagtctctttctccctcctcagtctttctttgtttcaggacattgactgttttgaacagtgtacactggttattttgtagtgtttctcagtttgggtttgtctgattttcatcatgattagattcagattctacacttttgttagggatgcagcataagcaatgctgtattcctctcagtgcatcttagcagaaggcctgtgtctccttcctggtgactcttgtttgtgctcacttgattatttgtctgccaggtttctccactgaaaagatactattttaccctttgtgagtatcaagtatcattggagacatagctgagaatatgtaaatatcctgttactcctcagatttctcacccattagttatccattgatgactctgcctaaatcatagttattatcatagttgccaaatgatggtcttaattccatgtgtatccttattttcacataaccatgatttgaactttctgaatgtatgaaatgtattaaatgttttgacagacttttatgtgtggtttatagggtagattttctatttcagctaagagttttaagttatgattataaatgttttaaggacttggctgtgtgggtgtgtaaatatatttctactctggtgtatacatggaacattcaaaattaaaataagtagatggttctgattgtttctaataataaagaatgtatatagatagcttatatgttctttaacacaatgtggaaggttaattaaatttttagaatcttaagcattctgtgaatacaaacaatgttatgtaaggagcattcaatacaagtgtggcatggctgataatgttcatttagtgtgggaaaacatcttcaaaaaaagattaacagcatttttctgtgggacccgttggggtggggtagggtgggttgagaagggactgagcttgttcataaagttttaactccgtaagacaaacttctttgtcttctcagttctagctcggtgacacatagtagactttatttagtgatgacaaccccttgtgatgaatgtcaacagtattaaactagaacttcccctgattacttataggtccaactcgctggaacaagtttacaggctgctgctcagtctttaaatgtacaggtaagctgggacctgggattatgggtcaatcttttatttattttttcttatatttttctgtagtgagcatatattttataataggaaatgcttagaagtattaccttttcaaaattagtgaatctcgtgaagattcaaataatgataattattaccattaatgaaaatcagttttatattatgctactgtgcatgaaccaaaaatggacaggaaaagtctactttcaaagttgtatgtgtaagttcagtaaaaatgtttctaagttatactgctataacacatacctaaacacacagcctgaaagttctcttaaatgccagtttgtttccaaaagacttgttatttatcatttttgatgtcttagggagaccttatagggaagaggaaagaacactggactgagacacaagggtcttaggtttgcattctcattctgccactgactagctgtgtgacctttggcaagtcacataacctccttgggttcagtttttctcatctgtacttaagtggggacatttataagattgccagggttcctctccatcctaaaatgttaggcttctaataattgtaattaaacctgtttgtagatgttggtggatagacaatcaaaatcttaaaacttaaatctggccactttccttctttgaaccatatggcacaacatgcaaagttcaagtgttagacattgccctcttaatatttctatcaacctgctggttcctttcattatagtgtttaggtaactagcagtcaagagggaaagacagtattatggaagattgatttcagtgttgctaatgactaaagaccttgggttgagcatttcatgaaacccagttgaatatggacctagtaacacgtaggaacaaggagagaaaagaaaaagagataatgtgaccttactttctgagggagaggaggcggaaaattgccttggttgccatggtaaactttcatcccttagagagatgttggcaaacaggctgtatctccagtgcagaatgtttacagtcctgcactgtaattatctctcaatgactggcagaattaatcagagcatttatgttaattagccttgctgcagtccccaaaacaggtggtgagaaatatgcaaatctatgcagaattttaatgctttgcataaccagttttaattaccgtaaaattttctcttcgtgcccctctctcttgactgcagcattttctctctgagcttgtgtgttagttgatgggagttgctagatttaccgttctgtaaaatattaggtggaaagttctgtggatcaagtgatcattctctgagatggtatatggagaagtttcagactgaccaccaggtgtatgttaaaatattggtttggaaggtctaatgtagaggtgaattgaaaatatattcttccctttaccccctatttctagagttgaggaattgggggctatgaaaaaaatctataaatttgtgggggatgactttatttttaaaaattgtaatagcagctttgctggcattagaattaacaagtttaaaaacttggtatgtgaaactaggaaaatacaaataaaagaaaggaggtaaaccagaactcatgactgaataagctcatgttttaaatgattcctaaaagatggggttttaagtacatttcttttaatcaaccatttgcaatcttttatttcctacccaccccacctcagtctaaatctaatgaagaatcgggggattcgcagcagccaagccagccttcccagcagccttcagtgcaggcagccattccccagacccagcttatgctagctggaggacagataactggggtaagtgttcactgagagaattataacaaactttttctgtgtcagaactgccattggccaatagctgattagaattgttcaccatagctggtagtaacatggctatgcctggcactattgtgtctttaaggaacttcctacactgtaggtagtaagttgctctgaaaaaggaattatctttgtcgtaagttttcaggatatcttttattagaattgtggatgctctggataaattaaaaaccttattaaacccctgtttcaggtgttgcttcatcatgcaatggagtaattatcatatggttgagatcattacactgaaaatggcagttatccatttggcattaagacatcactgcagggtagaagttaaagaatggattagtacctgcaaaagaaaaacatttttctttaagttactgtgtaatgatctaaaataaagcatgtggcttcatatcctagctctgcaacttaccgtatggcctaattacttcatttccctctacctgttttccttctgttaaatggagatactaataatacctatctcacattactgttgtaaagattggagataatacatgtaaaacttatagaacggtgcttggcatgtagcattcaacaaatattgtttatttttgtacttgatcttagccaaaaggctgagacgttctgtcatttattttttatggttaataaattggcctgtttggctatattaagcttttaagttttcagctgtcttttctctaaggcaccattcaaaatatttttccaatgttgaaaatttgtgtattaaattatctttgtgggggttggtttagggcaatggtaaggaatagtttttattcaattcacatcacattaactcccaagaatttcctagggttttttgttttctttctttctttctttttttcccagttaagtgtgttttgtcagtggacaactgttttaagaactgttgcaaaattgttcacaaaatcccatgagtagagatgtatgtatatatatattatgtaaaaattaaaaatatatctatactttatatacacacatatcccttgaagggtattgagtttttgaatggtttggttttgagccttatgtttctaatgcacaaattgtgtttgattcttttagaggaggttgtggcactaagtgactgtacatatacttcagaaaattatggttccatcttgtttgatcaatcagaacttgtcaccaaaagaaaagtagaacacatttactactttaagtgtgtttgaaataagttgcattatgaaaacaactttaaatatgctctaaatacatttcctactttactatttgggtcttgtttttggtgactagtgtctacaatagtaagagggagttgggattctaggttcctttggctggagcttctgttaaacctgggcattagggttcatttgcatgtaaagagaacggctatcaccacctgtttcatagagataatgtgttggaaaggagatgtaaagttgcagagactcagtgctttcaataacagaaaagattgtgttagggaggggcctgtagggagacttggaaaagaaacaaatggagctcatattctttagtcatatctttggacttaatggaaatgatggaatatggcagggattcatgctaatgggaagcagctgggccttatcagttctttccttggttatatccagcatccttgttcctcattcatctgactaatcacttgctgtttggttgtgtgtaaatgtattttcatatcttgtcagtggtgattcttttttttttttcttgcttactagttaattacttttttgcccaaaccctagggccctggacaagcttgaatgattaagtccatagtggggaccaccattttaatttaaatgttctgctagtaatggtagtttgatcactgatgaacattttagctgtctgctaagcaagtgaagttgggtagctggggactgatatcatttgagttacctattttaaagcagttggcttgcattaggagactttctccttcaacactttcccataatgtgttctggttttgtttagcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggtgagtgaggaactccaatagctggggcagcaagtgaggaataaagtggcaggttttatttaatgttagattaactttttgattgttagtgtggggccttaactgcctgaggagctctagatcagtgaggtaagcggtacccttccttaccactgaattagaaataatgtttgtttgcttattgtagttgatattgtaaacatatagctgattatttgaataactgactttatattaagtgacaattcttgaataattagctggcatatttttgaagcaggggattactgtatttattttaattagctaattacagcagacatggattttttttcatgtgctctgcggtgaatgttgccacccatgtgtgagacagtgagtcatctctgctatggagtgattaacattattgcattagaatgttgtttggtttcaattttcacattttagggcaaagtatctagagataataaaaatttatttaagaagcgccaggcgcggtggctcacgcctgtaatcccagcactttgggaggccgaggcgggcggatcactaggtcaggagttcgagaccatactggctaacacggtgaaaccccatctctactaaaaatacaaaaaattagccaggtgtggtggcaggtgcctgtaatcccagctacgcgggaggttgaggcaggagaatagcgtgaacccaggaggtggagcttgcagtgagccgagatcgcgccactaaaaaaaaaaaaaattaagaagcatacacaatagtaccaaggaggaaaataaataaaatctttaatctcaagaagaggaaaaaggtataagtagatatatcagtaaaatatatgaagagttattatgagtctaattgttagacagctgtctttatccgtctcagaaaagactcagaaatggacttaacttgtagcaagagtttgactaaccatttaaaaagaactaattaactgtaagagtagagaataaatatcagactagtctttatacaatctttatcaagataatgttttgattttggccactttctcatcaccaaataaatgtttttagtgcctaagctgtgagaccctatattaacattagtctaaataagataacgttcatgaaaacactttgaaaattataaaacagtaggccaatgtaaggtgctattgttgttagggattaaatttttatatggatagctatttttggttttaaaaaattgaatactttagaacatgtggaaaagggcaaaaaaattgaatactgatttttcagttgagttagataagctgttgtcaaatgtcataagtcattataggccctttattgatggaaattcagacataacacgatcaatttttatttaagagaaagatcaatcaaatatttaaaaactgttttctcacttgatttttaaaacccatattggtctttacatgataaaaaacagaagtatatttgttctgagggaattttaaagaaacattgaaaattaggcttatcataacaatatatgtcagtccacaaaaatagtcagttgcagaggctccaggttgcttcacgtgctttgtcaagcacacacagagcataccctgtttggaatatgaaagcatgcgaagtatttactcttctttatttggatgtgacagaagtcatcagctggaagccttataattaagcgaacttttatttcagaatctccaatccatgttttaattccaatttttcaggatcttcaacaactgcaacagcttcaacagcagaatctcaacctgcaacagtttgtgttggtgcatccaaccaccaatttgcagccagcgcagtttatcatctcacagacgccccagggccagcagggtgagctcctccttagagcttattagtggtataccaaggctgttcgctgaatgttacacatgcatgaactactatcattttggccctgaaactattagaccaatgtttttattaaattttatttgattataaactttcgtttaaaaaaagttttgttttgttttttgtcataaataccacattattgaaggttgccctgaactgccattcatctgcttaatcactaaggaagaaccaagagtttggccaaaagtctaagtgaaattattcaacatgccaaacataaattggataagttgctgctagtgttttgattgtttttcatggaagtgtattcaaagaatatagactgagtgttgaaagtatgtgcttctaaccattgtttttttaatttaaggagggaagactgctataatagaaactacaaatttcgtgagttataaaaaacatctttgagtcatttgagtggtaaatgttatataattaatatatcaaacaaccactcgtctgtaaggtcagttaatgtaatcagggtgaagaatgtcagagtatcaaggcttcaacccaaggaacattagtgcatcactaatgattctttattatttctgagtgggtttttttgccttttttcttcttgatcattcattccaaaatcttttgtcatgaaataattattctagcatatattcaagattcagagataagtaattcagtatttacttgcagagggctcacaatttagtggcagggaaacagacctaaattatgttagatttgatatgcacacaatgctatgggaaccaagcaaagagacccctgtaactttgtgctcagataagtcttcacagtgaatttgggaaaatacattcataggcttacaaaagagagaatgtcagtcttggaaaatgaacagcatttgcaaaccttagaaacatggaagaaaaatcaataagctgtgtttgagaactataagtagtgccttacaactgcagaataagtttgcatatgcaggtaatagtgaaatttgaacccagaaagattagcagagaccagatcattaaagaaccttagattaagtttccaggagtttgaccttaaatcctatagcttagtgcttcctaagatttgatttatttaagagtcattaatggccaggcgtggtggctgacgcctgtaatcccagcactttgtgaggccgaggcaggcagatcacgaggtcaggagatcgagaccatcctagctaacacagtgaaaccccatctctactaaaaatacaaaaaaaatagccaggcgtggtggcaggcgcctgtagtcccagctactcaggaggctgaggcaggagaatggtgtgaactgggaaggcagagcttgcagtgagccaagattgaaccactgcactccagcctgggtgacagagtgagactccgtctaaaaaataaaaaaattaaaaaatcacttgaggaattagaaaagtttcctgagccctaaccccaacctcccaattactttttttcttatttttaaactattaggttcagggttacactcaggtttgttatgtagataaactacatgtcatagggatttgatgtacagataatttcatcacccaggtaataggcataatacctgataggtagttttttcgattctcatcctcctcccaccctctaccctcaagtaggccctggtggctgttgttcccttctttgtgtacatatgtactgaaagttttatggctgtatagtattccgttgtgtatatgcaccacattttttttaatccagtctagtgttgatggatatttaggttgattccatgtctttgctattgtgaatagtgctgcaattaacatacgcatgggtatgtgtctttatggcagaaaaatttatattcttttgggtatatacccaataatgggattgctgtatcaaatggcaattctaagttctttgagaaatcgccaaactgctttccgcaatggcttaactaatttacattcccaccagcagtgtataagtgttcccttttctccacaacctcgccagcatctgttattttttgagtttttttgttctttgttttttgggattttaagagatggagtttcactcttgttgcccaggctggagtgcaatggcacgatctcggcccaccgcaacctccgcctcccaggttcaagcaattctcctgcctcggcctcccaagtagctgggattacaggcatgcgccaccatgcccagctaatttttttttttttttttttttgagacatagtttcactcttgttgcccaggctggagtgcagcagcacaatttcagctcactgcaacctctacctcctgtgttcaagcgattctcctgtctcagcctcctgagtagctgggattataggcgcccgccactatgctgggctaatttttggtttttagtagagatgaggtttcactatgttggccaggctggtctcaaactcctgatctcgggtgatccgcccacctcggcctcccagagtgctgggattacaggcgttagccactgcatcaggcctttttgtttttttgtgtttttttgagatggaataaataggaaatggattcacaggctcctcgttcttgctctatttgtttgtttgtttttgagatggagttaaatggcatgatcttggctcactgcaacctctgcctcgcgagttcaagcgattatcctgactcagcctcccaaggagctgggattacaggcatgcgccaccacacccagctaattttgactttttttttttttttgagacagagtcttgctctgtcacccaggctggagtgcagtggcacaatcatggctcactgcagtcccagcctcttgggatcaagcagtcctcccaccttagccttcaaagcagctgggagtacagtgtgtactacctcacctggctaattgagaaaaaaaaaaaagttttttatagagacatgtcttgctgtggttgcgcaggctggtcttgaactcctgggttcaagcgatcctcttgcatcagcctcccaaagtgctgggattataggcatgagccactgtatctggactcacttagaggagtctaatgtgaatggcccaatatcttccaataagaaagtcttctgtcaactctactaaaccacagatttaatcagaaaagtggcatttccaagtttttatttaataaagttcatgttgaaacttgggtagggaaaattggtaaataagtaggtagatggacaggacctggtggccagttatatttgattaatgataggaaagaggtatctaggtataatgcctgggtttttaggaaactacgagggttgatagggtcagagaaaatatatatgtagtgttagaagaaccttggtgaaaccaaccttttaggtgtaaaggattaagtagattcaaaagatactgcattttcagaagtcaaaaactagtggagagtggtaatcgcaatggaagaaaatgccaagagggaaggagaaagtgacctagatcagaaagacttaggaaggtcaatgcaaagtgtgtttattagatttgttaattgccaaagccttaagatagaatgagattgccttcattcactttcagcaaagccaagggcgttgtctttcccttttcatatctgggacctcattttatttcaattttatttgtctcaaatcaagatagtaggaataatgaattactgttcattctgattttttggtacttgcaaaagtatgtgtatgtttttaaacactcccccaacttccagacttttataagattgggaaaatagcacagataatgtaatactgattggccttagagccagtgaccctggacaactcacctaacctttctgagtttcccatatttccctttttatcttccccttcacttacatgggtgaattacaaaaaaagttttactaccctaacatcaggaaggtcattataatgtagtagcaaagagcatagactctaaagccaaactgtctctttgtgaatcttggctctgccacttacctgtgtgtcctggggaaagttaactttatgggcccctgtttcctcaactgtgatattaggatactttcagtgttcacctctaagagttgtagggagtcaacgagtaaacacatgtaaggcaccttttagaaagctgcctcctacatagtaacctttctaaatctttgctgctgttatcattatgacattatcatgataccagtatcatcctcagtcaacaaacgatagataactcagagaatgaaaaggttgttcctttatatagtttccctagaatcaccttgtaccactgctgctgagttgcaatcattcgttagtcgtatgtgacctagattccattttctaagattattcaacaatgtagaggatcagcgtagtggaaatacgtctataaacatttctaagaattgaattcattgtaattaatagcatcagagaagctgaaaatccaaagagctaatctcttaacttcatgatggaggacaaagattttatcttttggaattttaataatgtttccagcatgagattagccttcaatattgatttctggaattctgttttcccttgtttttcattgattaacctaaaacttttgagatgtagttcatatttttggtaatattgctatgattatataactgtaactgtctagaatttaatttctagcaagggaaatttaagccttttcctcagaattatttttcatgggaaaattcttactgatagattactggacttgagtcataatttattggttatcttattctgccctatctactctcagcactaattataaaaataatcaaagaaatgtttttggttagaaaactgttgttcatttgagttttgtttgggttttcattgtttaggtaagggaaagtggcaagcgttttttttttgttgttgtttttgagatggagtcttgctctgtcgcccaggctggagtgcagtggtgtgatcttggctcactgcaacctccgtctcccaggttagaaggattcttctgcctcagcctcctgagtagctgggactacaggcgcatgccaccacgcctggctaatttttttgtatttttagtagagactgggtttcaccgtgttagccaggatggtctcgatttcctgacctcatgatccacatgcctcggcctcccaaagtgctgggattacaggcgtgagccatggcgcctggccaagcattggttttttaaaaagttctaaacctctatgggccctttcagccttttcagctgaccttgtttgggggtaaaacctaaggtttgaatttgtttacttatctgcttttgtctcttacagattaaactaactttcattgttaaactttaaagaaactcctatgttgaaatagcctatgtttaatggaacttcatttctgacctttgtgctctcttctctttttttttttttttttttttttttgagacagagtcttgttttttcacccaggctggagtacagtggcgcagtcttgtcttaacacaacctctgcctcctgggttcaagcaattctcttgcctcgcctcccgagtagctgggattataggtgtgtgccaccacacccggttaatttttgtatttttagtagagatggggtttcaccatgttggccaggctggtcttgaactcctgacctcaagtgatctgcctgcctcggcctcccaaagtgctgggattacacacatgagccaccgcgcctggccctctctttttttattattgtttttgaatattctttagtcttttcaaaacaattttatttaattagttttaatagttaacatagttttgttcctctagactacccttcagtatttttcaaaccagtaaagtttgatattttaattaattcactcaaaaattagttgagtgcctgctgtgtcatatagtgctctgatagttagggatgtattttgaacaagatgcaggccctgccctcattaagagacgtcaaatagtaaacatgtaaacaaatggtttagataccaataagtactagtcaggtagcggatcatagtaatctggtaatggttaacctaaagaagaatgggcccatggtctggaaaagtctctctggagaagcaatatttgaattgggaactggtgaggaaggatgagggagaggttaccacacctagaatctgaagacaagagtcttgtaggcaaaggaatgtgaaacacctgagatgggaacagcttgacctgatccaggaaaagaaaagccaaagtagctggagttcagtgagtcaaaggaagtggtagaagttgagatacgatagctagacagggccagatacctagggctgcatagattttgttctaattctaatataaggccatgacagcattttaattgggaaataataagattataaagatcaccctaactattatatggagattgaactatagggagacacttggggaaggaggatggtcatttaaacttccataaacctgccttttaagaaatgtttgtagtaatatatgctgaattttatttaatcatatttgcttcaatatatatttcacttgtcccagatcagcaaaagtcagggttctttagaaaaattcaaatctatttaatatatttatcttatttgtgacctacattatgaaataaatattagtatcttttgatagcttaaatttaggcagtgcttagttacttataaataagtgataaattctatggctaatctctggcaggcttaagtgttctggctgttgtcctacatattacaacatttaatatatccaaatttagtaacctaatgaaatcataattaggaagctattgcctcagataatcttatcacatattcaaaagaaaatggtaaaatcccttttgtttggtgtgctttgtcgaatactttctaccattgctcttatcacagcaaacataatcttgtatttagtattttagcaacagcattttatctgaaactctttacttaaactctttactctgtatttaagattaaatccttaaatacagacattctgggttggtcctgtctatcagtttctgaaaataaaaagccatgtattcaagtaattgagcatcttctacaaacaaagagtttgtatttctactttgaatgtcagtttgtcatcatgaagcattggtggcattacattatcaattatttgaaactaagacagttcagtgttcatgcagatattaatagaatattttacatttcaactttattatcaccaacaggcaaatgtttgataaagagaacttgaaaatgcttcttttcctctggtccaacatacgctggcagtttctaatggattctaggttaagaagttgagctctttttggaatttccagctgtttctatttagaatagttttttaactttcatcccattctttcctaaaataaaggattgacctatcacagagcttattcagattatgccaaagacatatcagttttaatttaatgttgtatatcttctcttccaagttgtaaaacaagattgaatgtaaggcaaataagataaataagagttttgataccagtaagactaccagagatcaactggaaattttcagctcattttctgattctttctttcttttgccatgtgttcgaagaaatctttaatgtttctggataacatgtttttcttctacaggtctcctgcaagcgcaaaatcttctaacgcaactacctcagcaaagccaagccaacctcctacagtcgcagccaagcatcaccctcacctcccaggtcagttttcttctatgggggctgctttctcttatcatattgtttggggagacttttggactttatttaatttttttttaaatctaataaaaataattcggtcttcgaaaactgaccagaaaatcaaagctaggcttatcagctcaatgctaccaaatcaatatagtctttgaaaatcttcagagttcctgtttcttatatgttcttaaagaataactgcattagcagtaaatgagtaatgagttctagctatgtgacatctcccctcaccatacttggcggtagatattaccacttaaactggaaacctagtgagcctcagttaaaaatccattgttaccctttaccctttctcagaaactgctaagagattttgatctctatattttcttttttctcaatgcttttatggtgctttagctcatttctactagaccatataaacactataattatattaaaaaaatttagacatataaaggtttaaattatagacctgattccacttcttatctagctgttgctttgaacatgtcattttatctctctggacctcagtcttctcatctataaattaggtgactgaactggctgatcctgaatctccttccagctctgactttctttgtctgcagtatggaagttatcacttaatactaacacattaccagatttgacagaattcagcatccatttatgataagaactcttgcaaactagatatagaaggtaactttcttaacctggtaaagagcatgtattaagaaaaaaaaaagaaaagaaaaaaaccaacatcatacttcacgaaaaactgaatactttccccctaagatcagaaacaaggcaaagtgaccagttgccacttttattccacattatactcaaggtgccagtaatgcaataagacaataaaataaaatattaataaatgacatacagattagaaaggaagaagtaaaactatcttagttgctagatgacatgattgtctatgtagaaaatcttaaggaatctaccaaaaaaagctactggaataagtgagcttagcaagtatgatacaaactcaatatataaaaatcatttacatttctatacactagcagtgagcatttggaaattgaaattaagaaaaagaaatttacagtacttaggggtaaacaacaaaatatttgtaaggcctatacaaatagttctatagttgaaaactatagaacattgctgcataaaattaaagacctataaaatagaaagaagtaatatgttcatgaatcagaagacttaagttaaatgttaaaatgtcagtttttcccaaattgacctctagattcaacagtctcaaccaatacctagcaggcttttttgtagaaatttgcatactgtttctaacatttatatagaactgtagaaaacacagaataaccaaacgattttgagaagaaaattgaaggactactgatgtcaagaataattataaaactcaagtaatgaagacagtgtaatactggcatatggatagaaatagagatcagtggaacagaatagaaggtccagtagatccacatgtatatggccaactgatttgccaaaggtgccaaaggatttcaatgggaaaaaaaaagtcattcaaaaaatgcagctgaaacaatagggaaaaaaaataaaaaaccttgactattatttcacaccatgtacaaagatttgtttgatgggtcatagacctaaacttagagaaaaaagcttggaaaaaaatctttgtgtccttgggttaggcaaggatttcttaaataggacacaaaaagcaccataaaataatggataaatttaatttcataaaaatcaaaagcttctctcaagtgaatgaaaagaaaaccacagatggggagaaaatatttatgaaacatatctgataaaacatttgtgttcagaatgtctaaagaactcattcaagttaataataagacaatctgatttaaaggaatgggcagcaaaaaaattggagatatgtcaccaaagatgatatgtaaatgtccagcaggcatatgaaaagatgctcaaaaaccgttagtgatcaggaaaatttaaatgaaatatcactacacagtcactagaataagcaaaatttaaaaggctatgacaaaaccaagtgttggcaagaaggtaaagcgactagagttctcatacattgcttagtggtgttgcaaaatggtatacacactttggaaattattttggcagtttctttttgggggggtgagggggaggcaaggtcttgctctgtcacccaggctggagtgcagtggcacaatcacagcccactctagcagcctgacctcccaagctcaagcaatcctcccgcatcagcctcctgagtagctgggactacaggcgtgcatcaccatgcccagctattttttgtagagatggggtttcgccatgttgcctaggctggtcttgaacccctgggctcaagcaatctgcgtgtcttggcctcccaaagtgttgagatgacaggcgtgagccaccgcaccaggctggcagtttcttataaaattaaatgtgcatgtaccttgtgacccagcagttctgtccctagaaatgaaagcatacgtccacacaaagacttgtatgtgaatgtttctagcagctttattcacctcaaactggaaacaacctaaatatacatcagctggtgactaggtaacataagctttagcatatccatatgatggaatgctactttgcagtaaaaagaaacgtgcttctgatacatgcatctcctgtgaatctcaaaagcattatactacatgaaagaagacataaaagactgcatacagtatgattcaatgcacatggcattttagaaaagacaaaactaaggtacataaaacatattagtggttgccagggacggggggctaatggtggggattaactgcaaagggaacaagggaacttttgggagtgatgagaatgttctgtatctactactatctgtagtaactgctactgcaattagtagcagttgtatgactgtagttgctgaaacatatactttgcccttttaaatggtgaatttgtgaatatgctgaatgcaagagtgaggttgggattttgaaaaaagcctataccagagacttcttcctggcctccgttctctgcatatggtggcagggccgttgtggcttcatcctgactcctgctcactgaattctactctgccatttctagatctggcccagtccagcctgaggtttctggagctggggtaacttatctgtaaccaccccatctaaaggtacccaagcgatttttagtcctttattatttgagaatggggctacttcaggcccggagatgaagtaacaatgtgatagttaagactcacctgtaactgtcaaccagtttcgctgtgagaaatgtacagctacataggggtctgctatggttggtgctcgttttggctcctccaaaatggtcaggttgaaaattacgcagtgtcagcatgacatagaaatgaactttgttattgtcattgaaacaggataagagaggaacttaactccagttgtcgcctgtgtaatgcttattctgtagttttctgggacagttagttcctttggaggaagccttgactcataaggtaaaggtcaggcttatataactcatctaaatttgaagaagaaaaattcacagccacagactttatctgtaattctggtttataatcgctcacctgggctactcttcacaggaggagtcaactgagcaactaagatgcagtcaggcagtgcctcccactagtgaggtgtgttccactcagggcttgtgaatagaacagaataaccttaagtttgtgtgataagaaagttgagtattttatttttaaaaagagactataccctcatgtcccaaaataaactatacatggatttaaataatcaaatattcaacaaagaagaagctagcagattaaaaggaattttatcaatgttagaaataagtgaagctttctcagatttgaagtaacaggatatattagaaaggaaaattaaaagctcacccaaatgacaatttaaaggtttatgtaccctgaaaaataaaaggaagaaagcaaattggaaaagcatttgcattaatatgacaaagcttcctttataaaatttgaggatctctctaaggataaggatgagaataaatatcattaatatataaattggttaaggacgtaaatccaattcacattcaaagaaatacagataataattgacacatgggaaaattttgacattgagtagtaagagaaatacaaattaaagcagcagggaactaccatttacttcttgaattagcaaaacattttttaaaactgctaacgtaagtcatgtggaagagtgttgcatagtgggaaccaacgttatgatatgtatcaaaaaccatgaaattgtttatctagttaccagaaaagcccttgagaatttatctcaaaagaactaattacacacataggtggaaaaaataactaatatgcataaagtttttcattgtgttatctatgttagtgaaaacataaaaactgtctagcaattaagaactggttaagtaaattatgagaatattgccttagtttttaaaaaggataactatgaaaactgaaatactcctgatttcagtagtccaagctatcaaagagtaagtcagtggtagtgcttaaaacaaataaaaatgctatatatccagacaactatttaaaccattaaatatattcactcttctttaaaagtcctcggttagctgacaaattccagaaaattaatttggattttggttaatttggggttttcatcttctatagattcttgctcgattaactggtgttagcataggcttagagagtatgtgtgcctgtgcttgcatgcctgtctccatcaccctctctcttccaaaaagttatttttatttttaatttttattaatttttattttttagagacagtgtcttgctctgttaaaacaacgttaaataagaaaagcagagagtaaaattttgtataccataattacagtgaaggtttaaagatataggtccttggggaaaaaactggaacagatatacaaaagcgaaacctgttataagctatttaaactgcaggtggtttacttttcccccttaatgattttgaattatgatcttgaatactatttttataatactgtgtcacaggttggagatgtaatagtggtaaacaagacagatatgctgtctactgttttgacagttgaagtgctagacttatgaaatagattttttgaaataaagagtaatttattaaaagacataagatatatgtattcagaccatttgaaaacccagttataataggtttcatttttgtgtattcatttcatttttgtgtattcatgttttttctatagaattacataattacttgtaattacagtatacataatttcactgtctgctttgctcactgaacattatgttgtacattctgtagtgttacatggtcttcatcgttatccataaatgtggctctttccttcagttgtttacttggagtaaacctaaatatctcttcacgtgtttttcctcattgttttattctttctccaacagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcaggtagggtgaattggccttacattgattcccctccttggctgggtccaaatacagttggctctctgtattcatggattccacatctgtggattcaactagtccaaaatatttgggacgggggacgaaaaaggatggtcatgtctgtactgaacatgtatagacttttttcttgccattatttcctaaacaatacaacaatttacatagcatttacattatattaagtattataagtaacgtagagatgatttagagtatatgggaggatacacgtatgttatatacaaatatacattttataatttggaggacttgagcatcagtggattttggtatccaagggaggtcccgaaaccaatcccctgtgcatactgagggacaactgtatttgctttacatgtccaaagaggcttctaagatacaatatgttcctcagccatgttgttttttggttttaaactgcacctttttgttagccttttcctgcatttttaatgtatggtttaatgttagtctagaagctttatgatttctttcagaacacaggcctctgaaatcataattatatcactaaattgtgaagactttaaaagattgtatggaggattttgttatttgaagaatatctggtggtagacctcagtacttcatatgtaagattgagagagtaaagattacggggtgtattatattagctaaaaggggaaaagtttagaaggcttatttaaaaacagttttttgtagtgggggcagtagctctaatctgtaatcccagcactttgggagactgaggtgggaggattgcttgagcccaggagatggagaccagcctgatctctggtgggaccctgtctctccaaaaagtaaataaataaaaaatttaactgggtgtggtgacgcatgcctgtagtccaagctatcaggaggctgaggtgggaggattgcttgagcccgggaggtcgaggctgcagtgagccatgattgctccattgcactccagcctgggtgacagagcaagacactgtctctaaaaagtaaaaattaataaaaattaaaaataaaaataactttttggaagagagagggtgatggagacaggcatgcaagcacaggcacgcatactctctaagcctatgctaaaaccagttaatcgagcaagaatctatagaagatgaaaaccccaaattaaccaaaatccaaattaatttcctggaatttgtcagctaaccgaggacttttaaagaagggtgaatatatttaatggtttaaacagttgtctggatatgtagcatttttgtttgttttaagcactaccactgacttactctttgattaacctgtcataaataatatatttttttagagacagggtctcgctatgttggccaggttggtcttgaactcttggcctcaatcaaccctcccgccttggcctcccaaagtgctaggattacaggtgtgagccactgcgcccagcctgcaaataatacttttaaagcaggcaaggaattaaactgaatgaaatttatgtaaaatggtataagatcattaggtaaaaaaaaactgaagtatggattagactgggtgcctttatggaatcaggagaaatctgttattttctttccagggaatataatttaaagtttttaagccactagttaaatattactcaaattattttgtgttgaaagtacggtaatgctccacctggcctggtaggtcaaaatccaagggtagcatccccaaatgtactatgggtgtttttaagaacacatttatatatatctttatatatatcttttttttttttttttttttttttttttgagacagggccttggtctgtcacccaggctggagtacagtggcatgatcacggctcactgcagccttgacctccaggggtcaagggattctcccacttccgtctcctgagtagctgggactcaggcacaccaccacacccggctaatttttgtagagacgaggtcttgtcatgttgcccaagctggtctcgaactcctgggctcaaccaaatccacccacgtcagcttcccaaagtgctaagattacaggtgtgagccaccaggcccagcccaggcttatatttctttgggaattcatttttgctcaaagaaatcaattgtgttggggaatatgtaatgattttttaaataggcatgattttagaggaaatacagttacatttgtgaggagtttgacttgtgaagaagcaaattatccagaaacattttaatactttcaaagcatcttaaatgatctgacctgttttaaaaagaaagctaggccgggcacagtggctcacacctgtaatcccagcactttgggaggccgaggcaggtggatcacctgaggtcaggagttcaagaccagcctggccaacatggcgaaaccccgtctctactaaaaaatacaaaaattagccgggcgtgctggcgggcgcctgtaatcccagctaatcaggaggctgaggcagggacagtggcttcaacctgggaggtggaggttgcagtgagccaagatcacgccactgcacaccagctttgggggtgacagagccagactctgtctcaaaaaaaaaaaaaaagaaagaaagaaagctaaacatagaactagattgatatgagtaagttacaaagctgaaataagtataaggttagcatatttagcagtgcctcaagttttaaactattagcacagcatactctggggttccctgagagattgttgcgtaagtgatatgccaaagatgttaaggcttttaaaaatccttatcttttactcaaatagtggtttgcctttctgcatttgacccaacatattgccagtgttatgtttttctctccctccgcacatctctccaggtaaaggagcttccctatggtctggtgttttgttttgtggttttatcctattttttggcatgaccattccttatttttcgaaatgactttgagacagcagtggcaatggttcacaaacttggactatgtgggttaaagtacatactactgctgcagaatggaaaatcagtctatcaacctctgtttttaagtcagatacttcaattttagttattcaaaggttgctctgtgtccaatttatttatatacacacacaaagttttagccattaaagttatttgctgaaacaaaaaaagctctattctctgtgtaaatatacacattattagatgttttaaagttattttctaatttcataattgcttattaaaggattaccatggctgtctttgcataattagaaaacatgtcatagcataatacatttatcacatgtggtacattcattatttcccagtctcagtttttgttccttttttgttatgttctttttaaaaatatcaaagggatataatatagttaagattatatatgaatcgactacttaaaacatttacttttgtgagtgataacccaagatggttgtgagttggattatcacgaaagagcattaaaccaagcctgtaccgaattaatgaaaattagtatgttaactgaggagtctgttgctttttattcaattaagcaatttaaatgtgaaataaaacatattaataaatgataaagtgagtttattatttattatcatggttctagttagtgaatggcatagctttatttccagccaccaccttaaagtatcatttcttataattactgtcatgattttttaatatatattttatttacttatttatttattttttttagagagagggtctcactctcttggctctggctggagtgcagtggcacaattatagctcactgcagcctcaaacttctggggtcaagtgatcctcccacctcagccttccaagtatctgggactacaggcacatgcaccacacacagctaatttttttgtgtttggtagagatggggccttctgtttccaaggctgttgacttattttttgcttgttaaattgttacttttataataagacagaagtttgtgaaaatttgtagcttattgtgcagttactatgccagaaaacacttattgccatctaactgctacataagtttatatactcaaagaattgcaaggtttagttggcaccagctgtaatctaaacaagctgaccatgacatgaatatatgtgatacacaatgcataagttcaatgcttgacatatagtaggcacttagtgaatatttgattgaatgaagtaacattttattttattttattttattttattttattttattttatttatttttttgagacagagtctcactttgtcacccaggctggagtgcagtggcatgatctcggctcactgcaacctctgcctcccaggtttcaagcagttctcgtgcctcagccttctgagtagctgggattacaggggtgtgccaccacacccaactaatttttgtatttttaacagagacgggggttttgccatgttggccaggctggtctcgaactcctgacctcaaataatccacccgcctgggcctcttaaagtgctgggattacagttgtgagccaccgtgccctgcctgaatgaagtaacattttaataaatatatagagatacaggtatagataaacataatcatctgtgtctttagacatatttgtatacagtataatggatagcatttatgccctgctcaccactgattctgattcttgcagttttatggtaattggaatgaaatcaataaacagtctacttcagtatattcagaactgtcattaaaactttctgtgatgatggggtgttctgtacattggacatgggatgtccaatacaatagccactgtctacttatggctattgagcacttggaagggctagtgatgctgaagaactgaatttttaatttattgggttttaattaatttaaatagccacttgtggctggtggctatatgggaaggcagaggatatcaatcacttgaagttcaggtattctgggtgcctcattttgtcttacatttcaatatttctcatctgttaaactttttatcagaagttgctcaccaaaaagaaaatggggttttaaaaatatgttacttttttaacccaactaccacctaataaaaaatgtagtattcaatgtgctaataaaaaatgtagtgttcaaaagatggatttaggggtaggggggaatcaaaagactgggataatcccagttcaaacaagtgttgccaggatagttgagagttggctgtctcatagtaggattagttgtatagtactttggaccagaaatgatgttgcctttctgccctgtcactaaactaattgaaatgaatgggtgaatcatttaaactccgtgagcctctgtttcctgtatataaagcaactatcttacgcttttttcccagtttgatcaagagagattcagcaagaagaaaagctctgtatacatttcaaaggttataggcttatagagaaagacatcttttgtaatatattcagggcatcattgttctattgctataaggttactaagtttccattgcccatgaaggtttgactaaatgggtcaaacctctctactgtgaatttctatttctatgatggttacaaaagtagtcttttagaatacctgttttttgtaactaactttgaaatccaaactaggagtgaaaatagatttttttttcactgcgtccagaaatacttgatagggaaaagaagaaaagagatgatttctaatttttaaagtgatttttgggaagtttgattagttcgtaaatatcttgggttatctagagagttatacataatatctgtaggtgatacagataaatttatttttatttttcttttttaaatttttttctttttttgagacaggatctcgctctgtcacccagactggagtgcggtgccatgatcacggcttgctaccgccttgacctcctgggctcaagcgatccttccacctcagcctcccaaatggctaggactacaggcacacgccaccatacctgcctaatatttgtattttttgtagatgttttgccatgttctccaggctggtctggaaatcctgggctcaagcattccacccatgtaggcctaggcttcccaaaatgctgggattaaaggtgtgagccactgtgcccagaccagataaatacatttttaaaaattacttaaatcactttggttgtatcaattaaggggcttgttagaatattagcactatttttgatacctagttgaaattttggtatctccatgattacataaggtggcaagaagagattcaaaatgggaaagtatgtgggacagtattgaacattgtaacgatcaggcctaaaagagtcctcacagtaacactgtgactggcttagggatggagtttatgtgggaccccgtaagtggaataattactgactccttgtctaaagcagttattggagcaacaccccagagtgaaggctttaagcactggtgagataactctgtctttcctctcctcttctcctgctctgtattgtgtgtagggtgatgttgggctcgctatggggaaactatatggaaatgacttcagccaaactaccatctctcgatttgaagccttgaacctcagctttaagaacatgtgcaagttgaagccacttttagagaagtggctaaatgatgcaggtaagtgactgtataagacatttctttgtcattcattggaattttacatggggattgttatataaattggggtttatatttcttactctatttttgttgttacagaaccttgaagcttactaatcctgggaggatcattataaattatggtgatataaatcagaaagctgattcatttaaatattctagtaattacagtataaataattagccgtaatttttagcctgaaatactcttgtatttgagccaggattaggaacacacacacacacacacacacagttgaaggaataggataagtaaggcttttgtatttagataagcttgaagtagaagcttattgtttcttccttgatgaattatcatagaacttgttcttgcaatagttctgcttttgttatttcaaatgaccacacatttcattcagaaaagttggactactagctttgtcttacgtttttttgtgctgagagttccttttggaagattggaattttgagtcacaggatcatagactatgaaagctgtaggagtcatgtagatcccttaaactatggttcttattgtagatatgaacaaaaattaggcctttggaaaagacaaacctgaaacacgcatccttggacagttttattcagtagctatgggtgaggcctaggcatctgtttcccaagtccacagataagaaccactggtttactgtttccatcttattttacgtgtagcagaaacaaactcagatgtgtatgacatgcccaaggttattaaactgtgaaattatagaaccctgtgatttaacttcagagaatttataaatatttcatttgtttcttttctttttaccctagattataccaataaaatgagaggccatttacaagataaatattaaacgttcagtaatttctaagaaactttcttccttttatccccagaacttataaacaaacagaactggagacatagagctgagtttaaggataggaatagtaaacctcttctgtctcagaaacagaaatccaaacatagtggtaatattgtcaaccatcctagcagaaagaatgccaataagggcagcagaaatatccatggtagtaaatatatatatattggggggatgggtggtgggtagggggagacatggtctcactctgttgtccaggctggagtgcagtggcaccatctcaggtcactgcagcctccacctcccaggttcaagtgattctcctgcctcagcctcccaagtaactgggaccacaggcgcacgccactgtgcccagctaatttttgtatttttggtagagatggggtttcaccatttagccaggctggtcttgaactcctgacctcaagtgatcctcccgcctcagcctcccaaagtgctgggattacaggtgtgaaccaccatgcccggccaataagcaatattgtaatgtaggttatgtgaaaaccttttcatacttggatgtagcttattttgtcagttttgttgttaatatgcatattatgcacatgaatcactgtgctcagctaattttatttctgtattttcttcattcttacagagaacctctcatctgattcgtccctctccagcccaagtgccctgaattctccaggaattgagggcttgagccgtaggaggaagaaacgcaccagcatagagaccaacatccgtgtggccttagagaagagtttcttggaggtcagtgaggattttacttttctgtacatgggattgtctgtgtagtacttaacattagtacttagtagaaactgtaggtggtaaaagatgacatgtcagcctctgctcttatggatgattataaataggtgaagtaagtaagttactaacataggagacagaaccagagttctgcagggttcaggagagactagaatcacatccatgcaagcactcagtatgagagaggtggcagcttaccataggatacataggaattaattccacagactagaaaaggtggggggaaagtactttaagcagaggaaatgcatgagcgtttccccctcagagtgggggagaaacactggagtgagggaaaccatagggtgtatgaggagacactctagtagattagttggttaaattgtagtgtctgtatgcctggaatagtagtttgggactggaacactagagaccttgagtgttaggctatggagcttaagttaatgcaagagatatttggcaattatttttttgtaccaggtaatatcataacaaagcttttaagaaaattttgacttctctaattcagaaaagacttgagcacattgggaggactctgaattaggagtttttgtcagctctgccacttaaactgtgtgattgggcaaatcatgtgatttctttaagctaaaggtccttcatctgtgaaatacctgcctttcttactgtgagatccaaattagatagcatgaagcatggagaaaggttaaattcctactaatacatgtggttgtactggtattttgttaatttcattcacaattaatagatcttaaaaatgaaaaactatagatatttaaggataacttatcctaagttaatatgaataagtttaataggtgtatgttcattagaacttctatctacacaatctctttgttgaaagtggcctaatgtggatggtcatatgtatcccagcttcattttctaacctgacgtgattatgccagtagttcaaaaagttattgcaaaggatagcttttggaattacatcttttcaccctgcagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtaagaataaaaaatagggagtgcaagctcaagggctaatttttgcaattttacaaatgacctgttaaatcagtttatttcataatagtaatttaatgaataaatacatcaaataaatgcatgtaaatttgtattttagacattaccaaggtaatgaaattctcattctctctttccttgtctctcgtgctctctctctctctctgctgaggtcactggtcttgaggtgcccctgcatggagggtgaaatctcgtgttgttattaacccaagaacttattggtcttgcttattttttatttatttttctatttattttatttttttgagacagagtctcattccatcacccaggctggagtgcattggtgcgatcttggctcactgcaacctccgcctcctgggttcaagcgattcttgtgccttggcctcccgagtagctgggattatagacgtgtaccaccattcccggctaattttttgtactcttagcagaagcagggtttcaccatgttggccaggctggtcttgaactcctgacctcaagtgatcccttggcctcccaaagtgctgggattacgggtgtgagccaccattcccagtctttttttttttttttttttttttttttttgttgagacagagtttcactcttgttgcccaggctggagtgcaatggtacgatttcagctcactgcaacctccgcctcctgggttcaagcgattctcctgcctcagcctcccaaagtagctgggattacaggcgcccgccaccagacccagctaatttttttgtatttttagttgagaccagggtttcatcatgttctccaggctggtcttgaactcctgacctcaggtgatccacctgcctcagcctcccaaagtcccaacgtgctgggattacaggtgtgagccactgcgcccagcccacctatcttattttttaaagtgaacaattttaattctttcatcacatttccatcatactcttctctggtatagttcattagattactctgtaaccatgggagtaaatttgctgctgatcccagttatctcagaaaatcttgttactttttattcatgttgagtcctaaagcccagtttattaaacttacactcacgtgattaagtgacaataagttaccagataaccttcagttctgaacttgtattaaaacaatcatctcaggtcttttactttgaaacaacatatgatcctttcctgtgaagcctcattgagtaacttctgctgtttgcattattcctagactgaagagacatacagtggtcgtatgactcccttggtttttaggatgattatgaatttgacttctacattgtcaggattcaaaagatgggaatattgttgagtttgcatttctgttctttttaaatttggttttattttatttgaatgtcattccatactggcaggctttttaaactaaggtcagcattaaaagcacatgttagtttatgtgaaggttgtagttgttaaatggtgggcctgtagtcataaagttatgagatagttatgaaaaagataattattaatcaacaattttgttttgtaaaggtgatgtttgtgttttagatttgtactaaaagaaagacagtatttcttgcaaaactagaattttttgttatttcaaaactaatccgttttttttaaaagtttgcttcacattattttcataattttattttattaaaaccaaacctaaggcaatactgcccccctacagagtcaaaagtaaaagtaatacatgtaccccagattccctgatcctgtcaaatagttttcttatttaggtaaagttgataattagtataatgtttcttaccgacttagagtatatctgtctcaacgctattgaaatttacgaactttttattatttatttttaaaacccaggcaaagctatctgtgatatcagtgaacaaccatcttcgaatagcagctttccaacataggatgtcaggtgtctcaattccaagatcaaagaaagactgtaaaatcatttcctctttaagttttgattttaagtgctttgtccatgttttcatttctgacctcaaggtggcgaccacaccaagccttgtgactagcagtgcagcaactaccctcacagtcagccctgtcctccctctgaccagtgctgctgtgacgaatctttcagttacaggtaagcagctgccaggccatgcacctgctgagcacatgggaggcccgttttgggttattataagagtctaccattaaattgtgaattaaggccctaactaaagataggtgttgctcataaatatcaattttctttaaagtaactcctttccttaaaagccttcaatagccgtggctttttgcattcagaaaaacatccaagtttgtcaattcgtgaaggttatttccggtctgaacctgatctcccactagtcttttgcctacgcaccctcaacacacaggaggcctccatccatacctttgtaaacatccctacaatggaaatgtccatcttagcctgcagttcttgatctgttactgataaaactataccagcttgtatgtcaattttcttggaaatattctttagctttcccaggaaactattcatttccatgtacctgtattataaatgattttatttttacacacctgtctttcccaatagactgcacttctcaaaagatttgattattctttttgaactcttgatgcctagctcagtgcatgacatactcactataaaatgaatgtttttttttcctttggcctcttttaaatagcaaattttccagataaatttaaaatcacttagcattgtcatcagatgttttttagtgatacatagtgcataagacatgctgtaattattcaccaggttggttatttgctagtacatcattgggtagattaatgatatttcataatgaagcttgatttaacctagaggtagggacttttatttttctcacccatgttttaagtttacaatgcctccttggctctatgacctacccatgatgtaaaaattgaataaatggctttatattatattaaatttctacattattagaacattttgtttattgttttctgcatccaatcatccattaatttttgcttatgttaaacagtacttcttgacctcttctggatgttggacctttttaagaatttgaaagctacagacttttcctcacacaaaatagacatatacacaatttttagtaaaatttaaggagatttataaatgacagctcccatcaacctcccactccaaggctatttgtggatacctacaggttccagttttaataaccttggttcaagaatatacttaagaaccttggttaagaatatatataatattgagcacttccacttaataagcaaactgttagtgattgattggcattgtgttgggcaccaagaatgtgaagaaccatctctgaggaccttgttgtccaaattgactgccagtcacctggtaaattatgaactgaatcctaccttcccaacaaattatattgctttaggtctaaaaatacctgtctcttacagaaattttgttaatagtttacacattaagaacaaatagctttgcagttttcttaaaatatggggaaaatcaaagtaattttagagagattttaatactcaaaactagctaaaaatttgcatcagtttttgatacttcttaccactcacattttcttgaactcttactcagcctatttatgtggatctatttgtgatttttttctgacacgttgataatttttcctggagtgaattttttttaattattaaaaacattattaggaaattcaaacaggaaaaacaatcacaagtaccatttttattttctctttaaatcctttttatatgtacatgtatgtacagtttcagtagtatttgtgcagtacagtatttgattgcagccttgtgatactctaagcagaggactcaggctctgcctggacacctgacccacaaaaactatgagataataaattgtgatgatttaagctgccgaatttgtgtcattgctccttgaaagagaagaagagtcagtgtcaagtgggttttcttttcttactcttttatcagccgttgctcaaaaccatgcccctttttaatttgtttttcctctttggactgtaactttcttgtacagcctcttttcctctgatatttttatactgccttctttttttctctgttgagaaaagtagcatgtttctttatcatgttatttattaaagacggccattgtcttaatcatacaacttatgtaatgcaatctgctttcttcctgaagactttcttcttgggatttctatgattgcttattttaaattgttttccttgttttcctgagttagatccaatgtttctcagatgccctgtcatcctctttgattcctttttgtctggagcacgttctcaagtaattttatttagaaaggttacatgggaggtaaaacttctaaatacatgtataactgagaagtatttattttgccttcacagttttttttggagtttgtccagttacaaaagtatttttcctttgaattttgttgtgttttagcatctagtgttgctagtgaaaagtctgatttcaatctctttttccttgttttttctctctgtaaaccttaagggttttttaaaatcttatactgttctaaaatttcactacaaggtttcaaagaaggggccttttaaaacttgccctcattggccttcagcaagcattttcaatgtgaattaatgtatttcttgcactctggtaatttatctttttttttttttaagttaggattttttggcattcactctgtttattcattttgtgtcatttgtaatgtgctgttggcttttttcattgtctggtgatttttgtagtgatgaatgcaagattacattacttattatcagtagcctgtaagggtttttcctgacattgtgtagcttctgttactcaagagtcccctcccctgaatggaagggctcgcggtgagctgtgaatgtgaataaagaactgccaaactttatttcagcctatgaacaggaagcaggcaggcaagcgaggctttctgtcatacttttccaaaatgaggggtatctttcctcatgcatgcaagtacctacactagaatccttagcgttccatagtcagattttattttctttcaagagtaggtgactttggttctgttcatttgagaggtctggtagaaggagggaaaggcccactgtgagagctattatgtgaatagcccttgaatcaccctgttctctgaccctatttccatctacctcagtatctgacaaataactctgagctgggactctctgtgaggctccatcagagtgaataatttcctcctctatcatagtcttctcctgtgcccttctggattatggttgatttctccaccatccagttttatcctttttctcatttctgcaaatctgtctaaatctcaaaacctctgatacctgtcaccagagctctttttcccttttgtatctctttactattatttggaataggattttagaaatgaagggaaaaaccatatccttagcactatcttctaagaaaaatcatgtttgattgatgtggtcatcttattttcccataggtacgtttgacacataataggtccttggtaaacattctaaaatagatgcaagtgagcattgccatactcctccagaaagacgagtgttccattgtgtctcaaaaacttgtaaaaattccacagcccttaataatctcaaccaaacatgccccgcccccaattcattttccaaaatatttttcatagtgacaaaattgttgattcctcaggaagatatagcaactataattatatagccaccttaacaacaaaggcccaagatacaggaaacaaaaaggaataaaattcaaagaagaaatagacaattcaacaataacagttgcagacatagtatttatttgagccacgttaaaaaaaaaaaaattcaggccatgtgcagtggcttatgcctataatcccagcactttggtaggccaaggtgaaaggatcgcttgggtccaggagttcaaaacctgcctgggcaacatagtaagaccttgtctctacaaaaaaaaaaaaaaatgagcaaaattagccaggcgtggtggcacgtgcctatagtcctagctgctcgggaggctgaggtgggagggtcacttgagcctggaaagttgaggctgcaataagctgagattgtaccactgaactccagcttgagaacagagcgagaccctgtttgggggaaaataaaaaaaagccgtgaaggatatacaacatttgagcactatcaaccaacttgttctaactgccatctgcagaacacttggtccagcaacagcagaaaacacatcctttttatgtacacatggaacatccatctcccaggatacttttagccataaaacaagtttcagtaaattaaaaaggattaaaatcatacaaagtgtgttgtctgatgacaactgagataaactagaaattaacaatagaaagaaatttgggaagtccccatgtatttgaaaattaaaacatgcatcaaagaagaaataacatttctcctctattttcctatcaggccggtattacccagatacctaagcttagataaatagcacaagaaaaaaaaattacaaactcatattcctcgagaaaatataaaccaaaactctcaaaagaatcttagcaagtcaaatccagcaacatactgaaaaaatcgaacgattatatacatcatggccaaggaggatttatctcccaggaatgtatggttagtacaataactgaacatcaattaatgtaacacattataatagtagaagaaaggacaaaaaccacataatcatctcagtggatacagaaaagatatttgtaaaaatccaaaacccattcatgatgaaagctgaaatacaaaggaactgcctcacctgataaagagcacttactaaaactctccagcaaatagaatacttaatggcaaaagactgaatactttccccactaagattgagaattaggtaagagtgtttgtttgctcttgtggacttctgattaacatcgtcctggaggttatagcctccagtaagggggagaaaaaaaacggaagacaatttggaaaggaagaagttaaactgcttgtatttgcattattctatatgtataaaaatactaaggaattcaccaaaaaaaggtatctaggactaatcaataaattcagtattgttgcagaatacaagattgatatataaaaaataaattacatttgtatgtactatcaatggacagttcaaaaatgaaatttaggaaataacttgtatgtaacagtatcaaaagaataaaatacttaggaataaacttaaaagaagtgtaagacttgaacaatgaaaactacaatttgctgaaagaagttaaaagaagtctaaataaagagacatttcatattccatgttcatgttttggaagactaagcattcttaagatgacagtttttctccagcttgagatatatgtgcatctctctttctctctgatttcaaggtttatccacattatagcataaatatatatttttttattttatttattttatatattttattattattattatttgttttcgagacagggtattgccctatcacagtggcgcaatcacatttcactgcagcctcaacttcccaggctcaagcagtcctcccacttcagcctccccggtagctgggactatagccacatgccacccgcccagctaatatttgtattttttgtagagacgaggttttgccatattgcccaggctggtctcgaactcctgggctcaagcaattcacccaccttggcctcccaaagtgctgggattacaggcatgagccaccatgctcagtcttccagcttgatttatagattcaacaaaatcatagtaaaaattccaacaggttttttctttgttttgttttaaagaaatcgataaactcttggaagggaccaagaatagccaaaacaattttgagaaagagtgaaatcagaggattttcatgtcctgctttcaaagtttactgtaaagcaacaataatcaaagcagtgtattactggtatacatatagatatatagattaaatggaacaaaattaagagtccagaagcaaaactttaaatttatgctttattgatttttgacagaggtgccaaggcaattcaatagggaaaggacagtcttcaacaaatggttctaggacaactggatatccatatgcagaaagaggaatagaggaatttagatccttaccttacaccgtgcataaaaattaactgaaatggatcaaaggcctaaatataagagctgaaactataaagttgctagtaaataaagtaggacaaaatctttgtgaccttgggttaagcacagagttcatatacacagcaccaagagaacgatccataaaagaaaaaaaaattagtaaattcagcttcatcaaaagtaaaatcttttgtgcttcaaaagccacagactgagagaaaacatttgcagatcacatatccaataaagaaattgtgtctagaatgtataaacaactcttacaactcaatagtaagaatataaacaactcagatttttaaatggacaaatgttagtagacattttaccaaggaagatataggagtgactagtaagcacatggagagatatgtgacattagcattactcattagggaagtgcagattaaaactgtaatgagatactactttgtactcactagaatggctataatcaaaaagacccaagatgataaatgttgggaaggatgtggagaaactggaactttcatgcattgcttgtaggaatgtagaatgatacagcttcggaaaacatcttggcagttcttttaaacataaatttaccgtcctacccagcaatttccccaagagaaatgaagacatttctacacaaaaacttcaatgtgaatgtttatatagcagccttatttataatatccaagaactggaaacaaaccagtgctcatcaactggtgaatgaataaacaaaatgtgttatatctacacagtggaatattattcagccataaaaattaatgaggtgttgattcgtgctacaatgtggatgaaccttgaaaacagaatgttaagtaaaagaagccagatgcaagagactacatattgtatgattccatttgtgtgaaatgtccacaaaaatctagagacaaaaagcagataactaggtaggagtgtgacatgattacaaacaggcacaagggatcttttttgggagtggaaatgtcataatctggattgtgatgatggttgtataactgtaagttgattaaaagtcatcaaattttaaagctggatgaattttcatgtgcttactagtcactcctatatcttccttgttaaaatgtctactaacatttgtccatttaaaaatctaagttgtttatattcttactattgagttgtaagaattgtttatacattctgacacaattccagttcctttattggatatgtgatctgcaaatgttttctctcagtctgtggcttttgaagcgcaaaagattttacttttgatgaagttgagttcactgatttttcttttcttttatggatcattctcttggtgctgtgtctgtgaactctttgcttaacccagggtcacaaagattttgtcctactttatttactagaagctttatagtttcagctcttatatttaggcctttgatctgttttagttaatttttatgcacagtgtaaggtaaagatctaaattcctctttctgcatatggatatccagtttataagttgtatctcaataaaagctgtttgagaaaagacaagacagggcgggaagcacagggaagtgccaggtactatatacacaccttgactatagcttcctactgcccctgtgaggtggttggtggtatcttattttgctgttgaggacattgaggctcagcaacaataagttcactagtcaaagttacccaagtaattaaattgccaagttgccaagaatttacagtcatgaaatacatatattgatgaaaacatgactcactgactgggataattaatttgaagataattttaagttgttataccataatgcttatttatataacatttatattggagacgcctagaacaattttgaatgcttctggagtcatcatcttctggcctaggttaaattcactgataaaatttgactgggattttctttgtaaacttaagggatttaagaaaacagttggtgaatgatttgaaggtggctggagagtaaagaaataactattttaagccttttgagctcaagatattaggacttataaaaataggcaattcaatttcagaactttgaaagggaagtagtacccataggtaaaatcaggttagataaggtgagaaattggtcaaaaaaagattgaaagtacattgaaattgcttagcatggaagagaaataaaagatgttcaccttactatgtgacagggggcatgtcttaagagaagattaaagcgaaaaagggtatatgaatctgcctaacacaggaccctacacagcatccagtgttcagtggttgattgttctgagagatttagaaccaaagaagtaatgaacgaaaataggattcatagtatctacaaagatgtaatgatatttaggggcagtggcaataaaaataaatcacttatatttttcagaagggtagacagaggaagaaagccttcctttttatttaacaataagaacattatgtttacctcattcatttggcagccacttttgcacagctttataggaggtgaagaaagtagtcagtgctgaaataaatgatgtctgagtctctcccaaccctgtgacatgtgataaaaactgaagagtggaagtgagagttcaattctagatgttcttagtacagaccagaagaaggttttaaaacagatttttggaaggacaaaattgcctgaatttgtaacaagattgttatgaaagaagagcatgttctgaagcttggtaaaagatttcatcaccaaaaaatgttattattattattattattttttttaacggagtcttacttcgtcacccagactggagtgtaatggcgtcatctcggctcactgcaacctccacctcttgggctcaagcagttctcctgcctcagcctcctgagtagctgggattacaggcgcccaccaccatgcctggctaatttttgtatttttaatagagacggggtttcaccacattggccaggctggtttcgagctcctgacctcaaatgatccactcacctcagcctcccaaagtgctgggatcacaagcgtgagccaccacacctggccttgtcttaccattttcagtggggctactagaaatttttaaattacatatgtcttgtatttctgttagacaacactgatctcaaacattaaataatcccagcaaatgtgttttagtgtttagtaatgatatatttaatgtcagttagtcatttatatccaaatgttcattctccttaaaccaaaagcatattcaggcacttttttctaagacctcacaaataatttcttttttttttttttcttgagatggagtcttgctctgtcgccaggctggagtgcagtggcgcaatcttggctcactgcaacctccgcctcccaggttcaagcgattctcctgccttagcctcccgagtagctggaactacaggcgcgtgccaccacgcccagctaatttttgtatttttattagaggcagggtttcaccatgttggccaggatggtctcaatctcttgacctcttgatctgcccacctcagcctcccaaagtgctgagattacaggtgtgagccaccatacccggcctacaaataataatttcttagatcttaatttttatgcttttatgagattcatagtatcattgtatgttgttttttttttttaccacaatggactttttgagagctaatttttattacagaatagttgtttgaatgtagagaaggcatgtagtcatttttatactatgttgttgttgatactgaattcttagaaaagcatataactttctgtttttcttctccttgttttgatttttctgaggagacccctaaggagatttctgaatgaaaagagctttacagaagtttttcttcttttgctttctttttcttccccagagcagttgtattccataattagagcttctatgattcttttgtttcttgaataggaaacaggcaatggaaaacttctctgtttctttcattgctcatatctcttaaagtagggttcctagctgtgatcctaaaatgtttggttttgtagttaatttccataaaagcactaaactaggttattaaaggacagctttactaggtggtaggttaattattccattgattatagagtttggctgagtaaagccaccattcttccaaaaccatttacaaaaggtcatcttctaatctgtttgtcttttcaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctgggtaaggcgctttctcatctcattcacgtctgaggtggaggtcatccctggaattactcacaggggagactttacatcactgacttagatggggaaaaaaatgtctttaaagcagtaatctctttgaagtgggctgttttgtgatcatacaaggactttgattatagttgagtttatgtttcttaacaccctgggaagggcagtagtcatacctttgtttccagatgaagacccaaaataccaggtcactaattaccttagtgacggggccaggaagaaagcctagaattcttgactcttattttccccattaaactctctcaactgcctacttcctaattctcaagcatagataagagatgtaataggagtctcaattttatactgttattgtcacacattataagaattatcttgtaaatatatctttttctctagaatgtttctttcattttggaaagaaagagaaataagtctttcaaagaagggtcaaaatgactataaaagttttacattttgtgctgatcataacctcgtttgtatgagtaagcatccaggaaagcagtaactgagaagcacaaaccatagaagagtaaagaaaaataaatatttccacctatttccccagctggattttcgttttgtaagttccttttggtgtgttgtcaaaatgagacctgcgtctgcatggtaataaagtgactcctcttttggacttgcagaggtgccttactcagtctgaatccagggaccctgagcggtgctctcagcccagctctaatgagcaacagtacactggcaactattcaaggtcagtagaagcctttttcttactttggtggcatgcacgtgtgtgtgagtgtgtgtgtgtgtgtgtgtgtgcttgagacagagatagaggaagtctgctttgctagaggtaaaagtgatgggaaagagtcaaatgctgactaacttgttcttgagaactaagaaaatgtcctcgtaaaaaagctttgtaagaaaagtataggtgttagtatgtgagtaaaagcaggaaatatacttagtttggtatatggtaaaaaaccagaactttcatgctaatattgatcttatgtgagtagacttgaagccagatttttttcccctgataagtttatcccaagtattaatctaaaacccgtctctaggcaaacttgaccaagtaagactctccagttcccagctgcactcctgagaaagctgtgcatgggaaagtcctgtaatgaacaaacattggaacacatcaggtggacctcaggagtgcttttaattctcattaagttctgctctttttatatcgccgttagtgtagaacatatattctcttggattataatgtctcttttccaagctcagctgggttccttttgccttttagcatgttacccagggcaatattcattccatatactgaagggttccacttgtttagtacctaagctttctgtctaaaaatgtttactgttatgtgattcagggagacaatttgagagacatcactaattaattagaatttttttcttaaaatagttttgctaagaggctgaggcaggaggatcacttgaggccatgagttcaagactgcagtgtgctatgatcatgcctgtgaataaccattgcaccccagcgtgggtaacacagtaagaccctgtttctaaaaaaaaaaaaaaaaaattaaagtgttttgtgcataaatgagaattctcagggccaaaaataactattagccaacctaaattaagattaatatttcacaggtaatatctctaacagtgtactagagaatgttaattacagacaaaaccaaaccatggcctagattaccttacattatattgactttctgattgactaaatcatacctgaattggttagctctaaagcttttgttatataataatttttttttgcaatagaatttgtgataaatcactttttcttctgctttattgaatgtttctgtgctgtgttgatactacaaaggcaaaatgtcttccctagggcatgattgacactctgaaaagatactaagtttggaatctcagaaaaacttcaagctgcactgtctcactgttctgtactatttgtatgagcaaggccaaagtcagaggcattcccttcagctatattttatgtaagaaatcaaatgtgtaatgccgttagaaaatccctcaaatctacatgtaggagtgaggttatatggctagagagatttaggaatgttgccagacaacaggttgagatactaaatgagagtctcgattattttaaataaaatgttgatgatgccttctttggggaagcaacagcatcatagaaaatttctcacccattaaagcacatcctagacttagatcacccacctacatcattatgtctaatttcctgctacaatagattcatcattctcctttgcacaagtcatagaaatcaagtatttagcctcaggaagtgagaaattaattataccttttaactttatttggtgatacataatttattttagaactaaagcctttttgcaagatgattttcatcttgtatatcataatataaagcagtggtccccaacctttttggcaccagggactggttttctggaagacagtttttccatagccacattgtggtggcgtggtttctggatgacactgtttccacctcagatcgtgctctatgagaatctaatgccgccactgatctaacaggaggcaggcctcaggctgtaatgcccaccactcacctcctgttgttaatgctttaatcacttcagctagtttgtcctttgaacagaggtagtttaaaatcagcagtcttcattaaagacaaaattattggatttatcaaatatgtctaggtaaatgaaataaactggtgatttcaagacacgaacatgactctaattcattagacagttattagctgtcttctacccctgcttgtgcccattaaattagacatttcagtcttttaggctcttcaaaattaaaaataaactacaattggtatcaatatagcactgtgtttgaggaaaaaaattcagtgaagggctatactttttcctggtgggttgtaggaaaatgatagacttttgatgtgttatttggcttctccaggatgatgttaatgttttcattcctgcctgttttggggggtttttgtctgtagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtctttttttttttttttttctggtcttgctctgttgcctaggctagagtgcaacggcacgatctcggctcactgcaacctctgcctcccgggttcaagcaattctcctgcttcagcctcccaagtagctgggattacaggcgcccaccaccgcacccggctaatttttgtatttttagtagggacgggatttctccgtgttggccaggctttttgaactcctgaccttaggtgatctgcctgccttggcctcccaaagtgctgggattacaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcgtgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagtttggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatgtagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcgctctctgaatattgcatcaaaaatgattaggttgcagaacttcatgaaagctttactaataatcttattgttctgacattatgtaaaggtggtattaatattgtatgacttgtcaaagtgctagataggtttataagtaggtagtagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgttttttaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgc

SEQ ID NO: 1361 - DNA, 2752 bp, Homo sapiens
ttaaaatattcaaaatggcggacggaggagcagcgagtcaagatgagagttcagccgcggcggcagcagcagcagactggaaaagtaagaagagctttcctgcctttttaattaccaaactactctcagttttcaatgaatcagttcaaagaaagaatgcagtctttctatacctggttttcttccatcatctgtgacagcttcttgatctgtccccagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgcccagcaacagttactactccagcaggcacaggcacaggcacagctgctggctgctgcagtgcagcagcactccgccagccagcagcacagtgctgctggagccaccatctccgcctctgctgccacgcccatgacgcagatccccctgtctcagcccatacagatcgcacaggatcttcaacaactgcaacagcttcaacagcagaatctcaacctgcaacagtttgtgttggtgcatccaaccaccaatttgcagccagcgcagtttatcatctcacagacgccccagggccagcagggtctcctgcaagcgcaaaatcttctaacgcaactacctcagcaaagccaagccaacctcctacagtcgcagccaagcatcaccctcacctcccagccagcaaccccaacacgcacaatagcagcaaccccaattcagacacttccacagagccagtcaacaccaaagcgaattgatactcccagcttggaggagcccagtgaccttgaggagcttgagcagtttgccaagaccttcaaacaaagacgaatcaaacttggattcactcagggtgatgttgggctcgctatggggaaactatatggaaatgacttcagccaaactaccatctctcgatttgaagccttgaacctcagctttaagaacatgtgcaagttgaagccacttttagagaagtggctaaatgatgcagagaacctctcatctgattcgtccctctccagcccaagtgccctgaattctccaggaattgagggcttgagccgtaggaggaagaaacgcaccagcatagagaccaacatccgtgtggccttagagaagagtttcttggagaatcaaaagcctacctcggaagagatcactatgattgctgatcagctcaatatggaaaaagaggtgattcgtgtttggttctgtaaccgccgccagaaagaaaaaagaatcaacccaccaagcagtggtgggaccagcagctcacctattaaagcaattttccccagcccaacttcactggtggcgaccacaccaagccttgtgactagcagtgcagcaactaccctcacagtcagccctgtcctccctctgaccagtgctgctgtgacgaatctttcagttacaggcacttcagacaccacctccaacaacacagcaaccgtgatttccacagcgcctccagcttcctcagcagtcacgtccccctctctgagtccctccccttctgcctcagcctccacctccgaggcatccagtgccagtgagaccagcacaacacagaccacctccactcctttgtcctcccctcttgggaccagccaggtgatggtgacagcatcaggtttgcaaacagcagcagctgctgcccttcaaggagctgcacagttgccagcaaatgccagtcttgctgccatggcagctgctgcaggactaaacccaagcctgatggcaccctcacagtttgcggctggaggtgccttactcagtctgaatccagggaccctgagcggtgctctcagcccagctctaatgagcaacagtacactggcaactattcaagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaa

SEQ ID NO: 1362 - protein, 743 aa, Homo sapiens
MNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 1363 - DNA, 67384 bp, Mus musculus
  misc_feature (1)...(67384): n = A,T,C or G
ggcttccctcagacctgagcccctctgttacctcaggtcttcctggaactgactgctgccctcacaggacccttctgtgccccgcagctggggacattggatatactgttggctttaatgaaagtttaatgtagcttttaattagtgattagcccagtgcctattccatagctgaacacagcctggagtcttcatagggagctgtttccagcccttggggctaccaccagcttagagcctgagagtcacatggcttctgccctaggtcctcttggagactggcctcctcagactgggacatgaaggccaggcctgtggagacactgattcctttactctccctcacagtcctgcccctcctctcaagtccccatcccaagctccccatcagaggttgggaaataggtccaggaacttgctccaggcagggcactggggacccagctctatcatttcacatgaccagtgtcgcttgtcacgaggtgcacacggcaagcagcaaacagctgggatggggtggggcggcatcgatgtcgggaaatgactcaaggaggacttggtggtttctctgcaggtcccgggcgaggcttctgtgcgccctgtgcccagtcctatgggcatggggagagggagggggaggctgggggggcctgtgagagaaaagattcagagggctcatggaggagggtggggaaagcggggaaggagaaattagggagaggaggagttttcagagggttcctgccagaggccgcactgagaaataatggccccttgtcagtttttctttttcttgatgaaaattccttgattctgtgaaactcctttgagcctctggcttcatcctttttgatgaggtaaaaaagacagtgtgtctatcattctggtggcctcggggcagaagttgccggctagattaatttcttcttgtcaaacagcaagagaagagagaggggcccagcccttccctgcgggtcttttctttattgggaaagaggtttctggagcccttgggctggaatgggggcttcctggcttgcagtccatgcctctcctgccactggctgtggcctggacaaaggcagcctgtgtggacacaactgtggctaagcagtgcctgggaagggaagcactctcactgtgggcccctttgagggacacagaaaggaggctttgtccatggggaggctgtgggagggggtgctagaagaccatccttccccgggtttagcctgcttcctttttcttttgaaaatctgttttaaactctgatgcccaggaagggacacaagccgactcccattgatgggagaatccagtgcacagggtggatcggtcctggggctgcatgcttagttcttcctgctcctagcctggtccttaacatctgacccaggaggaaacttagcatgcaacagctcatcacagcctgggtgtctctgcctcacccggaggtccttgctgggagcactcctgcaggtctctgtcataggcactacgtaattacagttggggcagccatggctccggacataagaggtcctgctgatgaagctgttcagagctgggggtggagcatctcacattagccactcataaatccacagaagcatctcaaatgcatctgtaacttaaacattttaaactaaatagtctcttcatttctttttaactgctatcaattgagcagatttattttcaatgttcggagatgaatgtgcacagggtcagagccacactcctgtgtgagcagactcttaactgggttggggtgagcaggcttcgtgaggtgcgagccagctcatgctctcggcctccagagctttagagcatcctgcaccaacaatccacgtcagaacagttctgtagggacagacgagccatgcagatccacttagtgccactgcggcactgcttcttgttgtgaacgttggggaaagctagtggtaagggagtctggtggttgtgtcggtggccaggggacacttggccactggcggtgtgtttgcttctcctgaaactggctataggctaaggaaaattgggtgctaaggaaaagcgagctgtgtcagaatgtggacggagttcctactttccctttaagacccacctgtaaccatttccatgttttgtctgaatatatttaaggcaaagtgttctaggagggcttaccccagaatgttaattctagcttccagttttctgacatgtggctgtatttttgttctaaaagtagttttattgacatatgtaattgacagcattccatatcatcactcagtgttttaaaatcgcaactctgtggctttggaggcttgtccagccatctccgcagtcacttttccaaaaggtggtcctgtcactgtcaccttatgcctcacgctgtctggctccccaggcctctcagctgtggggactcctcatatggtgttcacctgcctctacctcctgagtgctaagattaaaagcatgcactaccataatagtccaggccttagaaagaaaattttttattagatattttctttatttacatgtttgtaacaatgtagcctcagtagattttcatcctttttaaaattttatttttaatttatctttatttctcatttaaaaaatgatagtttttaatgtttattaaaaatggaaggaaatatttgttcctaagaatgtctcctgttttcagaagtgcccccaaatttagagtatataaaggagtgaaacatgggaaattctacgaatttgcacataaatttgcatatcgtgaatcaatttgtcacccccccaaaatgctttcctggctaactgctgactttgaagagagggtttgctgacctgtgaggcctgagggttgcatctggcctagtttggctccagtccctatcattcagcctagagtccctgctacccacactgtgacctgcctctcagccagagctgagactgggccacctttcttgtgcccggtgactgtggcatgctacatgcagaggcctctgtgtttctctcagagatatccagcactcgctgaggagagcgctggtgcaggtctcacaccacctttggcaaagaccaaagaatggagggccacgctctgtgacaggaaacttactgcaggatttatagctggtaagctcatgcccactggttctctgtttctggagatgaggcagggttgtggtgttgggccacttctaaagcacagctcatcccaccagtagcccaagcgagcctccgtttcctgctccacagatgagcctgagcgttttctcaggtgctcacctgaagggacaaggcagtgggctctcctgtgtgcccatggcttctacgttctctgttgagtctggtggccacaggtcacatgtaacaactggaaccacttgagacctaatgttagcagcatgtcagttgcttttacagactatctgacctacctggggtggactataaagagtgggtagtatccctaggcagcagaggtgtcatggtgggacaaatggtgtgtggtgtatatgtgggaatccatgtgtgtggtctgtgcctctagccagggctctatcgtggccttatctacctaccttccttccttccttccttccttccttccttccttccttccttccaaccttccaaccttttgtcaatgccttgctatgtagcccaggttggcctggtaccaataaccccccaagtagcagggattacaggcaaaagtcacaatacccatcattttttatccattcctgatcatagccaaaaggccccgcgtctaaacaccatagttagattgcattcctcttaatacttcataataggaatgagtctgcagtacatggagttccaggaacactcaatccagatgttttggaaatctcaagttgattgttgcacaagagagtggctgggagtccagtttgtgaatacattgccaggctgggacgcaaaggaggtgggcagttggctgcatttatgtttcccatttatatgtgtatttattttcccatttactctccctcgtttatatttcccgtctggcatgtggatagcaacactggtttatagcagtcctaatgattagatgtggctcagggcctgggtctacttagtaatgctcacagcagtaccatggctagatatcactgtgagcactgtgtttctaagagctgactcactggccctggagtctcatctacctcattgccctgccccagtggccaggcatgagcgggaattctgccatacataccccagggaatgagcaactcactgcaacttgccccactcacccccacgtcttgccgtcccttggacctgagaaactcttgtatctacagcatttgcttgtgccttgaaggtgcttgttagccacagatcggggtccctattgctctgcaagcctccatgttcagtgaaagccactcctgctgggttctcactgggctgagaccacagggcagggtgatagggagtggggaggcttgctggttttggtttcctttcttattcttcacaaagaagtcatgggtctaaaaccctgagtgaactgtgagtagggagggagtaaaagtgctgaccaccaagcttgatgacctaagtttgattcctagactgactccaggttgtccattaatctccatatgctcaccatgacacatatacacatgcacatatgtgcacatgtacatatacatgtacatacacatatacacgtacacatatgcacatatacatgtacatacatgtgcacatacacatgtacatattcgtgcacatatgcatatacatgtacacacacatatacatgtacatacacatatgcatatacatgcacatatgcatatacatgtacatacacatatacatatacatgtacatacacatatgcatatacatgaacatacaaaaaaataaatgttaaagcaaaacccagcccaaactgtctttaaagaaagaaagccgagtgtattatattcaggatgtgggatctgtctctctttgaaacccttgcctcctgtgaaaacaaacaccagctctgctaggtcaacctaccttggtctcttcccttcagcagtactcaaacctcaaagctccatgggcagctgctcagcaaagagcccctccctccaggctctgcagcatgaatacctctccattctctgtgggctccattcccctcagatatggacttacattctctctctctctctctctctctctctctctctctctctctctctctctgtgtgtgtttactttttgattcaggttcataagaattagcctgcacacagtaggtcccttggttagcaaaatccttccctcacctcccattgtcccacctcacaggaagtaaatataactttaaaagttatatagaataggagaacaccaagcatggtagcacacacctataatcgtaatgctcagaaaactaaggcaggaggatcactgtgaattcaggccccgatctgtggctacaaagtgagctccaggccaacctgggctacattgtaagaccctgtcccatacaaacaatcaaaatcccacccaaactaaaaacatattgcatgaaataagagaagaaaaacatttgtgataattgtccttactagaaaaaaattacagaaagatgtgagacaaaatgctcactgtattgggcctactgggcatccttaggtcattgcaagcatgcccagtgtgagcagcctagtatgaacagcccagtgtgagcatctcagtgtgagcagcccagtgtgagcagccaagtgtgagctgcctagtgtgaacagccaagtgtgagcagccaagtgtgaacagcccaatgttgagcagccaagtataaacagccaagtgtgaacagcccaatgttgagcagctcagtgtgaacagcccagtgtgagcagcccagtatgagcagcccagtgtgagcatctcagtgttagcagcccagtgtgagcatctcagtgttagcagccccatgtgagaagcccagtgtaaacagtgtgacccaggttcttttctgtttctcctgtttgctttcctgacatgaagtaaacgtttgctctgtcacatgcccctgccgtgatgtgtctcacatcaccccaggacaacgggccaaacaatcatggactggaatctgcaaaaccctcagccaaaataacccctttctctttgtaaattggtcatctcagagatttgctcttgtcatggggagctaagtaacaggtcttctgaacctcgcagtaggtgggttacaatgggaccttagatgtggcaagattggctgtgaccaaggattgcactgcaggtcggtctcagaggacttccccacaggccccctgaaagggacaaaaatgtctgatgatctggggaattagatattcaagagtcttaacccaaatagtcacttcagcatcaatgcctggggtgtatgcagaggagctatttcatacttacaaacaagacagacagacagacgaatgttttacaattggctattaaacaaagccatgtagtggctcttgtggctgtgaaggttttctagtgggtgaccaagtgactgtctgggcttgttcttactctgtgcaccattctttgagtttctggatggatgatagtttttctgttattggacctaagcctatgaaacatgggccatttccacagtgacacatctcggaacgttcatagacagaaataaagaggtgtctttttttttttaatcccatcattttccagcatctgtgacttcatgtggaggcagacaggcctcacttcacactacaagggcagtgcattgtggggagacatgcaagtctgtggctcctgcatgtacttcatgggctcatagatgcatgtaggtagacacccagccgcgcccagagtacaagtaggtagtcacatgtaagaaggcacacatgcattcatacgtattcgtgtgtactcatacacgtctgcacacatctgtgtccacaagcacatgtctgttgttgtaacacccacacacacacacctgcacccacaggcacgtgcatgcacactacacccagaggtacacacataggattgctctcacttatgcaaacacacacacacacacacacacacacacacccatacacgcacgcgagtgtacaacagcacactcggcctcctgacctggaggttccttctgcagtggtttcaagagttaagtctcatgagcacggaggctgaggagtggagattcacacagggccttgcttcctggtatttgtgtctggcacacacaggagaaccaaaggctcacatgaatgcgggggctgagtacaatttccttataaagcattgttaacctaagaaactctgggcggaagtacttgggcaccctgctaccatacaatgacatcgcttgttgtctttaatacttctcgctacccgaaacgctcaaagcaacgtcagtctcttagattttcactttgaggattttggttttatcgcaaagaggcagtttcttatgtaactttctggcaggttatactgtagtgctacttacaaatggagactcgtgtccacagccctggcctgagaaggcaggtgtgctgagctcctctgagcccaggcttgtggaccaagcaatgccgtcccacccagaggccaggctggaaggctcacctgcacctcctgcttgaatttgcattttcccaccacggtctcgtcactgtgacagaatacagatagaaggagtcgccgtttctcaccatcctgcagatcaagaagcagagagcccagtccacaactaaagagaggcatcactccaaggcccgccttcaggaacccacttttgctagctaggaaatagtctcaaagtagcaccgcccgccaactgggaatcaagtgttcaaacacaagcacctgtggggagacgccacacattcagatcatgacagctaatggtgcttgtcactttttgtatgtttcttggccatttggcttaagtgacatgcagtgttcctattgtggatacaagtccatcgtccaacaaccgagttacacatattttcttctgtaggatctcatttctactctcctatgtattttattttattttattttattttatttttattggatatttttctttatttgcatttcaaatgttttctcctttccaggtctcccctttggaaccctcctatcccatccccccttcccctgcctctatgagagtgttcacccactcacccacccactcactccctccctcctgtcttcctaccctggcattcccctacactggggcatcgaacaccctcaggtccaagggcctctcctcccactgatgaccaacaaggccatcctctgccacatattcggccagagccatgggttcctctatgtgtcttctttggttggtggtccagtccccgggagctttggggggggggtctggtctgttgataccattgctccctccatgagactgcaaatcccctcagctccttcagtcccttctccaactcctccactggggacccccgagctcagtccaatggttgcctttgagcatctacccctggcagagctccatcagcaagcacttcccggcttccacgatagcatctgggtttggtggctgtatatgagatggatccccaggtgaggcaggcagtctcaggatggcctttccttcagtctctgctccacactttgtctccatatttcctcctgtgagtattttgttcccccttctaagaagcagtgaagcatccacattttggtcttccttcttcttaggctttatacccaagacatattttaaagtgcaaagttttcaaagacttatttttatttatctattgtgtgtgcgcgcgagtgcgtgtgcatgcaggtgcccgaagagaccaaaaaagggtgttggatcctctggagctggactcataggcagttgtgagctgcccagtgtagctactgagagctgacactctggaagaacagcagaaacttctaaacctggagccatctgtccagtcctagcacaggcatcttaaattcatgttttacattttgatggtctgggttaaccaagttttttttttttttaaagcagtcttgtttctgatatcatagctaagaaatctctacctaggtccaagtcacagctttgtccctgtggacttgggagaagcttgtagttctagccattaggtttggtgtgtgatgtgttctgagttcattttgtatgcagtggtgagcaggtggtaggtacgtgggtgccaatggtcctccctgcgtgtgctctcctgccgccttccctgacagtggcacactgctttggtaccctcttgaacagtaacccttcccatgttggagctcagccacggcagagcatggatttggaatcgcatttaatttcaagttaggcgtgtgtgtgtgtgtgtgtgtgtgtgtgtatgctgaagtcatccatgggtttcctaagcacttccccgtgtctggtgtcctcttcctagtgtcgtgagcaagtttttcctagcccagaacaatgggaagtttgtttagtgacaaagccctctggctttctgcccctttaattagaatgtcggtttatttttaagtttccatttgcagggctgccacagctgtggggtgactcacgagggggctaatgagccttgggaacagtgggagtcagctacggggctgggtcccccatacaggaaccaagggcaggcaggtttgtgggggaaaggagcgtgtctgaacctcagtgtgtttttccttttgatgcatcactgagtaccacccccaactctcagctacagtcaggtcgctgtaacagtcttggggttggctttacatgtggacccatgcgctagagattgttaccgaccagtgttcccccacccccagcccctgcattgagctctctgatttgttcaagtcgatcccctgggcgggtcagcctttgagggactcagccgaatacactctaaccatgtgcattttgtttgtttgtctagccccttttacggagaggacttttactgtgaaatccctcggagtttccgccacctgtccttttacatttttgatagagatgttttccgaagggactccatcataggtaggtacttaaaatggtaggtacttaaatggacattttcttcctttcacaagcagggtctcgtcctgggagaaatgacaaatctcccctaaacactgtcctgctgccctaaggactaggagattagcgcttaatttgaagccttcctggacaggaccatatatggctctgagtcactcttgatgggaccaagttggaggcttgccagtgtggcctggcctgatggttgtagcctcacgaattgtccttttgacccgataatgcagaacgatgtgcaaataatgacctggtatgcagacgaccgtaacactggaatctcatatccagatcacattgatcagggcctctgagcatcaccttaaggctaccatgcagtgtgtcccgaaacgtccctagacagatttcaagagctccttcccaggtaccacagggcagtatgggctgcaaaccttccttcttcactatctctaggccgcactcatccctaactccagcatagtagtagggataagaaagggccggcgggagggtttgaggccagtcagacatgtttgaagtccacatcaaccctttatttctctgagccttgttttccccatggcttcaagaaggtagtaaccctgatactctccctagacagtagttgtgtgaggagtctaggtgacagaccaggccaaagggtagtcactattttggtgaacccaagattatccaaagtaggagaacggggatggtgtggtaccagagttcacccactacaggtgggcagagggggccactgctgcctgacctacattgttcaaggtaggaagtgactgactccctctgtgttgtctgaggtccctagtggttgagatgaacaagtcacagggatgcagaagataatactgctgaagccaagaggacactgagcctggatagatggggagccctggacctttgagccagagtctcaattgggagcgtgtcagtagaactggagacggaacagaaccttgctttatcaccacatctgaccacacccttactcctcatccttcaccctgtcacctatctcatgccaactgtcaccaccacttcaccctaagtctcacacaagacccaccttcctctaccatgcctcacccttccatcccatctagcctcaacctcatgccctacctgacccattcctacatgcccaccctatcttgcttcttgccatggacaaacccattttacctcatcccctgtgcccatcttccctgaggccccacatatgacttcacgcttctcttactcaacctcacaccccatagtcttcaaaccttgccactgttgtgtcaaaccttgtcttcgtcgctgttgtattgctatgaggagacaccatgctcaaggcgagcatttaattgggggccggtttgcagtttcagagggttagtccattatcaccgtggcgggaagcatggcagtaggcaggcagggcactggagcagtagctgggagcttatattttattcagaagttgcaggcagagagagaaaaggggagggaactaagaatgggcctggtgtgggctctttgaacctcaaagctcacccccagtgacatacattctccaacaaggccacacccctaatccttcccaaacagttctactaactggggaccaagccctcaaaacatatgtgctcgtaagggccattctcattcaaagcaccccatgtatctcctacttgcttttcactccacttaacctcgcctctcacatgaccctcacaccccaccccactttctccttatgctttcctgtcactccaggcacaccccctctgcatcctccttcccccccccgccccgccccctcttggacctcaccttgcttcacttttcattctggcttcccttcatcccttaacgccccacattagctccttgcctgtctcacctcactacttgactctgacctcacacactgctcacactcaacctcacagacactcctcacatctgcacagctatttttcacatctcccatatgtcatctccccagcctcaaatcattcctcactttacttcacacttcatctcactcgacctcgacatgcacccttaataccagccatcaccaccctgcgcctcagccctcacacagaccttccctccatcagtgcctgtgcctcagccctcacacaaaccttgccttcactgcactgcgcctcaggcctcacacagaccttgctatcaccaccctgtgcctcagccctcacacagaccttgccttcactgcactgcacctcagccctcacacagaccttggctccatcagcacctgtgcctcggccttcactctttccgctcccctcaccttactcatcacatcttgcctcaccctcctcatgccccctttattccacagcttcatccttccctcatacttgtctctcacacctttcctcacactcacctcacgcttcacacagatctcaacctgcctttcacatctagcttcatacatatttctctcctgtttgtcatctctttcctcacacccgaccccttactcccttgcacccacacgacgcccacttcttacgccagttttcggcttgctcttcattcccaacctcatcgtctgctcacaggcagctcacgctcactctgcacgcagacctcggctcatttctcacacctacccccacacactcttcctcctctctctgctgtttctctggagactataggcccttctctgcctcattgtccctagagcgcctccacatctgatatcggggttactcctctgtgtgtgtctggatcccattgtctgtaagatgtctgtagacaaggatctgtatattgtattcattccttgggtgcttgcttggcataatatggtcagtgcactgaaggaacgtataaacatatgaataaatctgtgcatatggagaaacttatgtataggtttaatttaagcacacaaagaaagtgtaaaatagagaagccaggcgcacctgtagttctccagcacagcacgtcctacttgtttggacatctgtgtcgttcgttagtttctttatgcattttgcaagcatttaatgagtcctcattatcaaccaggccggtgagtttggttcgcagggtcctagatggtaccagccctcaaagactccgtccttccagactttttctcacccacagagtttatgttgtgtggtcgcaatcgctagtgtgcagcttttgtttcccatcttgtttctctgaattttctttgagtggattgtctcagtgttcgtttggtgtccgtggcctcctgtatcttccttcaggggtagggaagcatggtgctctgcaaattcttctggacagtcagactgtcactgtgaagactgtcactgtgactaccagatggtatcaattgggatcaaccctagaactcagtatcctgcatcccaacctgtccttgtcaacttgactagttgcttgtccatattggcatgacatagtttgagcatctgattttttatttatgcccaactaacaatattcatggatgtgacatggggtaaagaaattgagtggacttggttgtgtgtaactggatccggaatagcctatttctgtactgacaacaggagtccatgtgaggggaacatgacacaaaaagccctgagtcctgatcagtctctgtctaaaggggccatgatgctcaaagctttgtatatctgccttctgggggcttcagggtgtgagccaccactagttgactgttattaggggtgcccggggccaagccctaagccgctgtggggatgggggagctgagtcagctttggggctaaattttcactttgaaaatcagctggagaattccagttttttcaccaattgcattgcaccatcacaaatagaaaatagacgtgaactattagggagacattagaggaccccagtttgcagactgtcttgaccttgttcttgcaaaaattatgggtggccaggctctacctccctttcctgagcaccctcaagaaaactatactcttcttccctcctcctcccacacagatctctgtgtgtctgtgtagggagtgtttcctggtctctgctgtaggctttccttattgttccctctcctgcgtaggccagttcagccatgacccacagtaccctccagcaccctgagcaccgtctgtgtaggacatttctaggcctgtgggttttgggttggcacctcattttcttttctttttcctggacaaggtctcatgaaacaaccacctcagacttaccgtggtgaacttgaacttctggcctttctaccttcacctcccaagtgcagacactgataagatagtacatactgttgtgcatggtttatgcgatgtcagagatgtactctggggccctgtgcatggtcagcactcactctgccaactgagttacatccctacccggttatatctttcgttaggtagagtggcagctggtggaagactgaaccagggtagcaggagggcctgctcttctctgcttgtttcatatgcctgagccagctgaggcttctgttagcaatggacaggaaaaccccaaatctgccaccgccagcagtctctcccccacgatttcagtgtcacctggagaaaaactgactgtccctcagctccaacaagccatgtgcatcccaacatgccaagggaagattaggtcatggtttccaagaatgagtgaaatgtgttaatccaggtgttttacaagggagaaaccagggcaggtggtttttctctaggtgggcaggcactgtgtgtgaaaactccctgtcgggcaactcctcatggagccatctgcctttctaagtatgagccatgaagtttagtcatcctcagggccgggtcctgtagtctcctgagagctttgggccagggctcttctgctggcagttggcttgtagtttgtgaccttcccagggctcccctggaccagctgatactcaggcacagcctgggaaggtctgctctgaactcgactcttgatgacagtgcagttgactgggcttcatctgtttgtttcctggggacactgtaccttcactgtgctgtggctgctgtcagccattttgaactaatcaatcccctccttactcatggcttccacctggcacagggctctaggtcctgagtccagcagacagtggggagtttgcccttctctgtgtggaatgctgacaccccagaagccagttctttctgacagaccttggttggccaccgccaagctccagtcccttcttgagaggggtgctctcttgaagatttggggctctctcggggtgctagagggcttcccaggatctgatgctactcttgggtttgcggtaccttcttagacatgagagtccttcttagatctggtgtttgaagtgttcggtttccctctgaggtcttggggtggggtttttctctcaggatgtagcgctgctggcttgggtccttgggtgctctctgaggtattatagatactgtcaggacctcagacactctgtgaggcatctgtcagccctcgctacacccactggctgacctgatggcctcttgctttcaggccctgagaaatggggacctctaggtgacaggtttctcttatcaaggaggaaagggcctgaagacccggatatgtgtgttctaggagtccaaactgagtcactttcagtagaagcttctaaagaagagggtaatagactctgtttgaggaggcaagaccccaagtgtctcacaggagcacaggggcactggccaggcctagcagacgatgcatgaatggatgaatggtagcctctcctcctggggtccagcatttccctcctagggtccagcatctccctcctggggtccagcatctccctcctggggcccagcatctccctcctggggcccagcatctccctcctggggcccagcatttccctcctagggtccagcatctccctcctggggtccagcatctccctcctggggtccagcatctccctcctggggtccagcatctccctcctggggtccagcatctccctcctggggcccagcatttccctcctggcatccagcttccacatggggggagagggctttaacagcttcttcttgttctcccagctgtgaaatggactagttctccccatgggtttgcacatctgcatgacgtcaccttctcttctgtgttgtcagacagaagcatcaggctccttgacccctcccagccacagaactcacaccagcttcttgacacagaagtcctcacttcgagcattttgttaaaaggtcccagatgaaccagagcacctggcgcccacactgctgacccaggcactggggaggaagtgtggcagtttagggaggacggtgagctcagatcatgatacacacgagccttgtgacccgagcttcagaaagcgcagatccaactaaggctcctccccatctccaagatagagcaactcatgcatgcgccgatgtttcctctcactgtggactttcccagtggagctactttgtgagacatacttatgtcgtcattcgaggaaaacagttatagaactgtgtggtgcagctagaattccacgtgtaatcttcctcactgtctgagggagatgctgaccccaggagggagatgctgactccaggagggagatgctgaccccaggagggagatgctgaccccaggagggagatgctgaccccaggagggagatgctgaccccaggagggagatgctgaccccaggagggagatgctggaccccaggagggagatgctgggccccaggagggagatgctgggccccaggagggagatgctgggtcccaggagggagatgctgaccccaggagggagatgctgaccccaggagggagatgctgaccccaggagggagatgctggaccccaggagggagatgctggacaccaggagggagatgctgggtcccaggagggagatgctgggccccaggagggagatgctggaccccaggagggagatgctggacaccaggagggagatgctgggtcccaggagggagatgctgggccccaggagggagatgctggaccccaggagggagatgctggacaccaggagggagatgctgggccccaggagggagatgctgaccccaggagggagatgctgggccccaggagggagatgctgaccccaggagggagatgctgaccccaggagggagatgctggatcctaggagggagatgctaggccccaggagggagatgctggaccctaggagggagatgctaggcgccaggagggagatgctggaccccaggagggagatgctgggtcccaggagggagatgctggaccccaggagggagatgctgggccccaggagggagatgctggaccccaggagggagatgctggaccccaggagggagatgctggaccccaggagggagatgctaggcgccaggagggagatgctggaccccaggagggagatgctggaccccaggagatactggaccttagaagggagatgccgctttgatgtttcttccttctgaatgttttgagtcttgtaaaagttgagtgaaggacttcaaaaacaaatgctagtagcgatgtctaaggaatgggagtcaggatgagtattctgcaaaggccagcaccccctatgccggcgtcagccccggaagcacagggtagcaaggacatagataggtctcccagcctcgagcttcagaggttagcctgctgtccagagagagccgagcccagagccgcaggattttgttatccttctccacagacataagctcgatcttatgaaacttttgtttcatgtgggataattcactagagacaaaaaaaaaaaaaaaaaaaaaaaaccacctcccactgtgggacaaaggtctgttttgcaagagccacacagtagctgtcttcagcggtcagaggcctcaggaccctatagtggaaaaatcaaaggaacacccaccaggtgggggagggaaagagggcccctgtggcagccactgtccttcaggcacatgtgcatggccacttgccacgcgtacatatgccacatgacatataagtgaaagattgcacatttgcgtcccattcagtagcttttattagaaggcacacattcctaccacattatcataaacctatgtagtgttttgctcccatctacattttgtggaaagggtggcagcagaggtggtagacagccagacctgctgtgtgggagcctgacaggccagtaatggctgaaaatagactggcccctttctcttatagtcagcctgctgcagcaacttaagtacaggcgaggtggaagagtgcttatctgtaaaaactggttcttctgccgtatagcttgcaggaagtgctgttatgtgaacaggcaagtctgcagccttgaccaaagccagtgtgaagtgcgctctgcagcttggaggctccgagtctaaccttactaaggagtggggctccagcccccttgacctcttgtgggtttcccctccatgacctttgctctcttcctgtgttccaggcaaggtggccatccagaaggaagacttgcagaggtaccacaacagggacacatggttccagctgcagcacgtggacgcagactcagaggtgcaggtgagatttgcacgtgggttgggttggggtaagataagctcaggctgtgggcctgagatggagaggagccagcaggctgcgtcttcacctctgtggctgagctctgcagccctgttcctcggtcatgtttgttgctctggctgctggtgtgcgttgtcaggcagatggaagcaactttaaaatacagaaggtgggggaaagaagcggcaaagagcaaatcgtaaacttgggtagcatgctcagtgctgctattcctggagagagtagctgagccacagaactgccaaccaccccatggcgtgcctgcatagtgtgtcctctgggacggagcacccggcttacggaaatagagagatcatgcgcacttaggtaggtaggcctggcatggctgtcccttgatgagcagcataaaacctcctaacctggcttttctaactgtcttagttaggtttttactgctgtaaacagacaccataaccaaggctagtcttataaaggacaacatttgattggggctggcttaaaggttcagaggttcagtccattatcatggggagggggagtgcaggggagcagggcagcatccaggcaggcacagtgcaggaggagctgagagttctacatcttcatctgaaggctgctagtggaagacagacttccaggcagctaggatgagggtcttaagcccacacccacagtgacacacccacctcaacaaggccacacctctaatagtgccacttcctggaccaagcatatataaaccatcacactgaccttagcatggccactcttaaaattgcctgtaagaggggatggcaggtgtcacatgcccagggtgcaaacctgtttatgactgtggcccttgtcatgagccctggttttagataaaggacagctgcaatgacctttcactttgcctgctatgtccatgttatggctgggagctgggtcacagaattcagctcccctgttcaggagtaacatgggtagttggtcagcctctgcaagcctcatctgtataaagtagaggttttgtaggccatggagacttacatgtagcctagcagtgctaggtgcattgtgggatatggaggtttatgctggttttatcctgagtagatagagtctggggaaagtccatgaaacagacatactgtaaagagccgggttgtaggaaagaactcagcagaaagaatttactaacagttaacgggggaagctctgagctgtgcatccttgtgtcctaggactccaagactacagacgaggctagtctgcctgccccacatcctcaaggttctcttcctcagtctggcttttctaagcacagggcaagggtgtcaaggccaaaggtcatccacccgtagagttggcagtgagatcagcacaagagaaagtgaggcactgagtagaatctcatggccacggtgcaaatgagcatgcagaaatttcactcacggagggacacatgtaatttccaattcattgacccagcctcccaagggcccacttgtgccgtgggagctaagtaatgcagcgatcacctacggaagcaatcatggttctccggcaggaaaggagagccttttctgaaggcaacagtcccccttccctccctggctcaggaagcttctccattgccaggagtttcagccttattcctccttagattcccaaggccaaggtcagctcagcacctgcacagagctgcaagatcccttccaggcgtagtcttcctcgagttagagttcattaacaagtctttgctgtttattaggcattgaatttttaaatggctgcaggttcacaggacgctgcaaacagaagtccacaggaatattgccaggaagtttggatgttatctttttccccgtctaaagcccccctagcctggcctttctaactgtcttagttaggttttcactgatgtgaacagacaccatgaccaaggcaagtcttataaaggacaacatttgattggggctggcttaccggttcagagggataacatttgtgagcacccaggcgtggctggtacaggtcacatgactgtgtacttattctgtctgatctcaccagtgtacgcacaagcacgcatgcacacgcaagcacacacatacatgtacatatacatacacacacatgcacacacaggtacacaagcatctgtatgcgcatgtgcacacacatgcacaagaatacacacacacatgcatgtacacatacatgcacgcacacacatgcatacacacatgcacacacacatgcacacgcatgcagttcatgcacacactgttcagggattttagtgtctcataaaccttgccactctaaccattgctaagtacagctcagtgccatcgtgggcattcctgtgttctttgccattacccttctccagatctctttcaacccattaaacccaggttcccaggctcagaatctaccactccactgggccaggagtgagggcgtgggtgggtgggtaggcagcgactttgcttagaactcaggtgagttcatctcttgggacggtctcgttagacgagtgttacatcacaggtccatgaatgttgtactgtgtcaggatccctgccttccttaggctgggggcctgaaccacattttacatacctgttaaccatgtgagttattgatactgctgggctagtagatgtctttgcaactttagcccttgtacacatttgtatcacagctactacaatcaagattcagaaccattttatcaccacaaagctatcggtatagatgcatatgtcaatctcatgtctggagggggatttcttctcaatgctggaaggtgactaaggcatcattggggcagctcaatttttccttgaagcttggcgtgtatgtcagtgaaaatagatcttgacctcagccctctagtcgtctgagacctaggatcctgaaaggcaattgaaaaggctggagaaatggagcaataattaaagaaagcccagcatccccttggtagtcctcagccaactataactccagttccaggagatttaacgccctcttctggctaccgcaggcactgcatgcacgtgacacacagtagtgcatgcaggcagaatccccacatacgtaaaaagaaataaatctcaaaaaaaaataattaaaaaaaaataagtcttcgctgctgttgctgggctgagggataagtaggtctctgtaggactcggtccctctctggtgagtgtgacactagaacttcattcacagtggccgagatagggaggcggcacctccccttagcctgacctttaaatggtaaccgccatctttgctccgcagctgtggcttgttttgaaaatgtcacatttacagtttctagaagggcagagagagtggcatttgggttcttggatccacctgttttgtaatttgtgggaaggaatcacacattacagcagagggaacggggcccacaagagaaaccatgtgtcactagaagtggagaaaaagacagctaaatgtcttgcttccttctggaaccaacgctgttcagaggtctttgatgagccgctttattatatagaaccagccacttctgctgctcccttcacagagactcgtcagctacggggatggccctgtcaggaaggcaggggctgcagctggcgtggcgccccacagcctccagcatcctctggttctgaatggtatggagaaggatggcactggcccctcccctactgcaacaccccatatctgtgtttctgaactggttatggacatgtaatgtattcaggacatatggtatgtcaccctagatctgccattcatacaggcaaataccatcttggtcagagaaggggtgggcatgccacctctcccagagtgtttgggagtgtgtctttagtgtcagatcatataaaaggttgccagtggttgcccatggtcaagggccacttttttctctggggtttttgaaagcatgggagctgagaaaagtgttgacttccttccctggcccagtcctgcctctgggtttgtttgcttttgtttgtttgtttgtttgtttgttttgtgcgtgcctcatccggtcttggctacacaaatctcacctagagccatctccacatttctccctgccttggcctagtgaccactcaggctggtagggatggtttagaggggagtgtcccttaaggagccaccctctcatgatgacctggccaggagtcctctcagtttcatgaggcagcaatacattcgaaattttgttaccagttaagtttttggggacactaagcagagatctgagctgtgtccatcttcctggagccttgacagcccccttcataacagcgttggcagtcattgtttcccaaagtacacaccctcggtgttaagtgggccacaacccgcttgctgcacaggcggcgttcctttgcatgctcaggttggacacaccctcactgaggtcttgggaagttgcgtctttctctttttgtttgggtaacctgactacaggtctatcgcttcaacgatctcttcagcggatctgtttggggttttgatttcctctcacttcctgcttttcagattttgctgtttttggtgtgtgtgtgtgtgtgtgtgtgtgtgtgtgtgtgtttggttatttctgctttcggaggataactctgtcctaatttactgattccgggtctttctccttcccagaacatgcatcccacgaatcctgctaagctgtactttcattttcatttatttaaaaatacttttaaatttgccttaagacttctctaaccagagtgatatttggaagtcgtaatcttcgtgtatttggagggtttcttttggttaccagtttctagtccgtcccgtgagtgctgagagtggactctggttttccccccatgtatctgatgaatgatgctgaaggtacttcccttgtccccagcgaactcagtagggtagtccctgctgtgtgacaaggtctaggaactccgattagctcctctcaggacctcatacagtggaaccgggccacctgtcaccgcctctgttctcggacattcttgatattcatctcaaggctggagggaagacttgtggcacttcctttccaggccatgaaataatgtttctctctcggatcagagtgaattcggagccacctgtctgtccttcagcaggtcttgaagagacggaaggcacctgaccctgtgctgtaggagctaactgaaccaagatatgggacctgggaacagaaagtatgactctgagggctgaaacacaggtgtaaacctgatgggttgctgtgcaccacctgaccacagggcaagaggcccctcccagcctccaccctgacacctctccccataggcaacgcccatcatgtgcagggctagaaccagagagacttctggccacaggcttgcctagagcaccttcatggtgcagaggggtcatggcggtggcggctgtttcacctcctcctggcctctcccagacctctagaaacggaagccgctgctcactgaggtgggagccgccctagtgaggagtgtttgtgctgagtcttgggggcaccgctagtgtgtgggaaaaacaggaaacaggaaggcagctgccatcagctgtgggaggtggggtcatctacctcaccccagtgcttctgcctttcagaggctaaaagatgaaatgagctccatccatctgaacagctcacagctgggtcctaaaaatggcctgctggtggtaaggccaacttcaggggccggggatggccactgcagcacccggcaagctccaacagtcatggaatatggagctacaaaactcactcgatattgtgcctcttagtgtttggaggtttcctcatcactaaacagccgagggcagggacacggcgtggggagagctggtacccaccttcatggtccttctgtcttagttacggttcctattattttgattaaatgccatggcagaaagcaacttggggaggaataggtttattctaccttaccatgtgcagttcatcacccaggacaggaacctggaggcaggagccagttcagaggccatggagggatgccgcttacttctttgcacttcatggtttgcttagcctgttttcttgggacagtcggggacagccagacccagggatggcatgacccacagtgggctgggccctcctccatcaatcaatgatgaagaaaatgctccataggcttgcctacagcccagtcctgtggcgacatttctcaatggtagttctctaactttgtgtcaaactgaccaagacaacccagacgccttatgtcagcattttggggtggcaaaggcaggagatccagaactcactgtcacctcagaagcctgaaagagtgtccctagacatttagagacctcagttcaagtcaaatcaggatttgtggcgtcgatgcaaaagaggatttcgtttcaggactggctagtatgaactagcgctgggatttaatgaagatatttgaatatagaattaagcacaaaggttaagggaaaggctttcagaaggaagacacgggagagcgtgggtgtgatcctctcacatgtgagagtgttggtgtgatcctcacactcctgaaagcatttcatgtggggatttcacagtcacagaaagcaaaccacccaagtgtagctactctctctattagtagggtaatagttcatgactgtctttgaagggatgctacacctaactgaggtcactgaggagtccctgaggggctccccacagaatgacacttgataaggtgaaagtctagctcacagtgacagacaggtatgatgtctttactgtgaactaaggtatcagttttgggctctcctaggcaaggccttgtttgaaggctcaggagcccaaaggtgtgatcctctcacatgtgagaatgttggtgtgatcttcacactcctgaaagcatttcatgtggggatttcacacccgcagtcacagaaagcaaaccacccaagtgtagctacgcaagaggccgtggagactttctggtttagcctccccttctctaatgacaggcatcttggattaacatttgtgtgcacttaacccacgggaggtcccacatctcacgggaggtcctacatcccacgtggatactgctaaggagcagggcctactctcctgatgcctttccctcttcatcctcatggtgtgactgtgtagagataaacaaaggaggttggggttgccagctacctgtcacccttctagaagcattcatgaaaattaacttcatggagaatgagacttgaatgctctggcctccccatggagatcgcagccctcttgggagagtctttcctgctgggtctcactataacatgccctggacatatgcattcgtagcattcctaggggccacatgtctgcgtgtccacatgtcctttttttatgcttttaagcccattacctctccaagtctgagtttctaggtctggcaccttctggcacaagtaccagccacttgaagggccacagatttcccacaatccttgtctgcttgtgacaccatccttgtgccttacagggcaaggtccacctggagctgagactaagtgaggtcattacggacactggtgtcgtctgccacaaactcgctgcacggtaagtcacctggggaactgaggacatactgcgtttctccagaggtggcctctctcatccctcctgcccccctggagctgatgcttacccaccccgggcgtgatgtgcagctcctgcaggtagcctgacttactcaatcgtacttcctactaatacttcatacttcataccacacttcagctgagaagggggccctgctttccagagctagaaatagaaatgagcagacatgcagggggactggagcaacaacagtgaggtcacgtgggtgggtatggacacatgaggtcactcctagctagagttaatccctggacttagcagcagagcactcggcagcacctctataagggtagcaggctctatagctatctgtggctccaggggaatgtagatagacacattccactttgcattcagacttcaggtcggctccaccctggcactgtacaccaagttgagacctgccctttcatatcatgcccctaaatatacaagacagattcattgcttcctctccttctatcaagtgctactccactataacaagatggctttcaggtctcagaggcgccccctctccctccacgagggactcaagctgtgtcttggagagtcttccatgtggttgggcaagtagaagtgagctctggtgattaagaatgccaccatgtttttctgttactgtaacaaaatacccgaggccaggcaacttacaaagaacagagacttgtccaccacagttaaggccttgtgctgtgtcctaatacagaggaacaccccacagtgaaactgacaaccggctggctactggctgagccttcatctcgctaccctgagtgtggtggctgtgtttcaggagctgtaaggaggcctcagccaagagaaaaagtctgtttgcaataaagatataggagagtgatcctgagaaaagggggtcagagactaatcctgccgtggccactggacacacctagccgccttcagctgtccagtaaagatgaaaagggaaggttagcaaccccacccctcagtgcagcagtgggacccaagctgcccacgtaggcttggtcaggaattagtgtagatgccaccttccgagacatctccgtatactgtgtttccctgttgagctcctcactggtaatatggtgccataactcaacatccccgcaccaactcagcgaaggcacatcttgagggttcagttgaagagcaaagcccatgactattaaacacacaacgccacagttcttgtactttaaactcaagatttggggacttactgggtttccaattcttcctttcgggactggagacttggtggacgttttcttattattctcattcacacagatatgtccttgtggcagaaccttcccctaatgagtaaagatttcaagggaccaatcactgggcgggacagaggcgggacttctgggtgggagagaggaagatgggaggcaggagaaagatacttttctgccagtgccatgacggcggtagcatggattaccatttaattttccacgcaacatgccctgtgttcgtgaaccttgattcctgaaaagttggacttagacaagtgcacagtgtggggctatccctgattctaagccagataaacatggcttctggatctcaaggatcccagatttgggctgcagaaggcttggtggttaagagcatctgctgctcttgcagaggaccagcgtttcatccccagcacccactcttggctagttcaccagctccggagccagggaacccttagtgttcttctagcctcctaaacttcacagaggctaacatctgcctcaaaggccagtatcaatggagacgggaactaaaaaccaagagtcagccgaaagcctagatacggaactcacaggccggtgtaggcaaatactggtgtcaaaatacatagacaaccgtgatccgtcactgtagatctcctgcctataggcagttgtgggattccaggctgagagcttgcactcccaggaggcaagaggggacccatgaaggagttatgagtgcaggcctctgagcagcagagggcagtgctggccctgggtgacacgctggtacttagctgtctgtcacctaggtgctttggagaggctgtgatggtggtagccagagggctcgataccctaagacgtagtttgatgaaggccacctgcttggacccctgtccttcggcagcatttggtaactgctgatccacattcttgccagaacttgccaggctatagcacacctggcccggtaagtactggcttggcacatcctttccctgaccactgtcttctgtgtctcagcatcttcgagtgccagggtctccccattgtgaacgggcagtgtgacccttacgccacagtgacgctggccggacccttcaggcaagttgtccctttgatgccctgccctgccagtttcagttctgggttatgggggctggggggtgggggcggggtaaagccctggagccaagaggttggcaccttttttaacgggagggcaggtatactttgaagtaggatgtgttttatagatttataggtttattgctgtaaactgtctttgtttcccggaaagcctttgtgagccttgtactgggtattttgggctcagaaaaggtccctgctttacataccatctgggagtggagagagacaatacttgcgagataaataaaggtggtaaacaactgtatgcttgacagcttggtttcaaacccatctggagctgacggccatttttttttctttctcccaaccaatccttcctttcttcactacaggtctgaagcaaagaaaacgaaggtgaagaagaaaaccaacaacccccagtttgacgaggtgttttattttgaggtcggtgcttcggtgggaagaaccttgagcctcagcagagacccggagcaagtcacatgactgtgtctcgggtgctgtcctggcccagcccagggagcctcggatctggatggcatttggttcccttagagattccctcagtctcaggagaccaaagccaagtgtctcttcctgagccatctggctccagtcagaagaggcagatggaatggccgagtcacagttaccaggacacagggttgggttgtttggctttgaggcttgtgcttcaccacagcttccccaagcagggcgaggttcgtttctccggaaacgtgagggtttgagcaaaaaaaggggaagtgattcagcccagagcaccctggggcctctcggaaccagagcgggcgagtcaagaagggtgaggctggaggctcctctcagccttggtgcctgttgtttgtgcttcagcaccaggtttgggggggttggggagacaagcaaagcctcggttcccaccttcagagcctaccacacaggaggagggaaagggaaagatggaggtggctcatagcctcatgttatggtgatctgtccataacatgctggtccaactctgtaactcccttgcactcagaaaaatcgccacaagtttaaagacagactggtctacatagccacttttagattaagggatgttaaatagctagaccttaatttttaagaagtgtgggatgccgggggtgggggggtggggggtgccccagtcagtaaagtattggacaagcaaacatagagacctgagttcaggtccccaaaacccactaaaaatccaggtatgggcgtgcacgcctgtgattctagttcttagggtgaggagacaggtgggtccttgatattcattggctagccaaatcagtgaaaagaaaccctgtctcaaaaataacagtgaggatcagttgaggaaagacatcctacagcaacttttgacctacacacatacacacacactgcacagatacaaaaacacagttaatagattttttaaaaaaaagccacacagcttcggtggcatggaggcctgctatagtgctgcagagggtggggcttctcaagtgtgggttcctgagtagcctgagtggggctcctgacctgagactggtcctgtcagagccatggggactctgtaattctgcataatcaagggtgctgtgggatcaagttaggagtcagaacagtggacaatcttcagagccaatcccatgaactcctctgtaatggaggctaggtggaagcagggagcaagaggcctgaaggcaggtctacggcctgaggggtgcggggagcagtggtggggagtagtactccaccactgtgtggctaggaaaccctttccatacaggcagtcggagagctcacagagcgggacaaggcagtgggcgctcactccaaccgcaggctctcccgctatgcatgaacttgcggtcagaaaatatcagtttagtaggttttgaaaatcaaagccagcagtgtctgtccttgtctgaggcccctgaagtacctccactgggctgttagggtatggtaggagcgagggcagactcttctaaaaccatatctgctctggtggcaacctcatttctaccgtgtacctaccgtgtgagaccctgcattttggcgctgtgtgtggccaatttacttgctagagacatgagctccagcacataggattaactcagtgtcttggagaagcttgagaaccacgtcgtgggcacctataagactgccaaaggcaggcggggcccctgcccctcccatttcagactccaggtgctgctgttgctgctgtcaatctttccgtcctgtgactcagcagctacacccagcttacaagacttagcagggcttgaaatcactgtttgacttaagctggagacagatttgggggggcatgggaggaaagttaactgcctgaccgactgtgtagcccctcatagagtgcatgttaggaggaagtagcttccccatcagttttctcctaggcttcccttagggtcctccttgctggggagagagggtggttggaagcccggagcctgcctggggaggtgacacttcagggatatccaaggctgagataggacatgcttctctgagagtcactgtgggccatgctgacatcttgagagaggagacgcgggggaggtaggggcagattggtaccaggacaggttggtgtaggaagaccactgcatccgatgggtgtttctgagaggagcagtcgagacatttaggggtagtgttcaggagggaggcaagtggctttggtgtttgttcatcatctagtaaattaaagctcgtggttaaggaatgttagtgtcagttcgagagtagagctttgagcagaaagcttccctccgctccttgcgaaggatgctgtgcgaggcagcatcgcacactaaatggtcaaagcagagccatccccttggccgttactcgtagcccgaattccagatccagccctgattattattgtcattactaattctagataagttctctgtgtaagtcaggctggctttgaactcactgtgtagctgaggagactctgaacttatgatccccctgcctccacctcctggatgctgtggtcacgggcctcagtcatcacgatgtgttaatatggtgctaggaatcgagctttgtgcgtggggcaaacatgagaggtcatcaggcctcctctgcctgttgtgttccaggtgcttgacaatctgaactgtcagctgtaaagggtgttatatttccaacctgtcgcagagtgtaaactccccagaacgtcttgctgaggttggaagacaggttggaccaccacagtgaactgagcactgttgtaggacggtgggggacggggggttgcattgtccatatttttttgagagtataaaggaaactcttaagagcctaggttactgccctgtatatctagcttcctgccgcgtgacattaggacaagaagccttggggcctgcagggtcatgaacagtttagagatggaagaagctacctccactcacaggttcctgccttctcctgagaaaccagcctctgccgcagctcagtatggccttggggcaactttccagtctagaaactctcagctccgattctcaggggtgggcaaggggtacggtccttcccggactgggatgccaggctgtgtgctcccagctgcctggccgaggagtctgacgtcactcgttcccatctgactgcaggtgaccagaccctgcagctacagcaaaaagtcccactttgactttgaggaagaggacgtggacaaacttgaaatccggtgagtgtcttacagaaagtgatagcatccaagcagtgaaggtcagtcacttaaacgggttccaaactatggagattgccccggcacatcacagcaacagccgcctgggggtctcattccagtcctagtttttacaccccctgtacttgctacctgcaaaggtctaggattagttttagaaacagccatgggacaaggcgatcctcctcctccctctcctccttcccttcctcctcctctctcttctccttctcctcctcctcccccttcgtccactccttctcctcctcctccctctccctctcctccttctcctccttctccctctccttcccctcctctccctcctcnnnnnnnnnnnnnnnnnnnntgccctatgggaaactctgctgccacccagcagaatcaatcctccagactgttttctgagaagagtctcacatgagtccctgaggctttggttacccccgcagagccatctcctctgatgttactgattgcttttgggtcctgtatgggtcctgtgtgggtcttcatgccctgttgctatagaaaccaagtcttctgtcaaggttggtatgcaccacatcctccccctgtggattcctagatccatctaagttatttgggggaacatgctgggcgtacatgatcaagcttgccagcaggacccttcatcatagggggtgggttcacacatacatatcttcagcgaagccagcggccatgcgggtgtgctcttaaagactggcaaagatgactgaaggacagctcagtcttctacaacgtccttttccatagcagtgccctaatagccaaggcatggtagaaccttatgagactttcagctctctggctgtgaaccttgtttgtgaactgagccattagtgggggcggataccatgcgcccaaccagctgatattccagtgcaggttttcaacccctaatctgagagaataaggagaattctcttggggaaagaggatccctgagtgacccattttccccagaagcaatggatgctgccatggctgcagactgtgtagcttgtggcccagctgcaggccctccagagggtagaccttgatcatagttcacaccctacagtctagtggttgttagagacaaagggagggctcttaagttttcaaagaaggactatcgggtgtcttaggtatagcatctgccctggcttgctattttgtcttgtgggcaactgctcaggcctgtgacatctctattactctgtgtgctgggcccacaggaacatctagggcagagccaaggccttagcaaatatctgatgcttgcttagggaccttgggttactgctaggtgaaaggacccaggtcataaccaagaatggaacagctatttggctctgtcataggtagtgaccctcagtagttccctcctacagactgagctgggggggggtccccactggctcccagactcaggaatcctatctgcccactgctagtgccttgcactgagaatcaaaacctctgctccatactgcatcccggttcacctgctctcagtgaaagccttcactggcacactctgagaacaggaggcctttgctgcctgcccgcactgggaagcagggtccctctgcccctgcccaccaggtgaccttgcttggggagaactgaatgtcacttgctggtctctttcagagttgacctctggaacgccagcaacctgaagtttggggatgagtttctcggggaactgaggcttcctctcaagattctgcgacactcgagctcttatgaagcctggtaagtgtgcaatccaaggtacaaggcggggagggcagggtagttgcgcagaggaccctgtgccacgccaatctttgaccctaaccgaccactgcctgctcctactttgcttggcttgctgaccagcttctgctcttacagtgggtaacactcagcagacagagctgaccatactgaagggaagggcataagaagggttaaaagcaagttttagaacttggagcagctttgggcctcttctgggagagcgtgtcagccgtctaagtggatgctttgctggggatggtcttcctcactgtccagggtccctgctcagggccggtttgtgaggtgttgtgggtctttatagctcttcagacaaactttctcttgttttggagtctgccaagattctcataaagcttgctttcttcttccttctcatgactttatttctggttcctccagacactctgcatcttcactgtatcccatgtttgtttctttaaagatgtgaagcacatgggtcccagtgtcctgttgtccggtgtcctgttgtcctgtgtcccatgccaagggttactctgagggcactaacgtagactcctgtcccaggaaattgacttctaattctacaaagttcccttgctagttccatggccaggttctaggacacagggctccacctcagccaatgacaagccgcctggccaggaacagagagacagagagagagagagagagagacagagagatagaggggggagggagagggggtgatcagaatgtactgcagtgatacagaccagcacaacccaggtttctcttgtgagaaccacacttgtgtgaaaatggtccccatttgttctgagcaacgccatggtatgggagcgctatcctctgagaatgctgactacagaggtcttggcctcccggccttatcttctcctagcagctcctctctttcccagtccctccctcatccctcctgcttcagcttccgctcagcctgtatgtctatggttcttctacaggaaacgctccagtggccatgcccccataatatcctggagaatggccatggagcctcgtctttctgcctgagacccattggtgacagcagaagctgtctaggggcagggcactgggcctccctgggaggaccctgcccttacctgctgacccacgtccttccttcccaggtacttcctccagccccgagacaacggcaataagagcctgaagccagatgacttggggtctctgaggttaaatgtcgtttatacagaagaccatgtcttctcctctgagtactacagcccactgcgtgacctgttactgaagtctgcagatgtggaggtgtgtgttagccgtatttactggcccaaactccgctccacagacctactctgtatgccacctgtcaggttctgcctatgcgaagcatactgagcctttgccaccctgtttccaatgtctgggtgtgcctgtgcccattttgctgtgcatgtgacacttagccctctccagttatagctgcaggagcctggcctactcagactgttccaactctagtgccctgctggattggggatttggtgggagtgcgcttgtgccacacttgcactggcaagggcacgctagagcagtggttctcgacctgtgggtcgtgaccccttaaggatcaaatgaccttttcacaggggtcgcataacagatatcctatatatcagatacttacagttcgtaacagtagcaaaattacagttagacggagtagcaacgaaaataattttatggttgtgggggaatcaccacaacttgaggacctgtattgaatgcttatagtgttaggaaggttgagaacctctgcactaggggtgttaacacagattttcataggtgtgagtttctcggcaaagagccatgggttatttagtagatggaaaggaacccacggaaggggtgagtccctctacaggttggcctccctgtgctgtcatgtatgtgaccatagggtgaaggtctggagtcaccaggtgctagcctgtggatgggacacagcctgctgagggtgggtaccacatcatgtgctcactgctcatcctgcccctctgcccagcctgtctcagcctcagcagctcacatcctgggtgaggtgtgcagagacaagcaagaggcagccatcccgctggtacggctcctgctgcactatggcagggtagtgcccttcatcagtgccatcgctagcgcagaggtgaagaggacccagtgagttcgccctgctgccccaccccttcacgcccctccccctcggacccctcccacctcctgctcttctcacctcaagccccttctacctcatgctcatcccatgtccctcccactccatgctcctcccaccccatgttcctcctaccccatgccccttctacgtcatgctcctcccacctcatgcccccttccacctcctgctcctcccacctcctgttcctcccagctcatgcccctcccacctcatgccccatccacctcacgctcctcctacctccatgctgctttccctgtaccccagcctcatacagagatccactcccattctttgtaccttccacttgactctgctgccccccacctgtctatatcctggatgggaagctgggcccctgggtacccagtggttagacttcaaaagtagccatcctaaactgcatctgtgcacagcattggtaggaagtgagggtgtcaggctcttcaggagccaaacaggtctctgaccctctttaacagatttccttattggtcctctcagaaggtagcatttctggaaagatccagaaagggtggggagggggtagactgggtcccaggcttcaaggaccagttctgtcatccctggtgagctccaagtttccctggagatccccactactggatgttcttcccctgccccccggaatagcaaggtttatcccaagatgcccttgataaggaaggaaccagagtgaaggggctgtgctgatcagcagccagtgatgacctggctttgcagtctggggcttttgctggtccatccagctctgcacatcagtagcagaagaactgttgagatagagcatttcccacagagcccctgccagccagcatccatgacccactcagtggccccactcaggagactttgctcccttcgtgccgtgacaaggcagatatcaccccattgctgttttccagggaccccaataccatcttccgaggaaactcactgacatccaagtgcatagatgagacgatgaagctggcaggcatgcactatctccatgtgaccctgaagcccaccattgaggaggtgagatagccctggtcacttcagcatggtgatcggggcttctatatgagacagagctatccacagggacctcattagctctcatagaggacatgctgtatgtatcccagaatcctctctgccttcgaatggatttatggatgtagatgatggatatgaatagattgatggaaggatggatatagatgattgatagatagagatgactgatagatgatagataatatatagatgaatagataagagatgattagataatgtagagatagataaatatagatgattgatatataatagataatatatagatgaatagataggtataggtgatagatggatagatagataatatagagacagatagatatagatgattgatagatgatagataatggataggtaaatatagatgatagataatatagagatagatagagatgattgatagatagagatgattgacagatgatgataggatagatatagatgatggatagatacatagagatgattgatagatcatatgtagatggatagatagattatatatagatgggtagacatagtgtcttttatatccaaactcccttctcataactccacccctcacatgacttttgttggatgcctttccagtaaggtgggttgtgaaaagcaggttctttactttgtgtgaaaatgtaaactagaatagtgattcacctatgagcagaacccttgcagcactcgagaggaggaatgttcctaaacctctgaggcatctcttcaccagtaaaccaagtgctgcggccctggggcaatgcccactgcctggctaggacagagggagggctgtgcttcctggccttgcctctgtgcttcactggtccctcccagcaattcatgtaggagcaactgtccattctgtgggacctcacgggactctgggatcacgtgggggctctgtggggtcaagaatggtccttaaggcagctgcagcccagcccaagtctagcgatacttccccatgcctgtagctgtccagcaaccattgtggaagctgcctccaggagggccagcttcctcgggaagccatccacggctccatctggccgcctcgtgcagcacctcttaacgctcttccagatctgccagagccacaagtcctgtgagatcgaccctgtgaaactgaaagacggcgaaaacctcgagaacaacatggtaaggcacctgctttgttctggggcacttcccaaggccggtcacccgatgggggttctgctcatggccgtgtggacactgtttgaagatcccagtcagggtggggatagttgggccctaagccgcttacctgactcttggctgtgagtccagtgttgagctcacagaaccgttgtcatcggatgccctgttcctacctgtcctccactgctgctctcacttgcctcttagaagttcttacagctcccactgtctcccaagggcccagccccagcccatgaactccgccacatctcagcttgggacaagcaagcgtcttcatatgaagtgtgtcaggctgcctgagagactgtcatgtgttaatgtcctcttaggagttcttacagaccagactttactgggttcatgctttcaaacagaagtgcaggttccttgggtcctagtgaagttcagtctacattcactgacgctgggcaagagaacccaggggatgggtcactctactcacctgatgtggatctttcacagagagggtgtttgcaagcatcatggagggctgggctccgctatcccgaggcatggccaaggctgtctctgccttggggagacacggggtctaactgtcccactcttgcaggagagcctgaggcagtatgtggatcgcatcttcactgtcatcaccaagtccggggtgagctgccccaccgtcatgtgtgacatctttttctccttgcgggaggcggctgccaagcgcttccaaggtgagccagcctggctgagctaaggggtgggctgagctagggaatgagctcagccacgcccaccatcttggctcagaatcccccagtgtaaacatggcctcccagaactaactgcctttgtatgttttctcgatggggtcatgaattctaagttactgccttgctaagaagaccaaccccctgggggcctttcccttaccaagaacttcaagtgtcagggatctgggaagaggtttcctggggaccctcttcttcaacctgttcctcgtgctggctcctggagaagctgagatgccctccccacagcccccccttaaactgaatgccttacctcccccaacaccctatcctcatggtagcctccctccacaccaagatattccccagagttcttagcctgtcctatacagaccagaccagacctctcaggctgcccccactacctccaaccccataccccagtacctttcctatcctaactcctgccccacctacacctctctaggccccacacctaccactctgagcaaagagcccccatgactacgccacacaggctggagctaggtgtctcaggccagagcaccttgctcccaggttcagcctctgggagacaggaatcttcagatgtcctgcagaccccaaagctctgagatcgcaggcctctgaaggctgggggttgggggaggggtttccaaaacaaaaaagttatcatctccatatgggagcagaccacccagcagtgatcttcaggaggccttggtgagtgaggttgcacctatgaccttcagctgcctgactgtgtcctcttgtgacataatgagattaccagatcaggagacagagaaatgggcaaagagatagacaaagatacagagacagaggggtgaccgaacacagagatgtatggactgaggagagagatcaggagatacagaagagatacagagatagagtctcagccaagtctatggggcccttgagaattgtcaagcaagatgagaacccatatgccatgcttctttccctactgaaactgtcccctgtctgcttcagatgacttggatgtgaggtacacggccgtgagcagcttcatcttcctcaggttcttcgcccctgccatcctgtccccaaaccttttccagctgacaccccaccacacggtaagtgagttgtcctgtaagccagacagccagtccttgtcatctaggcagcccacctcaaccagccagtccttaagtagtaagttcccctcagccaactggtcctccctcagcagctatgcttctgtgagtgggagagaggctgggctgggcttcactctgatggaaaaatcaacactactttatcttattgtgcatttctgtacgtgtaggtatatcttggtggagggatgcacagtcaaactcggatctctttcttcatgccccagctgtcttgtttttgaggcacagtccctcactgggatctggagctcgccagttaggcttgaccgactagccagtgagctgcagggccctgtctgtctccaccccttcaatacaagtgcacactactgtgttccacttctcacatgggtgctggggatcaaactcacgcttgtatgacactttaccaactaaatgtctctccaacctccatttaatatcgttttatataataattcatgtctgcccagggtcttacctgatgctctctattagtgtcccccgcacccccgtctacttaggtgcacatgccatagctaagccctgtctgggcagggcatagacttctaacagagcaatggataagtgcctggccgaggcaagatgtaggagaatagccccctgctagggcctcacaacaagacctgctggagctttctttggtttaagttaaaccctctgtcttagttagtgttccagtgctatgaaggcacaccatgaccaaggcagctctcataaaggaaacatttagttgacactggctaacagtttcagaggttcagtccgttgtcatcacagtgggaagcatgaagcatgacatggtgctggagaaggagctgagacagccaggacaagactgtcttccttaggcagccaggaagagggtctcttcagcactgggtggggcttgagcataggacacacacagtgacacacttcctccaacaaggccacttcctcctaatagtgccactccctgggccaagtgtattcaaaccaccacaccctccaagccacagcaaagctgcagacatccttagcaaggtttgtgggcccccagctaggcctatagtgatctgcaggactgctctaattttgagagaacccttgtcatatcaggcagagattctcagctagcaatactaggaacctggggtcttgatgaatcaggccccaggcagcactgatcttctcaaatctttactggtgcatatattccacgccatggtaggttttagacagtgccattcagtgtattaccttattccgggattaacagttgctcttctacagaacaaaaccacatctctctcgtcctgtctcttcaggatccacagacttctagaaccctgacacttatctcaaagacgatccagaccctcggcagcttgtccaagtccaagtctgtaagcctacactcatcatactctctttatgactgctggggtgtttgggtttggggtttttttccctctctgtagaagccataaatgaaatgttttgcatacaggggagggtatgttcattacagttaagaggatagcgaagataattaaaacctgtgtctccatctctccattgcaaaactaaatggtccagcatgtcctgctgccaggacagagtcatgtgactctctttagccatgtgactgcccttaccagtcactgtggggaggctcaccggccatggtgatcggagcaggctcatcccactctttgaacggacaaggtagcagagccgcctcagctttgtcccaggacctttagccatagtaggccaggcgtatgatattgacctggctgtcctgggatgttggggctgaagacatagacccaggaagggtctgcagctgcccttcatccatatgcagcctttgtatctcgaacagcagcagatgccctctgacccctttggtcataagcctccattccccttcaccttgtgccccagacaaggttggtgctgaggtctctggtctgccctgaactcccgttcttccagacttaccttagctttgatccatgcccacagcaccaggcttcgtgaccacatctgtagctatttgtagctggcccattaacccagttcccaggtgtcagtaggcgtgtaaagatgtgctttgtgccagaggcttcaacgtagactccctagcaatctctacggctggtgttttagcatccctgctgcatgttgaagcctctaggtggggctgcatgcgctcacccatgtgatctggaattgccacacctgtcactgttacagctttcagatctgggccatgagcattagtgctggtgaacgccagcaggtgacctgtgatctgggccgtgagcatcggtgctggtggctctcagcagttgatccatttccttttaggccagttttaaggagtcgtacatggcgacattctatgaattcttcaatgagcagaagtatgcagatgctgtaaaaaatgtaagtgtcaccctcttatagacacagagagtttcccacaccctctccatggtcattcccaggacctgtctggccactttaactgaggctggtatgccagccctaaaattcaccattgactctcttcagagtctaatatggaggctcatcctcagttttttgtgccgaaggccttctattaagttactttctgttgccgtgataaaaattaaccacaaccaacttggggtgggggtggggttatttgtctgacacttctacatcactgtccatcactgaggggaatgctattggctggctcatttttcatagcttgctccgcttgctttcttacaccatccgaaaccacctgcccgggttggcatcgcctactgtgggctgtcccctcccacgccagtcatagtcaggaaagtgtcctacaaacacgcctactggtgaatctgatggaggcagtgtctcaactcagagtctccccttcccagatgtgtccaggttgtgtcaggttgaccaaaacttgccagcacaggtctcacgttgcctgtgtgtttaatgcccatgtgtgctgcccgagccccgacgcagtagagagagagagacccttcaggaccctgggcttggcttttgctctgccggtcagaagcaaacaacttctctcttggaagtcataaaagtcccggacagggaaagggtagaagcttagggtggccttcaactgatggagggaatacaaggaatggagcggtcacacaccaaagctggggacctcagccaggccagcggagctagtggggttccagatgggctaacacctccctcccatcaggacctcaggatgtaccaatagaacctgccttaggcccacgaagctctagtagcctccctagcacacttgtggctcctggtgacagtcccaacaaggtcacagcagatggacaagacctggaggggtggactgggctaatatactagagacaagagcaacaccccccaccctcaccccccgccccagctctcctaggactcacatccccagatctctccactgggttcaggggcagtctatgcatcccagctagggctccgcagcaacagacactgcccacacgtttcctcttctaatgatctgatctcctcctacctcagtttctggatttgatctcatcctcggggagaagggaccccaagagcatagagcagcccatcctgcttaaagaagggtaaggagttgacagttgagattgttgtgttcttgtgtacttccttctccatgccccccccccggccccttccaccccatagtcctgcctgaggggcctggggattgcatcctgcccttgtttgcatcaactctgacagacatgcctgcttcccatgagccctccccgacaccccagatcccagtccctagttgagactgtttggctaggtccacgtccctttgtgtctctttggctcaagcttgggccatccgtaggtaaccattaggctgccctacctgcatctattcctttttaatcaccttctactttaatcaggtattcaacaatacattcatgacaccatgtgatatgcatttcattcacaacctcaaagcaccaggtttgtctcatagttcttaacttagcacagtgtgtaaacggcttacaaacctcatgccggcggtaacaaacttgcagggtaactggcggttgcgggagaggtgcgccctctccagctctgccaacgcactgtcaggctgaagtcttagacttttacccaagacggaagcactgcctgttcctcttgagggtcacatcctcaggccgaatgctgccctacacggttagctgcagcagcatctacatccgtgtgcagtggtaactgtgccatgccgtgattagagagattcactcccacctctgccacggcactcctccgtccgttacctgccaacacagagccgtgaggtcagctctgcccatttcatcatgttccctgggctaagtcagccctgcttaggtgaggccagagggcctgactgcagcctcagctgatctctaaccaccaggaatgacgactgcctcttccacctcatagggaaaacgggtggccttagaaaaagtcactgcggcaggtggtacttgggtcaaaaaactgagcatgaagatttatgtgaatccattaccaaggaatccacaggatcttctccatacagctgcctagggccacacacacctcttcctctctccagtaaagtccaacattccacatgatgcagtgttcacaaattctatacaaaccccttatgtttacgggttgaagaacgttgtgttttctaagaaagtactagtacaaggtaaaactgctcaaaaaaaccaagatcgtgagcccttcatcttccatcttagcactaggaagtaaagtgacagggttctagtaccactgcccacccgtggctcgtgaggacagaggattgttatgaccgtgcgtgcgtctggaggtagcgcgggccctgacctgagaacactcagtaagcgccgtgtgccccttgtgtcaggttcatgatcaagcgggcccagggaaggaaacggtttggaatgaagaatttcaagaagaggtggtttcgcctgacgaaccacgagttcacctaccagaaaagcaaaggtaaagaggttttccattccctccctcagggcccagtaaagctgggaggctctgccaattaacagtgcaggccgactgtcacaggagcctgggtagcaggtgagacctaagagagactcagcctcaggcctctgctctgccccctccccatagaaccagagggtaccgagctgacgtggtaccacagaccctccgccccttttatctcctcaactgtctgtagcttcgcagccccagcacccttcttgagtctatcttgctccttcagagccccaaagtggtgattcaataaagaaaagaagggaaggcctaggggagatgctacttagcctggcctcgttgtaccttatcggatcaacagagtcccaggtttcagtgacagggagagtgctaaatggctctgccatgccctaggtctaaactggatggtgtgccccagtgctggagatggtgtgggccatgttcctgtgggcccgagtgagtgagacactgtcaccagttaaatattaatgttaaatagtcccaaggttccaaggtcctgcctttgtgtacatgctgtgctctgagagccccatgcctaccccagccccgcatccaaggtcttcctatcttcccagcctttgagaaggacagtcaccgctgggccttggggagcctcacacctggggcgtgcatctgagtacatctgagcccggctctcacaccttctttgctgtaggtgatcagccactctgcaacatccccatcgagaacatcttggctgtggagaggctagaggaggagtccttccgaatgaaaaacgtgagtgatggccccttccaacctgacaggtggttcctcctccgactctgactcctcctgttggagatgtaccctcccccgccaccctgcatatctaggccctggggactctgccacctgggcactcatacaccccacctccttctctatctggcccagtggtagaacctaccagaagctaggcaaacagcttggcaccagctggactaatagctcctgacccatcctgtgtgcccagatgttccaggtcatccagccagagcgtgccctgtacatccaggccaacaactgtgtggaggccaaggactggatcgacatcctcaccaaagtgagccagtgcaaccagaagcggctcaccgtcttccacccgtcggcctacctgaacggccactggctctgctgcagggcctcctcagacacggctgctggctgcactccctgcactgggtaggtccacggctccacaaccctgtttatgcaggcccagcagttggcttttgcactgcatcaggcgagtcaggttaggtactaagatgcaacaaacacctactgagaaaccacgggcacagagctgttctgcagggagcccttggtgtggtcttccaaaaggctctgcctaggctggtgggagctacaagccttcaaggttactaagtcctgcctgggacagagatgtcttcaggagcggtaggcttgtgtggagggtctgaagatggggcagggttctctgtctcttctaccaagaacatgaatggcttgtgcatccctgagaagatgctcagctcacagatgcctccgcccggtttctctgcttggaccacagcatatatccccttcttggaaactggggcaggccattgccttcctggccctgtaggtggcctcctgccatgaagattggcagtgccccttgtttgactcttacgtggcctgtgcacatagaagaggcactgccagcctcatatgacaagcctgaagtggaggactactcagggccacccaccctcaggctgccatttaaccctcccagagccttgacaccattatatccagcttcattagtatagagcccaggtcccaggagggcctcttctcagaatctcagatctgtgtgtgtggccctgtatttccagaaccctccagggaagggatcaagggttccctctttagtctgtgacaggagccagaccttcaaggatgagaggattcatagactcattgtgaggctattctgggtcattcctaccccatgtgcccccaaaagaccctttcccatatcactaatgagttcaaagtcccccccccccaacataaaaccagtgtttaagagaacattcaccgttttgtctctgctgtctttggacagtgggctcccggccaacatccagctggacattgatggggaccgtgaaacagagcgcatctactctctctttaacctgtacatgggcaagctggaaaagatgcagggtgaggatgggccctgggcacccactgtggggagttggaagtgggggtgtcagtcaccacagcagtgtccctcgggagcctctggggttccttggtgcctgtgggtgtctgttaagccacttaaggaccctggagcttggcatggttttaggagcaattggcatgagaatagtctggctgtgggacattataacattttcagatagaatttaacatgcaaactgtgaacttccaaattctttagcctttctcaatggcatctacacaaccaaaagatttcattctcttgtgctctccagagaggggtgtgtgtgtgtacgcacatgtgttacatgtgtgtgcacacatgtggatacacacacaactgtgtgggcacatgtgaatatgccacatgcctagcagcttgtgatacaggcatagtgcatgttgtttcaagtatctgttactttgccaccctttagatttaatttctttatagaattaaagcaaacaatctaggcaggatgaattggatgtcacctgagcagggtttgagggctgtaactcagagaaagttacagaacccaccaaagaaagtgaaccactcacccaccccagagtctcccatctgtccttagggattatgtgatgggccccgtgcaccactgaaaatgtccagtaaagccaagaactgggcctgccaaggtccttctctttctcctgctctggcccaggagcactggtacacgggatgggggtggatctccacagacctcatgccagtgcccacacgggagcccagccacatctgctctcccggcaccaccccatgtcgactagccttggggatacacagacagcgtagcaggcacgtgcacacatctacacagacagcgtagcaggcacgtgcacacatctgcacagacagcatagggcacctgcatgtgcccaccctgcctgggttcttgaacacagcatggactcatattcttcatatacatacctttcacatcttcatgcccagcaagcctggcattcacagcacctaccgtgaggatgcgtgcggccatggcctaaggccgctcagtgactcagtaaacatagccagctgtgggcagctccaacaacagtgactgatgcagggtaagagccttggagaggatggggcctctgcagaggtctcagagagtactgagggtgattacacctgtgcgtaggcgccttcctgatacttctagagatgctgcatagcctggggctcccctgcactgtggagctccattcctgtccccgggtccccatcctccctcaacctgggaagcctgccctcctcagcctgactggtgcctgctctccctgtgcattttcccagcctctgccgctcaacagtctgagctttgcctccatcactgcaagtacagctgcctcaaaactgtttgctatatgctgtgactgtctgaacaaaagatggtttatctgcaccagagcccagtgcagaggagatgccaacagctgttggttggttggttgatttgtttgtttgcttgggttgcttagttggtttggttggttggtcggttgggttggttggttgatttgtttgtttgcttgggttgattagttggcttggttggtgagtttggttggttgattgcttagtttggctggctggttggttggttgggtgtgttgtttattttggttgatttggttgggttggttgttgggttgttgggtttggttggttgggttgggttgattgattgattgattgattgattgggttggttggttggttgggttggttggttgattgatttgtttgtttgggttggttggttgatttgtctggttggttgggttgcttagttggtttggttggtgagtttggttggttggtttggttggttggttggttggttggttggttggttggttggttggttggatgaatggaatcatagatagacagatgggcagatgtacaggtagatggataaatgaacagatgaaaggacaaattgatgagtagatagatggacagatgagtaaatagctgatagatggacgtacaggtagctagacatatggctaaatggataatgctgatggtcagtggaatagacagatacctatctataaacaggtaagcaggtagacatgtggattgaccggaaagtggatggatggaaaaaatagaagagaactgttctcatattctcattcttcttgactgtaagggattggcctaagagtaagggcccatctagtgctgtgactgaaaccttggctctcacttcatctagcaccacgccctgtgaaggtcagaggctgtgaagcttacaggcttctgcctcatgacttagtgctgtcctggtgctgtcattgtattggtagacaatttgcttttgttttatttaaacaaaaacctcctctcagttcctgccccccatccatttccactccttttttctttctctctttctctttagaaagcaaacagtaggtaggtaaataaataaataaatacaggattaaaaaagaaaaagcacaaaaaatgtatgcacgcatacacacatacgcacacacccatcagatccggggattgactggggtgacttcggtacctggtaccagcatctcatacagaacatcaaaggtgaatcctaccaactgtcacttcattccacttgggtcagcaacagagaccagagcagacactggctgtgtgtctcgtagtcttcctgcatacagcagtcagccaggctctctgagacttgccctcatcatgtctccaaatgtcacgttcacctgagtcagagctctgaatgtggaccagcacctcgttctcgttctcgttctcagagggttggtcagtaaaagcatgtgtccggctgctcattttctacagattgcatctcagtcactgtgtagccatgctggtggccttgctaaagtctgcagacacacagctccctgaacacttggcttcataaatgccttggtttccttccctggtgcccacagaacatcctggcaaaagcatctttttcttttagtttgtttgtttttcgagacagggtttctatgtatagccctggctgtcctggaactcactttgtaaaccaggctggcctcgaactcagaaatccgcctgcctctgcctcccaagtgctgggattaaaggcgtgtgccaccaccaccctgcttggcaaagcatcttaaggaagaaaatgtttatttagctcagagttccaagttacagcccattattgcagaaaatcaaagcagtgggaacttagaacagctagtcacgttacagccacagcagagagcagtgaatcagtgtattcacaccagtgctgaacccacgttcccatgcattcaaaatctcctgcatagggaatggtgccgcccatagtgggtgggtcttcctaccttagttactgtaaacatggtattcacacacatacacacacacacacacacacaggtacacgtcaacctggtctacataatagctcattgatagtctcatcccagatgactttagactgtgtccagttgacaactaatgctgccccactccaagcaggctccattcccttagttgatttgttctcatttataccagtttttttctttttctctcctgggtcagaatcaatttaataatgcagtcagggattctgaatctgatggctggcttaagggctgacctctcggagttgagggcagccttgctcctctctgatttgcctttcaagtcgtccatccctgttttgagaaacatgtatagcaatagccagtgcctctctgatccagtcctgtagggcccaagctgtcatgcagcctgccttccttctaccctgtccactgttcccttagtcactgctggcaatttctgttgagtgagccctgctttgccccccagactctgttgagctaaggaggtgagtctgtagccagcaccaccctgatcttgctgggtgggggttggccagccccttggtgtgctcttccttccacacacaggatgggaaagccaggcatttcccaggtcctttttgtttaacagctccgttgacctacttccctcttccccgctttcgcagtcaggagcagcctgctcctccaacgcctcttcactgagaaacctccttggctgaatatccatgtcatgagcgagttctgtcttgcacggaacagatcacaagcccagttcagccgagttctttgtcacattaagatcgcctcctctctctgtctgtaactccttagtctctgtgtgagacctgagcagaatggcttcgactatcgatttctcggtgttatagcagcatggccctgctgctgctctcccctcaccagaactgccttgcctgtccagcaatgttcccagcagttgccagccccttctgggcgggtccaaaactgctcatgcacttgggtagctctagggcagctctcatcttttgtgtcttctgccttggttgctttggactgccataaactggttgttcatggtcatggtgacagagacctccttcttattgctctggaggctgggacatctggaatccagtcatcacactactagttctgggaagacaggtctgattgcagactgacttcccactatgcccaaaggtctggaagaagttcctttttacagagggactagtctcttccacaagggctctgccctcgtgattggaccaccccctaatactgaacttaggagttaagacttctgtatacaagccacacatgtgacacgtgcctgtaatccaagaactctacagacaagaagcagaatgacctccgaaagttcaaggtcatcctgatttacatactgagtggaagccaatcgcggctatacaacaaaactttagcttggcagttcccaacctgtgggctgagatccccttgggggtccaacagccctttcacaagggatccctaagaccaccagaagacagaaacatttacattatgattcataacagcagcaaaattacaaaaaattagttatgaattagcaatgaaaataattttttggtgtgtgggggctcaccacaacgtgaggaaccgtactaaagggtcatagcattaggaaggctgagaaccactgctctaactcaaaaaaccaagctaaccaaataagcaaagacttgaacatataactttgaagggaaacaagctttcattccatggcatatgcaaaactgtaggtagggcctgggtaccttagcctgggcactgcctagccttggacaatgaggcagaatagcataccaactcagatattcagggtcaggtgagtaagggcagctctggtgcctgggtagtccttgttgatggccagaagccataacatggctgcagtgggggtgattaggaaggcagtctggggagaagatgagaacagtagagaacagagatccttggccactgctcgacacgccttctctcctgctgccctcagagctgacgtgttctggccagaagcctctggtgagtggcatgtgtcaggctctgtagacatgcagaatggaagttcatcccgacagcccctgcccctcagagagctgagccccatgtgtgggtgtggacacctctcttggcttgactggtgggcacaccgggtcatgaatgtgaagctcacgccatgaccggctgaagaccatactgaggcttggggtatgaggtctcagaacataaactggagagaccttgactatacagctcaccccgaagtcctccaggctggacagtgtttgactcccgaagtggcccctttcttttctgaggggaagaaaaagcttttttggggagggaatgcagagacgtggcatggctagggacagcggaatcctgagctacaccccgtactgacactcccctctacgcataccccttgcgtggcagaggcctgcggcagcaagtctgtgtatgacggccctgagcaggaggagtactcaacgttcgtcatcgacgacccccaggagacgtacaagacgctgaagcaggtcatcgctggggtggggacccttgagcaggagcacgcacagtacaggagagacaagttcaagaagacgagatacgggagccagtgagtgttggggtgctccctagccactggggttgatctagagatcgggaccttcagtgagcgtccacctcatttgggagggtcctggggtcccatggagttcagaggcctggcttgccttagccttttgtctgctgcagagcaggtacccagctctgtggtgtgcagggagctagctccatcccaccagcagcccagtttagggccttagaaggagcctggggccacccatctgccatcacacacatcctttgccacctcttccagccaccgggggctctgaatgctgggtcactaagccgagcacattcttgtttctggttgaggtaggagaggtgtagctagaggactcaagccagattgggacatcccgcttctcccgctctggtcatgtggccccaggtgggtcaagctttacagctgaagagttggagatgaagctcaggtccataaaggctgagacagctcctgacccacattcagcaggtggtgtggtactatgtccacccaaggactgctcagggacttctcccaaagtacatgtgggtgacccacagggagctcagaagcctatatgccctcagctgatgctcagaaacaataagaggatccaatcccaactgtattagagatggccatggccctcgtcctgactatccccatatactcacagggcaagggttagcatctgcagatggtgctaactctgacttacctgcactggatcccagccagtctcatcatgcttcccgatcgatccctttggacacacccgtggtggcccacatttaccttctgaaaacattgctctgatcgtattaaacatgcatgtcagcctcccggtgcaaaactcacaggctgagaatagtgaggggcttcattccgcttctcatggcgggagatggggtgtgtactcaccatggaacaacagctaccaagcacccacaatgctttgggccctgtcccagcatagagcatctaccagcacacaggaagacaaagccatgccctctcagaacacatgcccacatcttgcaagtgatgcatacttcatgcagtatgcatgtgtgtacacagcccacatatgtccacactaacatgtgcatatgtctgtgtgcacgtgccacacatagttagaacccacagcccatatgtatgtatgtatgtatgtatgtatgtatgtatgtatgtatagtgtgtatgttctaaatgtgctccatacacacacacacacacacacacacacacatgacatgtacacacgtgacataccatccgcaggagaaccctgagtcacagtgagtgcttccttggagttggcgctcactgttctttgtggatctgcactttccatgtgtttttatgatgaatgggcagcacagtgacagacaacacaaagacaattaaaagtacagtggttgttggggtgtcaggaacaggacctcattttctcctctctgctcgctctccagggagcaccctattggagacaagagcttccagaactacatccggcagcagtctgagatctccacccattccatttaaggtcacagcacctcccagatcagcgctgttgacccacaccagggggaaaaagcagataaaagaaggcagaaggcatacatggagaggaaacatgttcacccgttcacacgggtcctaccaagctggtggggccaccacgagtcaagcatgctcttccccggcaggaactgttgcctgggctgtgcactccccttagctgccagcacaggtggtctgagccatcctggaatgtatgctcatctgtctttctactccttcagttgtatggggatccagggatctgttaaatattagggaagtatggactttgtctaaacctgttccctcgcagcccggtcccccttcacaaaggcacgcctggttcgttcatgccagggcgcaccttcttcagtgtgcactcttgtcccttgcctgctggtctctgtggctccgtacacatgtagcagtctggccctagccttagacgtacacgcaatcctgccgttcgttccacggaatccctgtctgaaacgtgagaagcagtattccctggcagccagcaggcaggcagcctttctcctgagcttatgttggtttgttcctggctaaagggtcatttttgtggctgggatggacaggatggtacagaaactcctttatcttagaggacatgggggtccttttcttagagtccctggagagggagggctgtgagcccagtcttctctgggtgaccatcacccctcagttcaaacacaggtctggatgttggataaggtttcaaactagaatccacaggcttgctgcctcgatgaaagtctgggaaagatttttaaaggctgtgcatttttcaagctgtctttcttaatgtttttaaaggactgtttttaaatagcattttgatataaggcagtgtggaataccagcatctatgtgcattaggggggtgacccagggaaatccaaagggaacagtatttgatttctcacaaagccaaagggtcctcggggacatagctctgagatggagcctgcaccggcagcaataaaggccaaacgtggtattccacatgcctgtgtctctgtgagcccaacaggccacacatgccaatgtctggaaccacttttgattggggtgggagggtcctgaaacagacaagacagactgtaccagcttagcccccacagtactgctggagccttatgccaaactgcatttccagaggctgagagaggggcactctatgggcagatgttgctgaaggacacaaccacacattctggtacccttttctcttcattcttgttgggaggtttaatctgtatctagaacccatagtagcagaggatggaaacaaaagtcagtttggacacagcaggccccttgtactgaacttctttttaacttggatttgtaacttaatgtttctgtttataagatactaacgatttgcaatgtattttaatgggcaattaaagcagatgttttattctttctgtggagtggtttggattcccagaggggagcaatgtagaggaggttccctacaggtagggtggcagataaaggtggttggcatcaatgtcagaccagacaggtggcgttcctggaagcatggcatggaaaccccgcgctaggatgaaggatacggtggaacacctcacccccctctcctctcttctcctttggttttcactcttttctttccctttttaattccaatgggttaaatgggagtcaggcccattaaaagaaaagtctggagtttggctttgagagcaatgagtttttctctggggactttctggggccaagaactcaggccaggtgcttcccaggacagggtgaagctggcttgggtcactggttggtctccactggccacagaggagtatggagtggaccaaggaagatatgaccctactccttggcctcttgtctgacagggaactcccaggaatggagtatgggatgtctgctgccctgaccacaggcatctggaagcaaaacaacaaacaaacaaataataaacaaaacataaacaattggacaatactaagacagagggttgacctcatattccagcacacctaatctgagatcagctcacactggaacatacccactcagggctccaatcacacccaggcatgcctagttaagactcaagtttactctagagtatgcccagctaaggtccgactcacactccagcacgcctagtcaggcctgggatcattgagagtaggaaggttcacacttgtctcatcagttaagaactgtgatgctaggaacagaccagtccctgtggggaggagatacagagaatggaccaccagggttcttctgttcagctgtgttagttcaagttgtgccctagcaccaatctgctaacggcatcacaccagaaacctcaggcacgccatatttgagaagggggtcttgggcagttataaaactgaaataaggtcaccagtgtgaatccaagtttccagaaagaacagcagcctacactgaacatctgtgaggcggatgaaccgttaagactctatgcgtgtggctaggttagaatgttgcaaggccagagcctaattacaatttatattgggccatttttgttgttgttgttgtttctgtaggataccttaaatacttcaataaggaaacatttgcacttaagatgaaactattattagagttttttttaaaccactgttacaaataatatttggtccatgggaaaagtttttttttaagtttttatctgtttatgtatgtattttgagtgcctgtgtgtattttatttgcatccatgccctgtatgacagaggaggatatcacatcccattacagatggttgtgagccaccatgttggtgctgggaattgaactcaggacctctggaagagaagccagttgctcttaacctctgagccatctcttctgccccaggaaaagaaaatcttgttaagagaaaatttaaaggaatattacattatgaaatctcttctgtaatgtgatttttcatttacctttccaaggtaaatctggtaggatgccaatgtaatagtatccacaggtgagaattatgataatttagatattgaaaccacgttttccccttttattaaaaatagatttttggccaggcatgacacacgcctttaataccagcacttgggaggcagaggcaggcggatctctgtgagttctaggacagactggtctacagagcaagtcccaggacagctagtgctacacagagaaaatttgcctcagaacaaaaaacaaaacaaaagatttttcttaatgtatcctgatttcggtttcccctccctctgctcctccagttccctcccctctcccctcccctccggatccattccctttctgtctctcattagaaaagaacaggcttctaagaggtaaaagccaagcattacaaaatgagatataataaacagaaaccgtcacatcaaagttggataaggcaaaccacagaaggaaaagaacccgaagagaaaagagtcacagaccctctcattcatatgttcaagaggcccataaaaacactaaactgaaagctaatagatacccagaggacctggtgagagactagtttttcttaagaattagagctgaccatgccacacagcagattagcgctgtaagtctggctggaagaaaaactaaaattatgagataataatctaaatattccaagtacaaaaaaaaaagagtccatagagtataaatagctgtaggagaaacatagagtcaatctaggaaattgtttgtttaaagggcccattttcctcagtggtaccttcactctgagataatgttctgggttattttcattttagatatgctattattagatgtcccattatgtcaaatacagacgattcttttaaagaaagcatcagatcttagtcatgatggctagtagattttaataatatgatccaggagtttcttccttaacagctttaccaactgctcaagccatccccacatcaggccctaggaagtcttccctgtagccaccggacattcataatacttaataaacgatatgtgatacttggccaatagagagaactataaacagggggccctggatggaccaacaccttgctctgagccttcccaggctataactaataaaaacatcagtgattatggaggggttagaatgttgcaggtctggagcctgattacaattcctcttgagctctctttagccaccttaatagccattccttgccaacctcacagcctgtggctaactggagcaaccttttggaatgtattaacaaaactctagtttcacccaaccaaagggctacgaatgccttgggacagcatctgcagcccagagccgagattctctgcctttctgtagacatctttttacaatgtccaacagtgtatttgaaaagtgcttttgttcctgacttcctttgtcctgctaatataaaaacttcatgggctggagatacttcagtgctaagagcacatcttgctattagagtttagttccccacgctcaaatcggatgcctcgtgactgtctgcacatccgggagatccagcaccctcttctgggccacgccagcacctgcactcacatgcgcgcataactagaatcgagtttaagaaactatagttattaatatgacacagccagtcccccccccaataaccgaggcagagtcctatggattatttcattctgtcttgtacaattattggggaattacccctaatctatatttctatagattattatacttaatttcccagctgcactcccccaatacttgcggtttgactcttctccagtcgtatctgatctttattgatctttaacaatttggaaggactccatagcttttcttttcctatggaacaaatgtaaaatctcccaacataacataccttcttttttctgcatggagttatttttatttttatctgctaatctaatgcagcaatcctttctaacttcacgtggctgcctgtattgttctcagctgctctcctccaaagcaaaaattggctgttcgaatcccacctcagttacttctggtccagaagtctgacctggggttgggggtggggtgggggtgcgtttcatttgggcacctgatcctgctccatcacatgtaatgggagtctccggttccctcttcatccaccctctttctcctcctcgtggtccccacctgcaacccccagcccagtgtctgaaaccgcatctttcatattctccccagtaactggctatagccacctttatttagccagtggttttaaattggggagcaaggttttcatagcatcactggtatacataaggatctgctcactgggcacaaccaggtcttgggagccagtatttagcatttgaatacacagcagcaccagaccaatccctaacacgtatccacataacacatatccacacgcagacatacacatactcataatttaaaagaaaaaaatttgtccaacggttagtaggttggaacactgagtttgtgttcgtttgaatgtgctctgaggcagtggtcacttgtatttagctgtaaagcaaatgtctatcccctcaggggagagttgtatgctatgttggcaccaggggggagccccaatccactgtgtttgctgtcatagaggagctgaagaaacagattggggggatagtccatgaagatgacatctgtagaccctgggagaggctgcaggggagacatccctgcccctccttgatttctagccttcagctgggagacatgttcccaactgaggtcgaggtcctgtgtgggcaggtttctctgtctgtgtaagtcatcaaaatgtctcccaccaagccctgctctcagtggtaagttttgacccacgggcctgaatgtaaaccagatcacactgccccagggccatttattttcctgactctgcttcctgccatcctcacgcccatagaaacaggaagattctcaaatgggagagagcactggcttcaggagcacacatttgtgagacactgccatttagaagcccctcgctgttaaagaataccgaagtacaggaaagtggcagatagcaaactgccaaactccaaaaaaaaaaaaaaaaaaaaaaaaaaaaccaaaccaaaaaacctagagccagcatgacctctgggacagccctcaacaaccatccagctctatcttgtgatgtcacagcagcgtcatagcaacagtgagtgagatcgcgctggaccactttgctggcagagaggcagggagaggctggcagagatgcctttggtctgaggctgtgctggtgacgccctccttccctctgggtcaggatggagaaggaccccgccgcgcacaggaagcaccggcctgggcctggcgccctgccctcaggaataacccctgcatacctcaaggccgccagtgacggggcggaactccagaggagcaggagtgtgggtggcttgcaccagaagggggatccaccagtctgcatcaggaagctgctacgcaaggagctaggtaaggggtggctccctcctggaggactgggagggcaggcagacctggcccagccttaagaaagtacagtttgtggacatctggacatgggcagtaggtgtatcatgcaagacacattgccattaggagaaggtagctggtttccaactccagaactgcaccaagcaatggaaaccctgcctttcttttgaccgctctttgcttggggcttttcttaataagaaagatcagggctggaagagtctcctaatagttagcgtcttctggaacacagtcacatgtgtacatgtttctgggagtgtggggagcttccagtccttttatcttacatatgggtgttttgcctgcacgtgtgtatgtacactatggacatgcagtgctgcagagaccaaaagagggccttggatcccctggcattggaattagacttgagtcccatgtgcgttttggaaatcaaaattgagacctttggaattacattgagcaccgtttctccaaccctccccgtccatttttaaatcttctgaaaataagtcaccagcagacctcctatcaggcaccttcattatttgaccctctagactgttatctgaggctgggattgaactgaaacctacccttttttctccctggggcatgtgagaactgccaaggtctgaattacagtgcagagctgtgtaacatccctcagccctggccagaaggcctcagccttctgcttctcactgttgggacatccacagatgtcaacaactctgagtacagcacttcagacaatgcagagacaagcacgggatctcctgagaaagggacacagggtacagaccaaggccaggtgtgctaagtacaagaagggacaggctcctttctggaaaggaggcaggtggctaagcagccggcatctctatgagagaaggcatgggagattggggtgaggtttgaaatggatggaaagactaagaggatcaactggtgaggaagtttgtcctgtacttccctcaactagcctgcaagttaacccccaggaaagggccagccagctctgtaagggagccctccaactcacgctctgggcttgatctataagaactcttctctagcactttggaatttctgtctgagtcacaaagccactgtggggaacaggtaattccagctgaggtctggcccagacggcaactctgggggagagcccagaatatagcctcaaagacgttatctgtgcacaactcttcccattgaacactatgctgaactgccaggtccctggaagtttgggggaggaagttacatgcagaaggagtacgccaagttggaagagctcacagccaactagcgccctccctgcccccaccccccaaaaccaggatcacctggcacagctccctacagttattgctctgaagctagggaattcatgtcagcttgttagggtcccctcagccttgagcacattcaaggtacctcctgcctgataggatagaggataatcaagatcaccccaatgatgggcctcagcgctgtgaggcatgggggtcaggatgttcctgaacaagtcatcccatttccagccagtggccatcttgggaaggtcccttcttatctcctgttctgcctcttcaataatccacactgagataaggacatttgcaggcctgtgagtgtgtcccaggaggccagggatgcctgggctgggtcacaaacatatactaagaaagcaatggaggttgtgcttttacaacaatgcatgaagtgggctcagagtgcaagctcggtcatggaaggtgttggggcagaaggaatagacgtatccttggagcatggccaaaggagccaacaaagatgagaaagggaagtcttgctagctatggctgttagtctcaggctggccttgagcctgccccgaggagaaccaggcaggacagtgagcctgtgagatagcaaactgtgggaagtcctagatgcaggagccgtcgtatcatgtttagaatactcacatattaaccaactgcccttgctcctcagactctgaggaccaaggcaaagacccaagaagtgacacggatgacggcacctagtaagtggaagcggccttcttctgaaatgtgacaattggggtgtggggagtgggcttggagccctccactgggggttaggacttaggtgggggtggagggacccaaaggaaactgaatcctttgaataaagggatggttggtagggttgagaagcctctttatccaagagacttgtcataaaagcagaagccaccgtagtgtgtctctaaaccgcagatagcattcttcacttcctaggcagcccttctggctggtccttgtctgccatcgagctgacttggtggtagtatctcaacaaatatctccatgtgcctctcccagaaaggaatctgcaccctgtctcatgtcagctgggcccatcgagatctccttgctgagcagggagggtgcataaccagcctcggtattggtcagctagaacaagatgtctggccacctaacacaggggccatccctcaatacttcccaccatctgccctctagagggcttaaaaatcatggaacccaagggctttcctcagttctcaaagtccattcactgtggaccaggaacaggccagaccacttgtttataaatgacttcccatgatccagtaccagtgaaaggtactagactaggaaatcttgaggtagaaggatgttggcgactaagaagccactgaaggtgtcattggttgctggaactgggtaccaacatgtcacataggcctacggcatccctctagactcagataaaggacagggactttgggtaatgtaaccccaaatatgtcaaaggccagcagctatcttgagtcttccctttgggaactgtagctgtgaggaggcagctgtgttccccgttcctactccagtcccccaaaccacactcaacaaaacacacggggttgggagctactaaggtggtcatgagtgacaggcatggatccattcactggtgccctaactaaagtctctacctggagggagtggggctggtgtctccagacaagatgaatcgttagagggaataggagggtctttctttttgcctccaaagggcccatgggtataccccactcctagcattaggggaggagccaggaagacagcaagtgactcctgtcctgacacttattctacactgcttctttgacgcccctatcacacttacctccagtcgggtgagcctagaggacgacaggaagaaagggagccaggatgaggtggaaaaaatggacctcaagtgtgcaaaaatggacccagagaagagtgactcagaggccagtgccacaggggagcaggacgatgcctgcaaaggacgatgtatctctgcggctgaggtcaggccttggtggtccacccactctgtctgccatcctgtgaggtgtccctctacttagctattggtgtcttcttgggtttacaggagcagcattctgagtccacgaagctggatcaccttctagaaaagcaggcaagagctgcttactttagctacaggagttaagatatttaagtctatctgtagacaaattccagtgggctatgagcacactgtaggcttagcccataaagccatctaagcaggtgctgtgctgtccaactgagctggtaaggggttgagggaccaagctctggactggatttgcctgatcctgcaacatcctgccctagcttgccaaacaatgaagtcactaacggtgtggattgaaaagattccaccttccagttgagcttagcccacccagagacccaaacccaggtgtggtgactgaagacacacctgaccttggccactgaggtgcatcttccatacatcatactgaatcataaatctcgcagtgaccttcatgaaggaaggtagctttctcctctttcccaacccgtgtcacatggaaaggtggcagtagcacccattcttcaccaggactttacaaaagatagtccttggtaagattctgggccagccaaagtgccaaacagagaacaaggtggcatgtcctgagctgttggatcatcccatcttgtggagtagatctcatgtcagtgaatgtggctctagacaagagtatggaggtgacccatgtgctcccagtagatcagggatgaggagaggtccccaggtctcaggtaccttgtcacctgaaggccctaacaaccaaagtcaagaaggaagaaaccccttggaatatcagtaacttgtttccaataggtagcaatgaggcagaagggcatactcccccctcttctgcccagagctaaccctctggacactttgctgtctgttaccatggggcctctgtaatcaccagaatctagtggaaccactcaggcccagatgtctacaaggctgcattctgtcaagctcactcataaattatcacttccatccttagaaaccatctgtgtttgtggagatcgacctgggagaccatactgaggaggaggtacaggcaaaacccttcagcccagaaatccaaactacccactgggaaagtgtctgcactgtgggctgggacataactgacacatgatgaagcgggaggagagatccaaggccaggcattccagggaccctccatggtgctggtgctgaggaacggcctttgggaatagaatgagaacacctatgttctctctctctctctttctctgtctctgtgtgtctgtctgtctgtctgtgtctgcctctgtgtctgtccctgtctgtctgtatgtctctgtctctctgtctcaatctttgtctctctgtgtctgtctgtgtgtctgtctgtacgtgtctgtctctgcctctgtctttgtgtgtgtgtctgttcctgtcactatctgtctctgtctctatctctctgtctttctgtgtgtctccgtctctctgactctc

SEQ ID NO: 1364 - DNA, 3805 bp, Mus musculus
gccccttttacggagaggacttttactgtgaaatccctcggagtttccgccacctgtccttttacatttttgatagagatgttttccgaagggactccatcataggcaaggtggccatccagaaggaagacttgcagaggtaccacaacagggacacatggttccagctgcagcacgtggacgcagactcagaggtgcagggcaaggtccacctggagctgagactaagtgaggtcattacggacactggtgtcgtctgccacaaactcgctgcacgcatcttcgagtgccagggtctccccattgtgaacgggcagtgtgacccttacgccacagtgacgctggccggacctacaggtctgaagcaaagaaaacgaaggtgaagaagaaaaccaacaacccccagtttgacgaggtgttttattttgaggtgaccagaccctgcagctacagcaaaaagtcccactttgactttgaggaagaggacgtggacaaacttgaaatccgagttgacctctggaacgccagcaacctgaagtttggggatgagtttctcggggaactgaggcttcctctcaagattctgcgacactcgagctcttatgaagcctggtacttcctccagccccgagacaacggcaataagagcctgaagccagatgacttggggtctctgaggttaaatgtcgtttatacagaagaccatgtcttctcctctgagtactacagcccactgcgtgacctgttactgaagtctgcagatgtggagcctgtctcagcctcagcagctcacatcctgggtgaggtgtgcagagacaagcaagaggcagccatcccgctggtacggctcctgctgcactatggcagggtagtgcccttcatcagtgccatcgctagcgcagaggtgaagaggacccaggaccccaataccatcttccgaggaaactcactgacatccaagtgcatagatgagacgatgaagctggcaggcatgcactatctccatgtgaccctgaagcccaccattgaggagatctgccagagccacaagtcctgtgagatcgaccctgtgaaactgaaagacggcgaaaacctcgagaacaacatggagagcctgaggcagtatgtggatcgcatcttcactgtcatcaccaagtccggggtgagctgccccaccgtcatgtgtgacatctttttctccttgcgggaggcggctgccaagcgcttccaagatgacttggatgtgaggtacacggccgtgagcagcttcatcttcctcaggttcttcgcccctgccatcctgtccccaaaccttttccagctgacaccccaccacacggatccacagacttctagaaccctgacacttatctcaaagacgatccagaccctcggcagcttgtccaagtccaagtctgccagttttaaggagtcgtacatggcgacattctatgaattcttcaatgagcagaagtatgcagatgctgtaaaaaattttctggatttgatctcatcctcggggagaagggaccccaagagcatagagcagcccatcctgcttaaagaagggttcatgatcaagcgggcccagggaaggaaacggtttggaatgaagaatttcaagaagaggtggtttcgcctgacgaaccacgagttcacctaccagaaaagcaaaggtgatcagccactctgcaacatccccatcgagaacatcttggctgtggagaggctagaggaggagtccttccgaatgaaaaacatgttccaggtcatccagccagagcgtgccctgtacatccaggccaacaactgtgtggaggccaaggactggatcgacatcctcaccaaagtgagccagtgcaaccagaagcggctcaccgtcttccacccgtcggcctacctgaacggccactggctctgctgcagggcctcctcagacacggctgctggctgcactccctgcactggtgggctcccggccaacatccagctggacattgatggggaccgtgaaacagagcgcatctactctctctttaacctgtacatgggcaagctggaaaagatgcaggaggcctgcggcagcaagtctgtgtatgacggccctgagcaggaggagtactcaacgttcgtcatcgacgacccccaggagacgtacaagacgctgaagcaggtcatcgctggggtggggacccttgagcaggagcacgcacagtacaggagagacaagttcaagaagacgagatacgggagccaggagcaccctattggagacaagagcttccagaactacatccggcagcagtctgagatctccacccattccatttaaggtcacagcacctcccagatcagcgctgttgacccacaccagggggaaaaagcagataaaagaaggcagaaggcatacatggagaggaaacatgttcacccgttcacacgggtcctaccaagctggtggggccaccacgagtcaagcatgctcttccccggcaggaactgttgcctgggctgtgcactccccttagctgccagcacaggtggtctgagccatcctggaatgtatgctcatctgtctttctactccttcagttgtatggggatccagggatctgttaaatattagggaagtatggactttgtctaaacctgttccctcgcagcccggtcccccttcacaaaggcacgcctggttcgttcatgccagggcgcaccttcttcagtgtgcactcttgtcccttgcctgctggtctctgtggctccgtacacatgtagcagtctggccctagccttagacgtacacgcaatcctgccgttcgttccacggaatccctgtctgaaacgtgagaagcagtattccctggcagccagcaggcaggcagcctttctcctgagcttatgttggtttgttcctggctaaagggtcatttttgtggctgggatggacaggatggtacagaaactcctttatcttagaggacatgggggtccttttcttagagtccctggagagggagggctgtgagcccagtcttctctgggtgaccatcacccctcagttcaaacacaggtctggatgttggataaggtttcaaactagaatccacaggcttgctgcctcgatgaaagtctgggaaagatttttaaaggctgtgcatttttcaagctgtctttcttaatgtttttaaaggactgtttttaaatagcattttgatataaggcagtgtggaataccagcatctatgtgcattaggggggtgacccagggaaatccaaagggaacagtatttgatttctcacaaagccaaagggtcctcggggacatagctctgagatggagcctgcaccggcagcaataaaggccaaacgtggtattccacatgcctgtgtctctgtgagcccaacaggccacacatgccaatgtctggaaccacttttgattggggtgggagggtcctgaaacagacaagacagactgtaccagcttagcccccacagtactgctggagccttatgccaaactgcatttccagaggctgagagaggggcactctatgggcagatgttgctgaaggacacaaccacacattctggtacccttttctcttcattcttgttgggaggtttaatctgtatctagaacccatagtagcagaggatggaaacaaaagtcagtttggacacagcaggccccttgtactgaacttctttttaacttggatttgtaacttaatgtttctgtttataagatactaacgatttgcaatgtattttaatgggcaattaaagcagatgttttattctt

SEQ ID NO: 1365 - protein, 669 aa, Mus musculus
PLRHSDAGRTYRSEAKKTKVKKKTNNPQFDEVFYFEVTRPCSYSKKSHFDFEEEDVDKLEIRVDLWNASNLKFGDEFLGELRLPLKILRHSSSYEAWYFLQPRDNGNKSLKPDDLGSLRLNVVYTEDHVFSSEYYSPLRDLLLKSADVEPVSASAAHILGEVCRDKQEAAIPLVRLLLHYGRVVPFISAIASAEVKRTQDPNTIFRGNSLTSKCIDETMKLAGMHYLHVTLKPTIEEICQSHKSCEIDPVKLKDGENLENNMESLRQYVDRIFTVITKSGVSCPTVMCDIFFSLREAAAKRFQDDLDVRYTAVSSFIFLRFFAPAILSPNLFQLTPHHTDPQTSRTLTLISKTIQTLGSLSKSKSASFKESYMATFYEFFNEQKYADAVKNFLDLISSSGRRDPKSIEQPILLKEGFMIKRAQGRKRFGMKNFKKRWFRLTNHEFTYQKSKGDQPLCNIPIENILAVERLEEESFRMKNMFQVIQPERALYIQANNCVEAKDWIDILTKVSQCNQKRLTVFHPSAYLNGHWLCCRASSDTAAGCTPCTGGLPANIQLDIDGDRETERIYSLFNLYMGKLEKMQEACGSKSVYDGPEQEEYSTFVIDDPQETYKTLKQVIAGVGTLEQEHAQYRRDKFKKTRYGSQEHPIGDKSFQNYIRQQSEISTHSI

SEQ ID NO: 1366 - DNA, 172569 bp, Homo sapiens
  misc_feature (1)...(172569): n = A,T,C or G
gagctggtgtccactcccacatagtcctcttgctttaaacggttctcttttgagataattgcagattcacacacagtcgtaaggaataacacggagagtgcctgttccctttgcccagttcccccaacagcagcccctttgcccagttcccccaacagcagcatcttgcaaagcaaggagtggtcaccgatgggatcaagtgccctgagggcggatggcaccagctgcacatacactgggtgtgagcgtgtgtgtcagtgtgtgtgtgagcatgggggtgtgtgtgtcagtgtatgtgtatgggtgagtctgtgtgagtctgtcagtgcgtctgtgtatatgtgggtgtgcatgtgtgtgtgtgtctgtgtgcatgtgggtgtgtgagagtatcagtgtgtctatgtgtatgtgtgcatgtgggtgcgcatgtgtgtgtcagtgtctgtatgtgtgcatgtgggtatgcttgtgtgtgtgtgcatgtgggtgtccgtgtgtgtgtaccagtgtgtctgtgtgcatgtgtgcatgtgggtgtatttgtgtgaggagcatgaatgtgtgtgaaggagggagtgcatgaatgtgtgtgcatgtctgtgtgtgtgcttgtgtgtgagtgtgagggactgggagtgtgtgtgtgagggactgtgtgaccatatgtgcatgtgcgagtgtgtgcatgtgggtgtgagggaggnnnnnnnnnnnnnnnnnnnntatgagcgtgagtatgcttgtgtatgtgtgcatgagtaagggagtgtgtgtgccatgtgtgtgagtgcatgtgggtgagggtgtgtgaggaagtgtgtgaggatgtgtgtgagcatgtgcacgtgtgtgcttgcatgtgtgagtgagggagggtgtgtgtgccccaatgaaggagggtgtgggcatgtgaggacatgtgtgagcatgtgtgcatgtgtgtctgtgagggagggagggtgtgtgcatgtgagtttgtatgtgtatgtgtgagggagtgtgtgtgcgtgtgtgagtgcatgtgagggaatttgtgtgtaaggttgtgtgtgagggagggagtatgtatgtgcgcatgtgtgtgcacgtgtcattgagggagtgtgtgtgcacgcgtatgagtgagtgtgtgtgtgcatgtgtgcgctagcgtgtgtgagtgagggagggtgtgtgcatgtgagggagtgtgtgtgtgaatgagggagtgtgtgtgagcatgtgtgcatgtgtgtttacatgtgaagtagtgtgtgcgtgtgtgtgtgagggagtgtgcacatgtgagtgtgtctagttttgggcagttgtgtcccatgtgagtgtgtgtgtgagggagtgtgtgtgcatgtgtgtgtgagggacgagctgggcagttgtgtcccgtgtgtgtgtgtgtgtgtgagtgtgtgtgtgagtgtgtctagagctgggcagttgtgccctgtatgcagatctctgtgcagatgccggacatttccatcccacgagcatctctcctgctccttttccagccacagccacctcctgcccctccctgacccctgaccgctgacacccgctgctctgctttccgttgctgtgactttgtcagcttgagactgtctcccttcactcagcccagttcccctgaggctcacctgcaacactgtgcacccgctcgcttgctgcttttcacgcagttcactctttacctgctgaaggacagcttgaaggttgcctccagttttctgccattacaaataaatctgcggtgaacgtttgtgttttttatgcatcatgtattttgaagggcattttcctcactctcctaatccacagccttccttgtgggtgggaggaggctgagcctgggcagactgcgggggctccctggggacagcacccacacttcggcttctcttctgtggtcctggtgtggtttatgtacgtacaagagttagatctgcaaatccaccaggggcccgacacagtgtgcagtgctgggaggatggcagagaggaaaaatgcctgccagtgctctcgggaaaaataaccacgagaaaagctacctctagccgactgtttcttatctgccagacacaggacacacagcacacgcagcttggtcccggcacaggcctgcgggcgggcactgctgccagccccattttacagacgaagaaattgggagacaatctggggagatgagttagcttcacaggaaactatttgaagaaataaaagtaattgacgcggtggttcacaactcctaagtataatgaaagcagccgcgatcgttgtcacagtcaaggtgccagggatttgtgggctgaggggcattcatcagcacccacggcttctgcgggcctgggggcgggggcgtgagcgtctccctctgctctcctgccctgccctgcacaacctggtgaatttcctgtcccacccgctgccccacccctccctgaagcagggaggttggcaactgagcttgtgaggctcaagggtacctaggatgggccactcggaggggagggcagctctcctcggccatcacagccagaaagtgggctttgagtgttccgtgtggtgctgccaccgtgtctacacccacctccaccgtgtctacacccaccaccgtgtctacacccacctccaccgtgtctacactcaccgccaccgtgtctacacccaccaccaccgtgtctacacccaccaccgtgtctacacccacctccaccgtgtctacacccacctccaccgtgtctacacccaccaccctgtctacacccacctccaccatgtctacacccaccgccgtgtctacacccaccgccactgtgtctacacccaccaccgtgtctacacccacctccaccgtgtctacacccaccatcgtgtctacacccaccactgtgtctacacccacctccgccgtgtctacactcacctccgccatgtctacacccaccaccatgtctaaaaccacctccactgtgtctacacccacctccaccgtgtctacacccaccaccaccgtgtctacacccaccaccgtgtctacacccacctccaccgtgtctacacccaccgccgtgtctacacccacctccaccgtgtctacacccacctccgccatgtctacacccaccaccaccatgtctacacccaactccaccttgtctacacccaccaccgtgtctacatccacctccaccgtgtctacacccaccaccaccgtgtctacacccaccaccgtgtctacacccaccaccaccgtgtctacacccaccaccgtgtctacacccacctccaccgtgtctaaacccacctccatgtctacacccacctccaccgtgtctacacccaccgccgtgtctaaacccacctccaccgtgtctacacccaccaccactgtgtctacacccaccaccgtgtctacacccacctccgccgtgtctacacccaccaccactgtgtctacacccaccaccgtgtctacacccacctctgccgtgtctacacccacctccgccgtgtctaaacccacctccgccgtgtctacacccaccaccgccgtgtctacacccaccaccaccgtgtctacacccaccaccaccgtgtctaaacccaccaccgtgtctacacccacctccaccgcgtctacacccaccgccaccgtgtctacacccaccgccgtgtctacacccacctccaccgtgtctacacccaccaccactgtgtctacacccaccaccgtgtctaaacccaccaccgtgtctacacccacctccaccgtgtctacacccaccaccaccgtgtctacacccaccaccgtgtctacacccacctccaccgtgtctacacccaccgccgtgtctacacccaccaccgtgtctacacccacctccactgtgtctacacccacctccaccatgtctacacccaccaccgtgtctacacccacttccaccgtgtctacacccacctccaccgtgtctacacccaccgccaccgtgtctacacccactgctgtctgcttcgtgactcgggggtctaggctgcttctttcctctctctctgcatttcaagaagatgagagcgagaccatgatgctccgtggtaaggcccacctgagcctccgactgtagttgataaacccagcacagcattgcgtctcctgtccatcaacaacacagaccaccaggcctcggcatccacaggaatcttggagtggacctgtctgcttctctcagttgtgtggctcaactaatgtttgagaaagactcttcggtggctatttattcatctctctagattctccaaatgtgttctttcgcagctcatcaggtcactagaaagctactttctttgacttctaagtgcctacataaattttatgcgagaattatgatttaatgttatatttttactacattcattcaacaaacattcattgagcatttaccatgttctaggccctgtagtgagtgtcatttgagattaaaaacatcctcccctaacttgtccaatattccttttgaaaagaattccctaaaaaatttcttgtattgccttgtgggctaaagtactgtctttcctgaaagtctgacatgcttccttttatcagataatgtgacttgtgtaagattcatatttccatatttcccttttcaccttggctatccggaagctcagtgtgtagctttacgttcagctgttctcaccttacatgtgtcaacaaatccactaaaaaaatttcttttaaaaggaaagagacaggccgggcgcggtggctcacgcctgtaaccccagtactttgggaggctgaggcgggcggatcacctgaagtcaggagttcgagaccatcctcaacatggagaaaccctgtctctactaaaaatacaaaattagccaggcatagtggtgcatgcctgtaatcccagctactcgggaggctgaggcaggagaattgcttgaacctgggatgcggaggttgtggtgagcgccgagattgcgccattgcactccagcctgggcaacaagagcgaaactccatctcaaaaaaaaaaaaaaaaaaggggaaagagacattattccagcaagcagtttgcaaactgggagatgctgcctttggatcaaaacaaaggtgcattccagagaagaaacatgcgattgtcttccacaagggaattcctgcccaggatctcattctggcctttatgcagataagggaggcagacttgcttcattctgtttggtagagcctggtagcagtctattggtttggtccagagggcaaattgggattttctggccttggttgattccagcagcatgaacagacagctgtgaaagttccagcacttccgggaacgcagagctggcgtgtgacctctagtgagcaaaaggtcgcgtgcctccattttgaattcaggcccagtgagccccttgggatgcacctggcaggatgggctctttcaggttcagatacctgattccaccgttcttccttcagttcttactttgaaccctccaaaaattattccgttgtgtactggtcatttatgtggcttcaaatcctttgaaagtagattgttcagacatgatctaataatgctgttttggaaatgaatgaatgtccacttgtcaatgggttgatatgtgaacagaagagtatatccaaagagagcaaagtgtaacaccaaggtcattgaaagaagaaattatagagattttctattgggtcatcatctgatcctttcttctctcagtattttatttcccagctcatattatcacagctctaagagacaactttctaatttagaaaacgaatgaccaaatccttcatttagaacacaaatgtgagaaggccggtgcttgggcagctctgcggggctgtgttttgttgcgggagccctggatgtatgctcagcccctgtgcctctcagagggctgggggccccacatacagataccttgctccgatgtgcctggataagcactgagggtgggttttagggaccgactggggagagatgcacgtggggtctgagtcgaccgtctgtggggcactctggtcatgcccagcatccatttgtgcagcacaaactttttctctgggactgtccgccccccaggttcttgtggtatcgtaaagacgaccacagtttcgagatgtaggagtgaaatggaccgaggctaacccagtgaagtttgcggctgggttaaggagtgagtcagggagatgcgtgttttctccatcatgactgggagaggagtgctcatttgccgggaggtgagggtgactgtgcacctcagccgccagcaggagcaccagagaagccctgctccagccctgctgacgtctgggcctgggccaccagccggtgcagtgagcctggaccccaggagtgccttttccaatcctgacagacagctgcttaatgtgggacattgctttactttacaagttgaaaacgccaccctagcagcacggagcacctcccaggggctaaaccctgtatcatgactgaatgcgcccatgtcaatgaattctaacatctaactctacattctgcctcccctgaatccaacgttctttggatctagttctgcatttacccctggctcatgctggtgcatgcattttggtcctgaagctccttggccgactgtctcttcctcagtttttagcctcagcacttctccagcttgatgatgctgacctggaggagctgagctggaggtgggtggcaggcgtgtcgccttgcagaggtctctgcagtgtcttcaagcacagaaacagcatttgtccttaacagacagaaatgtgacacctcttcaggcccagcagatttagaggaatctgggattcaagatttttgagtgcattcattcagatggccccatcgcaagcctctcttcttcccagtcagggcctctcttcttcccagtcagggtccagagcttggaacagcaccttccgaggccaagcacccgaacctggaacaacaccttctgaggccaagcacctggccttctctggagctctgccttctacacggttaagtcctggccctgatccagtgttttggttttcctctggtcacaggagatgagtgtcttatgtggcactgaggaggcccgttagcgtgccacccttttgtttcaggtggtgatcttttcattatcttgccctcaacacgagccacctgattccatagtccatgtatctgtgactttcccgaactctccagcacccgagatcctgccgctgccagtgcatttccttccaaggggctcccgtcctggctgccactgctgcagtctggagattcactcctgaccccagctgtcgcctggaaacaaacaccaaagcgagatccgcgttgagtttatcagcaggcctgtgagggtggagggatggcagagaagcagctttgtggctgggctgccacagaggactccactggtcctcggagaaacacaggagccggcttgcttccggtggctccaaacggaagcatagtctccgtcgtaaagcaggggtgtggatggcgtccacagcacccactgcagacgccacccagggccagcgctagacgcagaggctctgggttggaaccaggggtgccgccttaacctcctgttctgccccggtgagcaccaggcttgcaagggctgaggatgagagaggcccctgtggctgcaggctcccagcagtcaggggaagaaaggccattcattctttcaacgcatggaactgctttttaggaagtgaaggtaagcagtggaaaaaaataggcctctatcttcatgaagctcctgttcctctccatgcagtgtgtgtgtgtttgtgtatgttcacgtaggtgtgtgtatgtatgtttagtgtgtgtgtatgtctgtgcatgtgtatgggtagtatatgtgtgtgctgtctgtgttgtgtgtatatgaacatatgtgttcatgtgtatatgtggtctgtgtatgtagggtgtgtgtatatgtgtgtatatgtatgtgtgtacacgtgtgtagtatgtgtgtggtgtctgtgtgtggtgtctatgtgtatgtatatgtatatgtagtgtatgtgtggtatatgtatgtgtgtatatatgtgtagggtgtgtgtgtggcactgggtgcaatgaagttttgcaacatagaggagggagtgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggggctgggcgcgggattcctcccctgccagatcgttgtacgtgaacttctcttggcaaagttcgtccgcgagtcaatcgctcagcctcgctcagcgggcccgggccgcgccggcgaccttccttcgtctcttccgccaggcagcccgcgggggtcccttccgctcagcggccaatccgcggggcgggggcgggggccgaggcctcgggggaagccgatccctgcgccccccgggtctccgccacccgccagcgccgtccctgccaaccccgcccctgcagggcccgggccagttgggagcaggggccgggccgcgggcggagcctcccggtccccgccctcgccctcggccgactggcggtcttgcaggcgggcggaccctcggccgcgctcggggctccggcgccgccgctcctcctgctcggcctgagctgcccgggctcggcgcgcgcttggggcgaggctcggcgggcgcggacgcgcagcatggcggtggaggacgaggggctccgggtcttccagagcgtgaagatcaagatcggtgagtgtccgccggcagccacgcgtccgaccccccggcccgaccctgtcctctcccgcgcccgcctcccctccgcagatccttgctggggaccccggcggagacgccctccaggcgcggcgcgctccccggagaacggctggtccggctccgcggcccctccccacctccccgcctccccgggcctcgggctgggtcgagtcggctccggggtaacgcggctccctgcgcctcctctgcgcccggagcggccccggtccctggtagcggcggaggaggtggggtccctgcgccgagggacgtctgtccgcgtgtgcgcccgagcgtgtgccccgcgtgtttgcaggagtgcgcgcgcctgaggctgtctgggcgcctgcacttcaggtgtcaaatccactgacgtcggggtctcggcatctccctttctccgctgcgcccagaaacttcctttccggggaatgtggaggctccttcacgcttctccccaggggcgtgaggccccggcgcgctgctgctgctgtgcgcgcgcgtctgtgcctgtgtgcgcgcgtgtttgtgtgtgcttgtgtttgtgtgtccatgtgtgggcggtgtgtgtgcgcgtgcgtttgtgggtgcatgtgtgggtgcgtatttgtgtgtggatgcatgtgtgcgcgcgtgtgtatttgtgtgtgggcgcgtgtgtgtgcgcgcgtttgtgtgtgtgcatgtgtgcgtgtgtgctggtggggcgttctggctgagggctcccgcggggcggggagaccccggacccatcggcaccacgtccctttccactgagaagtggcgggcgagctggtggcgaccagggcctgcgaggctgcggtttttctctgggcttcagcagcttctgaagtgggctccgggaggcgtttccggagaggaggctgtgtctggacttctggtttatctggagggatctgcttttccctggttgttttatcttgggagagtgatgtggaagtcctccccctcccccagagcaagaccgtttcctggagtgactgttccatattcatgccatgagtgtgctggaccacagcgcggttcaggctggagaggcttccagggcctgcagtgtcgcggtccccacggtccttctcccccactgagccgcacttcgcagccggcctcttcccgtgtgaagaggcctccgggaacgggctgagtgtcagttgttgatgacatttgatgctgccggaggcattccagctcccctaaaccagcgggctgtttcctgtcggctttattttggtttgcggatcatcgctgagacactgtcttgatatttggcccagaagcgctgcagctaggatgtggcagcacttccgctttgagtagtccagagaggagggatttcttttgttaatgtggtttaaatccgctgtcactttcatacaagaaagccagagctggcgctccctgaagtgcctgaggtcgccttgcctgggtggggaaaggtcgcggcccgtgggggtcagtttgctgctctttccttcagccaaggctgcttggctcagccagcgagtctgaggagtgtgagaagcactgggcttcctcagtcacgggggcaggagggctggaggtgggtgcccctgtggggcagtgccaggtctccaggcagcaggcagaggcggcctggggctttgcggctcgggggtggggggcccacagccggcacagcatgctcgctgtgtactccaggaagggctacacttcaggccacggcaggactttacagaaggcatgggaagtagaacaggagggcgagggaagaccagagtctcagaccagatactcagaccctgagtctcccagaaggcagcttcaccggcctgcgggcactcggccccacttccgacaggcgtgggggtcaggcaccctggaggatccctcggagagaaggaggtttggagatgccaccacttggtcaggctctgtgctccactttaaacaagccagtgaaaccctggctcagctgaggcttaggctgctaatcccacgtggggcctggatatcatctgaacctttgaccctcccaggggcagcagcagtgaggacgggtagagaggcccaaatgccagctgcccgactctctggatgtggctccagcaagaagtccccgtttcctctcccctccagaggtcacctgcagggctggctgcctgaggggtatctgtgccccaagtagctggggagacagggcacctcctgcatttgagcagagatgcagtctgggctggagaccctgagggtgacctgtgggtgcgctggtttggggttagtctcatgtaactgtgctgctggcctgataccctggggctccagcagaaagcccatctgtagaagcgaagtggaggatgaccctgagtggcgctggtgccagggggccactgagcccctcaggctctttctttaatccacattcatggccaaccttggctctgacttgccctgcctgagtccctggtcttgaaggctcagacaagatggtgcccctgtggttgatttgagggcccctcgctgtcattcacctctgagccttgtctccaggagcgctggatttgcccatgagtctgccagtgacttgctgcatgacccagggcccgtgtcttccccttcataacctcatttttccgtttgcaaaaggcaggcaattattgtctactatatccggtgggaacgtacaaggcagtgttgttcagggttaagttaacaccctgccccctcactcccagaacaagaattgtccctaaagttataccataagcaattctgctactactcttactaagaaaaaaagccagcacatttctggggggattgggagctttttttaaggtataggggcattggccatttaaattcttaaatagctttgaaatgtgtggtggtgtgtggcctcattcagacgttgacattgggaaaaatggaaagaatctcttcctcctttcccccttcctctttctttgtccttccagctcttgcaggtgaggtaataagaggagagcgccacgtagaagtgaggtgctttggtggtaacaatttggagtctttgtcttgaagaatctggctttctgcatttcagttttgtggaatcattttggatatgtccttctgtgcacttaaacatcttaaacactgtgtcttttgaaacagtcattaacctttcacagtagagtctgtgtatcatgcatgactgagccacacttcctatgcgatcgctgctttgaggaagcctgtgcttcggactttccatgagtcagggacccacagggagggcacttccgccacggccacggcgttgttttggggcccccgcccccaaggcgtgcagtgcctcctcccctcgcagtgatgtcttccgtttccacaatacttactgcttgtttttaaatgtggcgccttatcttgatacatgtgttcaataaagagcaacacacaaggtgtttctctcaatctgttacagaaaaaaaaaaagccagccccgcggtccagggcgggaaaggctctcgcaccgcggtgaccctgccgtcgagctggaggcggtcagcgtccgggaatgccgtccgtgggaggccgggcctgccgtgggctccccgctggggcttcctgtggctctctggtcgctcccttctttctcctctgggctcagtgcctgtggctccgctgggctcttgctcccttcctgtgaggctggagcttgtccgtgaagaagacccacggccggtctggcccaacattgaaccgctggtgcctgcaggcctgtggggcagtgagggccaggggctgccggcctccagccccagctatccctctcctgatcacaaacagaatcccacctgaagcaggaggaggtggcaccgggtgagaatagggagaatgacaagtggggtgcctggagggtcccctggactgtgcctccctggccccagctcctgggctagaaggtaagggctccgggcccagctctgctagaagtggcagctgacactctcagcctgatggactccctcacgggaggtggaggccgctggtcacagggctgttacaggcatcaaattaggtgatggtctgtttaataagagaaagtagcaacagtgtcttcagagggctagggctcactcaggtaagagaagtgttttgtgaatgtgagggagggatactggccacgccgtggctttccctgtgtctgtctgacagtgtaaggaggggctgtgtggccacacatgggccttggcatcagagatcctagattcccctaatgctaaaattaacttggatattttattaaccgagctcagctaagctgcctgtgctatttttaacccctgaggacgaaggtgcagggcctggctgcacctgggaaacagcaggggctccggcaggggcaggttcagcctggggcccgggccttgcctggaaaggggagtgggtttcttgtgcgtgtgtgggtgtggaggctggatgcagatgctaagggcgtcgtttccatgtattatctcattttatctaaactctggaaactccacggcactgaggtggagaaagggagacccacggatttatctgggcccaagcaccccagctccacgggctcctgggatccgagttcttctcctcaccacttagtattgtccattaatttttttttctttgagactgggcctcactgtgttgcccaggctggtctccaactctccaactccaggactcaagggatcttcctgcttcaacttcctgagtagctgggacacaggtgctcaccactgcagcctgcctgtcagtttggagagctgtttcttctctgtgatcttggattggaatggggggaatcatggagggctggagaacagagagacttgttggtgaccttagggacacgaggcaggcagtgttcaggcagggaaggaaggaaggggctgctggtctgtgtgggtggacagtggcctgggaggcccaagacacagggtgtgctgggaagacagtttggagatgcagaggtgatcctttaagcagggccacagccacccatccagccttcaggtgtgtgagcaaatggtgcctggcaggtggactcagccagggtgctggactggtgggcagagtgtggaccccggaggcagccctgggggcgtcattcctggaagggaatctggcattggtggaaaacactttgacttgcttctttggagctaatggaagcaaatgaggcatttggagctaaggagcgtgtgaaccgcgcaggcgcagagtggatgagcggcgtctccctgaggctgtggcaccgtgtttgcaggtggcgcgtcatgttttaaacatagacgtgtgtgtgtttagaaaggaggtggacgtattggctggaaacagccacaagcaaagtgatggctgctaaggttttgaaagtgaaggctgctgagcgatggtgggaggggcttggtgaggaggagagctcctgggggccctcgggggagacgtggacgtagcgaacccacttggaatcagacacccgagactgcgtgctggccacgtttcttgacaattctttgattttagatgacccctaacctctctctgccttggtttcttggtttgtgaaagtggaggccaaggccttcttttgcagagattaatgggacttagatgcaccaggcacttcccccgctcagatcttcatagatgggaggtattattctagcagaatttgaagctatctgttcgtctgtaatgaactggacttctatgtaagcaaatatataatttgaaaaagagctacactttaataagtaggagggtgttgagatccgggagagctcacactctggagaggtggcttttgtttttggttttggctgtcatctgggtgtctgggagggatggctttcaacttgctcctgaagagagaggtggctttggttttggctgtcatcttggagggggtctgggaggggtagctttgaacttgcccctgaagagagagtgaggtctcaggaagggaaggaatcatttgggttgggctggtgttatgagatgcacggcctggcctttgaggggcccagataagttagctggaggggccagtgggacgtgtggatgggcctctggccgatgggttgacagaaggggccacacggggtcccgtggggatgtggtgtcatgccccgcaggtgccggtacctctggagggtgcgaggttggacagcaggtgccggtacctctggagggtgcgaggttggacagcaggtgccggtacctctggagggtgcgaggttggacagcaggtgccggtacctctggagggtgcgaggttggacagcaggtgccggtacctctggagggtgcgaggttgggcagcaggtgccggtacctctggagggtgcgaggttgggcagcaggtgccggtacctctggagggtgcgaggttgggcagcaggtgccggtacctctggagggtgcgaggttgggcagcaggtgccggtacctctggagggtgcgaggttgggcagcaggtgccggtacctctggagggtgcgaggttggacagccgttgtggaactgtggtgggggtcggggaggcagctcactgagcgcgtctcgtcttacgcagccgcgggtcagagcaggggtctgtgttcacgcaggaaaggaggggcttgccgtgcaaccagagcttctagctttgaaccataggtgaaggcgatgaacagacgtgtctactgcagcagcacctgtggccagtggctgagtgagcaaatagcaaacagtagaagcaatgttgaggagttggggtctccccaccaatctcctgtcgaactgtcaccccgtcgttggaagtggggcctggtgggaagcgactggatcttgagggtggatttatatgaacagctcagcgctatccccttggtgctgttctcacgatagtgagtgagttctcgtgagatccggtggcacacctcccacctcgcgctcttgcccccgctctcgccgtgtgagacacctgctcccccttcaccttctgccatgactggaagcttcccgaggcctccccagaagcagatgcctccatacttcctgtacggcttgcagcaccgtgaccaataaacctcgtttattttgaattacccagtctcaggtgtttctttatagcaatgcaagaacagcccaatgagtaatcgccaactgaaacggtgattatgtcatgtgcatccacatgtgggctgctctgtggctttcaaggaacatattaagcccaggccaaaccacatgactcgcaggaagttccacggcataagattcaaaagaagcaaaatgagagcgcccaacaccaccccctagaagaatgataaacacagatcagatgagtgtgcgcagatcagggataagacccacacagcctgctaattggattacctgtgggatggcaggagtgctgtggtaggaagagagacaggaatacaaggccttccgtagcagcaagtatatgtctattatgcatcaatgtgcaactatgtatacggtgggtgagtgagtgaagaacaaaggcggagcttagaaatcatcccttcacagattgcaagaacagtgtcggctgtggaggacgccaaggccgagaaagaaaataacttgccttcattcaagacaatgtgctgtgtgggaaatgcatgtggacaggtgaaggagcggctccgtcaggccgcagcgggcgtccagcagtgacaggcggagtgagttgtggctggcccctgagaggcccctgacaggttttggggctccagcctttgtgtctgggaggctctggcacaggtgaaggggaactgagggttacgtcacctgtgacagatggttcagggtctctctgggtgtgacgcagagtccaaagtgaacagttacaaacgttcaagctttgctgtagatatgagtttcagagtcaccgaggtgcccgggaacgccctcgtcgggcctggatccccggaagtgagtttccccatgggttattggtcaaacggcatcagagtgtctgggagattttgtttttctgtgagtattttctcaaaaatagtagttccttgttctatgagtgtctgaaaatattaggtgtgtttctgcagacagggctggattcctggggctgtagctctagccaccctgaaatttggcattcttagttttcgttttcaaataagcttgaatcccacatttggaacaatcacccaaatttaagtctcagttttgttccttctggggacagtcagtgccctgctggtatcacaacacagccagtaacggctgcagcgctgacctgcgtgtcctgggtcccgagagacaccgtgccgggcttctgggggctgggccggggggctgggtcaggagacaggagccgcactggggaccgaaaccggtgccttgacctggaattgatcgaggaacgactcctgcacctgttctttcctctttacattgtttcttttatgttatccgaataatttccaacctgtaaagaatcatctgtcttggccctgactgcccataggataaaattccagaggttggtaagaggtctgagtctttcctagacaccgtggggatcctttttctgaccaccgaccagacagatgtccacttaggacctgcatgggggccgtggctcccagccccgcatggcccaccccgtgggtgcctccctcgccccaggatgggccagagtcctcagccccttgctgagagccaccctccctgcctggtgcgcatggcgtgcccagggtaggacggaggattctctgggatgcctgacaaagcctaagggtgattgttgttgtgtcttcctggagcttggtttttggacgtcatcgtctccaagctgcagcccgggtctgaactgggcgcgatagacccaggctggctgttcgtgtggcgttggagccagttcccatttctgcgttaggtttcattcctggccttttccctgctttgaggggctgcacagagtacctgagggcccttgcgtgcacccctaaatcttctctttagctgtgttccttctgaaggaaaaggtttcactcttcttttcagctctggagatttcttgttttggttccaaaccctcgaggtgctggagcagctagtttgccttgatcttgtcacttctgtgttttctcttccccagagcagccattgctctgggagcctgaggaccagcctcagcccatggcccctgctggggcggccacctcggcgtccggtggtgactgtgcaggacacatgtttccggcccccctcctctgaggctccaggagcaaagtgctgtccccaaagccatgccggcagcaggagcgtctccatgccgggcacgcaccgaaggtgtgtccagggtgtagggacccaggaaggttgtcttgtggtggactctgatgaccacagcccaggcgcttttgtggctcgtggaatcgcttcctcagaaaggaggctgggtgctgccgcggccttttccttcctagagccctttctcatgcagcgttggctgggcctgctcagcactgtggcagctgtcatggcagccagtggtccttgctttgggcagcagtgagatgcacaggcctggagtcagggctggggccgacctgccggagacccccttcctagctgcgtccctcactcggggccgaccggccggagacccccttcctagctgcgtccccctgtgtggaggccccactggttctcctgaatgctgtgccctctgcttccatgtcagaacatttccctccaatgggcaggggcgaacccacctgcacccccgggcccaggtgctcccagatgcagagcaagcccacccagcgggggaaggcacggctcgggggcaggaaggaggtggtggagctgggggtggttcggccccaagcaccctgagcctctggttgcctacttcattctggcccaggctgcatgggggtttccaaggctggggtcagactgatggacagggccattagcagagattcaggaagaggaaccggttctgggaaaaccatctgcatgcagagcccaggggactggccatgccggactctcctccgaggtccgggtgggatgctccaacagggctggttttcccatgggctttgggatgagggcttttctggggaattccagatcccccccagtctgtaggtgccaagctcagccttctcaggaagccttgctggccgggggtggggctgaccgcggaggggccctgaaggctggagcagcctggggaagctctgccgccgtggccggctgcgcagcctggaagggacgcctggcctcccagatcctctccctccccgacaactaatgtccaagactgactgctgagattctgggatttgcggtgggccccacggactggaatcttcattagtttaggggcggtggctggaggtaggagcctctgggccctgtgtgcccctcagccagtcacctgcagtgacagtgggagcaggctcctgcactcggcccacaaacctgctagcccggctgcatggtgcgaggcaggagagagattccgagaagctccttcctgagcgtgtggcggggggcctgtgtatgctcacagctgtaaacaactagtatctcattcactgtacagggctagcgcaatgggccataaactcacacggccatggtgccgcactcagggactggtctggccgcccgcgtcctcagggctacagaggagtgaagcgttcaaagtctttctctggggaagccgaaggtcaaaggtcgagctgtgcctgagagacagaggttcaggctgagggaggagtccgcatccttatgttcctcggaggtctcctcttgtgacatgcttgcacacatgcacatgtatgcacacccatgaccctgggaccgtttggggcagggttgcgcggcttgatgtgcagtgttgggtggaggtaagggaggctccggtgggcttctgttggcttttcctttagccgagatccgtggcagaagacacgggccaatctgtgctgagtaggctgcatgcagtttaaaacttctcaagcagttcttaatcatttttattctaccccacatggctgaggctggggacactctccagacagccccgtggctctcaggggcctggtcccaggaggctcggcgggatgtgtttggggcacgggggtccgaatgccccgcgggtggcctcctgcccccggccgcagtgctgggatgcacctgcctttctactttccacaacttgggatcttttctggcaactgctgtgcaattttctagtattttgtatttgtataagaaacatcttgtttttaggcccacaacttgttctttttcctaatagcttttccccctacttgtcactgacctgttctcttaggtggctgcatgttacaggggagtccccagtctttggactgttccagagcccaagactagctcggctgtgccactcggggaagcacactggaattcaaatgagacagatgttactctgggaatcatcttgatcctcttagatctgtgtgagaagaaaacggtggacaaacattggtgcttgagccgtaattagtaagaaattgctggtgttcctcctcacccgtgcctggtgacaggaagtcaggagaagagagtgtttgatcacttctagatcagtaggttctgaccatgaaaagtccctttccgtgttatctgtggggcagggtcacacggagtttctctgtggggattgttctccaccagggcttgttggtccagaccccttgaacggcattgatgcctggctggagagagggaggggccctgatcgacgcctggctggagagaagggggggacttgatcgacgcctggctggagagagggaggggccctgatcgacgcctggctggagagagggaggggccctgatcgacgcctggctggagagagggaggggccctgatcgacgcctggctggagagagggaggggccctgatcgacgcctggctggagagaagggggggccctgatcgacgcctggctggagagagggaggggccctgatcgacgcctggctggagagagggaggggccctgaccgacgtctggctggagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgttggtccagaccccttgaacggcattgatgcctggctggatagagggaggggccctgaccgacgtctggctggagagaggagggagggccctgatcgacgcctggctggagagaggagagagggccctgaccgacgtctggctggagaggggaggggggggccctgatcgacgcctggctggagagagggaggggccctgatcgacgcctggctggagagaggagggggggacttgatcgacgcctggctggagagagggaggggggccctgatcgacgcctggctggagagagggaggggccctgatcgacgcctggctggagagagggagggggggccctgatcgacgtctggctggagagaagggggggacttgatcgacgcctggctggagagaagggggggacttgatcgacgcctggctggagagagggaggggccctgatcgacgcctggctggagagaaggtgaggacttgatcgacacctggctggagagagggaggggccctgatcgacgcctggctggagaggggaggggggcactgatcgacgcctggctggagaggggaggggggccctgctggttctctcgctgctgctgggggatcctgagcgatcggcccctcagaggcgtgagcagttgtctccgggacctccgtaccgcttcctgaattccccagctggtcccatccgtctggaatcagtggcattcctttctctctccatcatttcctgctccatttagcgctcctccagtatttagagaaagagtttctcagcatttggacccaagaatgtgtttatggaaatgctgagtgaaaatgaaagactggaaaggaaaaaacacttctcactacatttttgctaagtgcctttttttaagtttattttgctttataaagtgtatttctgtgttttctttagggaagccctttctgccctccatgtgcccttcccaggccggggaaaagagctggggtgggtgggtcaggaggaaagcggggggtggagagggaggggcaggcagccaatttcatctccaaataaaagcactttgatttcttcccaccagatcacgattcattgtcatgggtgaccatttagttctgtgctcccctggtttccttctgggggaccccatggtagcacccacacccctgtcgctgcccacacccaaggcttccctctgggtagctgcactggaaccagcgggttttatgaacacaagaatgctggtgtttttcaggcaggatacagctgctgactttcagcagagaaggccaggcagtgggctagcctggtctggttaataattcatcatagatttgtggatggtcacacggagtgtgcggagctcaaaagctgccacttgcttagacgctagtccagattttagtgtaatgcctgtggcttaaaagtggcggtgacatcggttttcaaataaaatatttcagaaatatttgggacatttctatgcatctaatcagaaagttgtgaggcttgtaaaaatgtgccgtgcattcttaactggtgtgtttattaggatttggggctagagttgggatgtgatagagtcagtgtgagatggatgactttttgaggtcacccaccaaaaggcaacaacggcaaggcaaaagcttttagttttacttgatgtgtttaattacaaatattagttagagtaaagtgatttttcagaagcttccccacccactaaaatgtcctcccacaggcacttggctggggggtttgagtcacacaggcgggggtgggcctgagtttgcccccctggggttcccaggaggcagctgcagtcgtcgggagccatgaactggggctgtcccaggatataagggaaatattggctgtgccttccaagttattatagagtaagggataaataagacaaacccatgaacgtggccacgtatttatgagactcataatgagaattttcagcctccttgcagaggtgagctactattgtgctcaggaagattaaggcacttctaaacggctgttcccgtgcactcacggacacttggtgtgcacacgtgcacacggcaacatccacatgtgcacacaggtgcgtgtgcatgcacccctcacacgtgcacccctcacacacatgcttacaggtgtgtgtgcatgcacccctcacacacgtgcacccctcacacacgtgctcacccacagatgtgcatacaggagcattgcatgcacccctcacacacgtgcacccctcacacacatgcacccctcacacacgtgctctcctcacacacgtgctctcacacacatgcatctgtcacacacgtgcacccctcacacacgtgctctcctcacacacatgcatccctcacacacgtgctctcctcacacacatgcatccctcacacacgtgcacccccacacacatgcacccctcacacacgtgcacccctctcacacgtgcacccctcacacacgtgcacccctcacacatgtgcatccctcacacacgtgctcccctcacacacgtgcacccctcacacacgtgctcccctcacacacgtgctcacccctcacacgtgcacccctcacacacgtgcacccctcatacatgtgcacccctcacacacgtgcacacccacactgatgcacccctcacacacgtgctctcttcacacacatgcacccctcacacacgtgcacccctcacacacgtgcacccctcacacacgtgcacccctcacacacgtgctcacccacactgatgcagaggattctccaaacctgcaggctccatgtgaatagtggaaactgtatttgcagagttaatttttcattaagcaaaattattaggctgccattgaataacttttttcaaataactttatttaaagtgataaaaacttttatcattacaaataaattaagcattaactcagtagtgttttgcctcttctaagggttcgtgtgccgtaaggtgcagttttccctcacgttttaatggctctgacgggcgccgctcagtcaccagtttcccctttcccagtggcttggaacagcggtctgtcctacgctggagtctttcggattcctcagaatgcggcatgtttatgaaaaagcattcatagggaggggtagggatgggggtctctaggttaatagtgaggacggtatttctattttatgtatgtgtgtttcagagttgcaaatcacctcagataaaatagggccccttagacaagacagcaggcctggcccgaggggaggggtgtctgtgatgaccttctcaaggccaaaaacttcaggaccagcaggattcctccagagaatgttttcttgaagagcgttagctgcgcgttgcaaggctggccgagagggcacaggcccacaggggacccggggttccgcccctgcgctgctgccaggctctggctgtgtgacctgtcaccctccaggcctcaacatccacactcatgtcagcagggtgatgacaacttcccagggaccccagaacgtcacccgcctcaactgcagacgcctctgagcacatgtcccattcacagagcgtttgggtttcttctttaagcctgctggttatgacagaaagtaaaatattaaccaagaagaataatctcacatttaaatacagcttcacacaaacacatacatctgtagcaacgtcgttacaggagactgagaaggcgtgggggctcctcatcattccaggctgtgcttttcccttgagaagcaatagaggtaggagactgcggctgtttctgacctctggaccggttagagagcgtttgtagggtaaaaacatacacaggaggctgtgtgttatgagaggagccaccaaatcggcaggcgacagcgagggggacacgcggcctgcagagggcgtggacatgaccagctgcttcgaggcctgcattctgcctccgacggctttatctctagggcatgagtctcttgcgacaggaagtgagtattaatgaatcagttaaccattttctaaactgggaagttgtcttgtgaccagtcttcacgcaggcaggcacctcccccgcgtgcccgacactaacccaagccttatgttttgtgggacacgtggcctcgcccgggccaagggtcggtgtgactgtccagcctctgtgtcaccaaggtggggtgttcatctattgaactcacatcctcaccagccgtcccagccaggagacactcgggaaaactgctaccgcacggcggcacagggaccgtaaacatgttaccgctggacataatggaagctgccgatgacaccacacacaaagccccccatgggttccaagtatttttacacggccagacctggccctgtgccttgttcagcggcctctctgtggagaagccttctcctgccgggacctgcagcatctcacagctgggggtggggctggggaacctgcagcatctcacagctgggggtggggctggggaacctgcagcatctcacagctgggggtggggctggggaacctgcagcatctcacagctgggggtggggctgggggtgctttcacccacggccaggggtcgtgcccgggaatttcccagcttaccagcttagcacccccacgtcgtccctggagctgggagctatgggtctttccactgttggtcacgactctgccctgtccctgcacatgagggcgggtggttgaaaaatcaaagccaagtaagctttggagggagcgtgtttaacctgccctcgggtttacactgaaaccctgcccacatgttatcaagggttacccataaacaaaggtcggcgaaggatgaagaaaaacaagttgcttttacgagtcaattaaatatgtgatagtgctcaactcattttggcctgtgtggtttaaagaccagacgagaatatgctgttatttaagtaaaggtaaaatgagggtctgggcccattttgcaccatttagcaagtgaatgggtagcttttgtggtcagacctcactttggctgacagagctaggaaatgtgcaaggagcatttgctgattagttcatctccctccatccatccgtgtccccgttccttcacccctctgcgtgccaggtcaagatatcccagagaatgtttctagaggagttctggactcaagtctaataaaggaaaccccaggaaatccagaacagaaagttagcgtgtgacaggaggaaattcgttttgcactccgcagctgaatttgcggttgcctttctaacgtcacatgggctgtgctgaggataggccaggtctctctcccctgcacggacatcgcagacgctcaccgtggtggggtggattgatggacatggtgagagctgcatggacattgcagatactacagacatcgcagacactacagacatcgcagacacttgctgtggtgggtggattgatggatgcggtgtgagctatacggacatcactcgccatggtgggtggactgatggacgcggtgtgagctgtacggacatcactcgccatggtgggtggactgatggacgcggtgtgagctgtacggacatcactcgccatggtgggtggactgatggacgcggtgtgagctgtacggacatcactcgccatggtgggtggactgatggacgcggtgtgagctgtacggacatcactcgccatggtgggtggactgatggacgcggtgtgagctgtacggacatcactcgccatggtgggtggactgatggacgcggtgtgagctgtacggacatcactcgccatggtgggtggattgatggatgcggtgtgagctgtacggacatcactcgccgtggtgggtggattggtggacacaatgtgagccagccagtctctgatggcaactgttttacattcccgggtagcatttgtcccctctggttttctcattggcatctttctctctttttaagaaattcgtcagaagcaacatggttcttcccagtgagtgtagcagaggtctgcttgacattttagatacatttctccaattctccttccgttccttgccagccactatgtgctgtgctgagctcaagccacaggtgcatctgcccaagtgcagggccctgtcgggaagagccgtctgaggcccccagtctccatggaaggaggtgcctgtgagagacgacgtgccaggaggaggccggtgtggctgagcagacaaacttacattcagagaagcctcatccgtggaaacagcccaggaggtacagcagctgttgggctctggacttggcatgtggcttatggctgagcatccccttaggatcatcccagccctccagctcctgcccccaagtcgggaaaggcttcccgtgcatggcagggcctccacgggctctggagtcctggtcggcctctgctgggatgggctgggcctttctctgagcccccaggcctttagtgcctcctagtcccaccctccagccctccctgagctaagcaccttcccagccccctgctggcctctcattcactctctgaacggcgagtgttgcttttttgctgaggattctcttggaaaccctttgagctgagagatgagcccacagcggtgcctctgcctcagatgttggtgtaccctgcggccccatggggagtggacgctggcagtcggggcaccttggctgtgggaaaggaggaccacgctggccacacaggcctgagtgtgtgggaccagggcaagcagggagagctggcatacccccaccccattctccagttaccaacccttaacccggggctctcctagcggggtccccatacctgcagcaccagcatccccgggcacgcgtgtgaagtgctcgaggcaggccgcacccctacagagctggggctggcgatctctttccaccggccctgcagagagttcccgtccggctgaaatctgagaccccggtctaaagagtgtgattctcttcctgcagagtatcaggagcagaccagcttcccaaacagtcacccgcagagcttctgctccttcggggagggccctgactttctcgtggtagaaatcctccacccggccaggttccggctgccccaggccccctagaagactccggggattgctgagcagatgcggggctgcctggagctggcctggcccctggtgccctgctaatgccattttttggtaacacccattcacaatagcctggctgagggttttgttctccttctctttatttgctatcactaaatccatctgattaaaaattagcctggtgtgcccttgtcccagttgctgggggggggtgcctgggggctgctgtttccagggagagggagggacagtgtcacttacgggaccacacaaaggggcgaatctgccttttgcttttgtctcttccgctacagctcccaccctcgcctgttccttggaattagatagggtgaagtctgtgcctccttcaccagcataaacagaagctattttaagttgatgggccccaaccccaaccaagacacaggatccgatgatcctctggaagcgccgtctttgctcaaattgcagctggggatgtcctaactcctgaccacagatggaggtttgacatactctgctttacgcatgaggttttctaaacagtttatgtagctagaggctgttttggagaaacagagatggtcatggacatagttgcaaataccaaggctatcagtggacatggagacgctgggctctgtgtgaggcaggaagtgacgtttccctccttagaggctcagcccgttagaactcggcctgcagctcgtttgaggctcagcccgttagaactcggcctgcagctcgtttgaggctcagcccgttagaactcggcctgcagctcgtttgaggctcagcccgttagaactcggcctgcagctcgtttgaggctcagcccgttagaactcggcctgcagctcgtttgaggctcagcccgttagaactccgcctgcagctcgtttgtggctcagcccgttagaactcggcctgcagctggtttgaggctcagcccgttagaactcggcctgcagctcgtttgtggctcagcccgttagaactcggtctgcagctggtttgaggctcagctccttagaactccgcctgcagctcgtttgtggctcagcccgttagaactcggcctgcagctggtttgaggctcagcccgttagaactcggcctgcagctcgtttgtggctcagcccgttagaactcggcctgcagctggtttgaggctcagcccgttagaactcggcctgcagctctttgtggctcagcccgttagaactcggcctgcagctggtttgaggctcagcccgttagaactcggcctgcagctcgtttgtgccgttccatgttgcagttttaggttttttttttttttactttgagcagccctggattatgacaggtgtctggcgatgtctttcctgaccagagcgtggctcagcccccgaccggggcccacggccagaccctcactctgctgcccccgacctgggacaccgtggctctctcaggaggattctcactccccagccaagcacagtctgtggtgtcaaacctgccggtgtccggatgggtgtgtcctggtgctctgaggctccggtccgggctgtggggacgcgggaggctgagcgggtgaaggcggctgtgatgtgcgtgtcatgccctgtgcaggtgccaggaggggctgtcggtcctcacagcagccaggggaggaagcttgttgtgtttgttgctgatgaggaaacggggctctgggagggaagtgctttgccggctcacgctgggccacagctgcctgctgctttcctgagaagccgtgtaaggaaggtggcggccgagtgcgcagaacctgtcctgtgtagggccaggggtcatgcagctgtgcagggaagcagccgcaggcacggtgccgtccagtgagccggactgtatccatttcaccttatttcagacactgagatttgagttgcacgtaatgttcacaggcatgaaatgttatccttttgataatttttaaattacttaaaatctaccttgcaggcgttacagcacagggtatggtcaggggcccgggtctgtctctccctggtcctggcagccatgtaagcccgtagacccagagcaggggtccagcttccaggcccccctggggactgctgaattctgtcccactgacttagattttttgttttattctgagcatttctgtgtctgttgattcagtatttttttctggttatagaaggaataatttttcttttaccaaccacccaggctgcagccacctgtgactggtcaggtttctgtgatggggagagggcctggccctgaggtctgtgtttcacggctctcactgggctccgccagacgctcgttgccctgagggtgcagctgtggcagcatctgtgggtggctgaggagacgggacgttcaccgggaagttgcgccccaagggtgttctgggggctgcctcgattcccagagctagacccacacgatgctgagtctcgtgccgccgcgaggccacccccggtcaaagagacccagtcgcctgcctcgtggccctgcgccagccccgcctctggtgacgtctctttggaagccacagcaggaggaggctgctcacggcgtttggaggctcgagggcctggtctccaggtgtgcacagccgggatggagcagaaggaggatgagcttaagtcagagagtcctgggctccagttttgctttgacgtttatgttgctttaagagaaaacagctcagctgtgcttttctcctctccgcggccctcatggctgatctgtatggaagattagagaggaccctgtgtcaacgtccgcagcccaccgtaggtgctgagtaaatgttggtcggtgtttttctcactttattttcaagctgtcattggcttgggattttgtaaaaggcagctggggtgtggattggagtggagctctaagatgcttgaggcaagaggaggctgtgaacaggagggtttggactgggaaccacgcagcacaaatgagctgagttcgaggaaggcctcagtgccttgaaaggcagctgctgtttacacttttctcaagacagaggcttcacgtggtcgccgttcacacaagtgccaagcaagaccctggcaccagaggcgtggactgaaaatgaagccacctgaacgtcctgtgacggtcacggagccggtcgtgttcgggggcccgtgtgtgtttgtcaggccaggaccctgccgcctgccctctggcttaaggaatccagttggggagaaacactccctctgagtacccctggggttttgacccagcttgaggttgtaaacaggtggagggggccgagtggagaggccttgctgtgatagagacctgggcctgccctgccaccgtccgccgggagcccacggcagcctcgccctccgacacctgcacgctgcatgcagtggactgaactgcaggatgcctgtgttgctgccagttctgctgtttgggaaaaactctctgtgttaagttggatcttccttgtgactgattcagaggagccacgttgttacggaagggctgggacccagacacagggtccagagtgtcctcgaggtatcagaagaactcctggagagcaagctgagggctgtgtcgtcgccacaccctccgtgggtccctgctcctgagttaggctgtgcccagccgcccagtgactcagaagctgtgcacacaaggtgtgaatcccaccttgctctagcaccaagaaaacagcacctggtgatgggatgtggatggcggacgcggggtgacagacaggggataatggacatggggtgatggacgtggggtgatggacatggggtgatggatgcggggtgacggacgggggatcatggacgtggggtgatggacggaggatgacggacggggggtgatggatgggggatgatggacgcggggtgatggatggggtgacggacatggggtgacggatgggggtgatggacgcggggtgatggacgcgggatgacggatgtggggtgacagatggggtgatggtttcagggtgacagacatggggtgacggacggggatgacagacacggggtgacggatgcagggtgacagacggggtgacagacgcggggtgacagacacggggtgatgggggatgacagctgcggggtgacggacaggggatgacggaggatgatgggttgtgggatgataggacttctcagcactggtcgctcctgcctgggggtgggagtgaatgggaaggagaaaggctcggagaggtccttacccagtggccaggagtggggctcaggtttttcgtagtgttcaggggatcccgcagagcccctaggggatggcagggccacccccaccatgccggcgaggaagcaggcttggagaggcttaccctctgaggcggccgtggagagtggcactcaggggctggctcaggtcccaggccgggtgcgagctgatccgcgtcagcctctggttctgaaacactgagcctggctccattctgaaaagtgcagcagtaatttgaaccttgttctgaatggccccgctgattcatcctgcttttgcagggtcctgctgaaggacagcggcttctgcttcctctgattctggcagcctggaacttcctgagaggactgggcatgtggatagccatggtgggggacgtcctttaaactggggaatgggctcccctagacacagtcgcttccacaggaatcttctagagcctcacccagggcagagcagacacccacagcagcctggagttccggggagccccggccgcctgcctgggtcatgagggacaggccagcccccaacccttgggtaggaagagcccagccctcagacaggacaggcacctgggtgaacagacagcttcccctgcaggaggagatgcagctgttcagaagcagacctccagcgtgggaaaatcagacccatggtgtcagggtgcacgaaggcaggacacacaggcccgtcccccgcgagggtcaggacacgaaggagggacacacaggcccgtcccccgcaagggtcaggatacgaaggagggacacacaggccacatcccctgcgaagaccaggacacgaacgtgggacacacaggcctgtcccctgcgaggaccaggacacaaaggcagacacacaggccacgtaccccgtgagggtcaaggctggagcctgaacgctgtccgcagaccgtggctggatggagactgccatgttgaaatgcctgcacatctgatccagatgtggccgtgcacgagagaggaggtgtgggcgtgcacaccaagccgtccttgccagatgtggctctgggggggcctggctgagggagggaaaagagttaactttttctacctggagacttaactggctagaatgaatatctatttctttgtaattaagaacattttaaaatacagaaaaatagtttccttataagacttttaattttaaacatacgcagagctttctaaatgggacgcagcatatagtttggtttctgtgggccgtgtgccttccatgtgcctggaggatggacaggtggttttgtaatgtgtgtcatagtttgcacccagctggttcaggtgttaagccaaaaacaattaataaagcagtggtggtgatcagttcagacagagcccaacccctccccacgccaggggcttatgctccggagcgggaagcgtgttctaagtgggacttgggtgtgaatttctacacctacgctaagtaaaatgggcatttatttacaaagctccgaattacattgttttatattttatgtttaaacttcattaggaaaaattgccattattgttacacgtaatgagttgactgtcaatataaacgaaggaaatgttggcaaaagaaaaattagacctatcatttttatttacaataatctcaaatgctgttaaatttgtaagcatttctgttgctttatagatgttttggaaaagctaattttaagttttcaagaatgagaagttgtccccactgaaagcctggcacgttagcgtctttctttgcgttagtttctctccattcttattttgctccgtggagatacggtgcgcgcacacatattcaatattaaacacacatctgtaaacacacacaggaaacattaaacccatatgtttctatgtattattgaaagttcatcggaaaagacagcagaggccgtgtgccgctctgccatgcgcccatccggaggctgccgtgtgccgctctgcgatgtgcacccatcccaacacccggtcatcctcttcctcccactcagtgcctgcgatttcctgccgtggccccagaggaatggcagctctttagggtcaggactgctcagctcagggcgggtgcaagacgctctgtgtgtcagagtcttgcactgtggaatgcccgcttcctttcccccacgctgattcccccactgtgtagcttaccgtaatagtttcacagctagctgacttccttaggccactggaatattgatttgttctcatgttctcttaaaaatatttttcaaagattgagaagacaccgtaaatatgccgtcatggtcaggtgtcaggacaacggacgggctactcagagcctggcctggtttctgtcgtttctggaatgctgtggatgtgctgcagacgccagtgcctcccgtccagcctcaggctgggtgaagcgaggcggagggagcgtctggtcagtgctggccccggatgtgcctgtggccttgtcaggcaggaggcaggtgaggagcttcgatgccggtggtccctgtccccgtgctggaggaggggggctgccagtgctgctcctccttggctgaggcctcctgagcccttttcccctagatgtcccctcccaaagccgggctcctcataaatttgggggtacagagctctgcggcaccccttggtggagttgcctctggagagctccactgctgctgtgaacctgcctctgcttgctggtcacacggctgcccagtgagcacccctcagtgcagggtccatggcaccctggcatctcagagggctggcggctgctggggatgaggctggagcccaagggcagggtgggggcttgcgtgggggtcgtcctcccagtcccggacctgccctcctcctggggagagccccacccacccttctgaggtgacggcttggccctggagactacctgccctgactgggggccaggcgtgctctccatctccagggattctggggcttggggaggtcatagtctgttggaggagggtgcgccaattggccaaagggtgtttatggcccgagatggaagctgggctcggggggccgagagcctgggggccacccttcctgtgagggctgctgacgctggtgtgggcaatgctcaggtgaacgtgtgtggggaggggagggggcgaacgtgtgtggggaggggagtgggtagcgtgtgtggggagggtgtgaacgtgtgtgtggggagggaggggtgagcatgtgtgggctggggaggcggtagccccccctccagaacagacactgcactgcagcctgcacttggagtctgctgctctctcaggcagtcttgtcctgagtcgtaaataaggaacggaaaaccaaagtttcgatttgctattttctcctattctgaaggtgccattgagacgccaaatctcgtgcggttcaggcttttggctgtggttctccacggggtggctgatgagaggctttgtggccggcccactaggagggcatcggatgctcgccctgtaattgcgctgggtgtgcccgccaccggagttcccgcccctgatgacagggtcaggcagaggccggttcttgctagctgcaggttttgtgggtacaggtcatggggtatgggctgtgggctgagcctctggccagggtgtggtggcatctcaggccgcatcgccagtgggtgtctgtggctggggcagtgtggacgcatcgggggtgggtgtccgtggccggcggcagtgtggacgcatcgggggtgggtgtccgtggccggggacagcgtggacgcatcaggggtgggtgtccgtggccgtggcagtgtggacgcatcaggggtgggtgtccgtggccgtggcagcgtggacgcatcgggggtgggtgtctgtggccagggcagtgtggacgcatcaggggtgggtgtccgtggccgtggcagtgtggacgcatcaggggtgggtgtccgtggccgtgacagcgtggacgcatcgggggtgggtgtccgtggccgtggcagcgtggacgcatcgggggtgggtgtctgtggccgggggcagtgtgaacgcatcaggggtgggtgtctgtggccggcggcagtgtggacgcatcgggggtgggtgttttttgctgtggcagcgtggacgcatcgggggtgggtgtccgtggccggggcagtgtggacgcatcaggggtgggtgtctgtggccgggggcagtgtgaacgcatcaggggtgggtgtctgtggtcggcggcagtgtggacgcatcgggggtgggtgtccgtggctgtggcagcatggacgcatcgggggtgggtgtctgtggccgtggcagtgtggacgcatcgggggtggtggtgctgagccgagactcgggctccggtgtcaggtgctcctcggcggcttggttctgtgtcccccgtccccccgtcccccgtctgggagccgcccgaccttccctttggatgtagtgtgtgtctggggctcttggtgttctctgtgctttgcgagggtgagagctaccccagagagaatgccaggctcttcccagacaccccgaagggccagggcagccttcactgtgctgaggctggctgtggtctcttgggcatctctcccgacttgggccaggtacacagtggggtagggcgaatgtgcacacatttccggtggacttgggggagaccctctaggtctccttgaagcacagagccagtgcacctggcttctctgccagacacagcaacagtcacggccattggccacagccacctccacgacagccacagctgcatttctccccctggggccggctgcaccggagctgcccacatgagtgtccttggctgacagcatcgcagcctcactcttaggggtgagcgagcagcaggggtggtttggttcagggaccccaactctgggagcccacctgcctggggctggactcaggccccgtgttgccttgtgggtgggtgggtggcactgccggctgcgcccacggcgattatacagacgacttggtcttcccgtcgtccccagcccacaggactccagcctccacaggctttgccgccctccccaggggtcaggaagccccggagaccataggacagaggtggtttagtcgggagcgtcgccctgggggtaggtgaggcaggacaggcagtgacgccgcagccttggctgtgacaccacctggtgggctgcagtcccacttctgcccctgccaccggccatgtggcctgctcaccgccctgggcctcagcatcttctcctgcaaaatggggtcgtgatggttcctgagagtttgtgtgtagagggcagtgctggcacaaaacgtcagagacagggcccctcgcacctcctgcccgccccacgcagctgcaccaggctctgggggagggtgggacctgagcttggttcttcttgtgggaagcgctctcactccctctctgtccctctccctctcaccgtctctctgtctccgtctctcttcctccttcactctcgctctcccccagcacaggtccgacagtctggttcggtgcccgctgctctgccgccctctgggctcctggctggggctctgctctgcttctcagcccgctgcctgcccactgcccgcctaccgcccacctgctgcccgcctaccacccgcccgctgtggatcctgtgcttcacagcccccgtctctctgttttctggcactggaagaagacactctttttaagacagtcctgtgactcacaaccaaagggaggtcaagtgcatttgcacagttgtatgcagtctgggggtctccgctcaaggctggggactgtgtgtcgggcaggtccttcggtgctgggcacggggtctttcaccctgtagacgtcgcttgtggggtccttggaaactgagacccccgctccccactttctgatgagagggccccgtctgtctttatgccatggtccagggtgagttgatttccttgtgccgtggtccagggtgaatgatgtgccacatttcctgggaatgacattttccgtatgttttccagacggcattggcatggcccactttggaatccagcaggtgacttcagggcccacaagcctctcacccccaggaccccgggtgcagccacagcagttaagggagacacttagacactgccgtcttccctggaagcttccagttccaactccggggctgttcgggtttcgtgtatttcactgctggcttcactgttttaccaacagggctgacttggaaacgaggacagccaagcgtgtttgccaaggaaagcccggatctccggcgtgcagtgccggctggggcccctggcatgggtcagggccgggatcaggcccctccaggttcggattgtccatggggtggtgcttagacactgtctcagggcggggcccagcacgggcagtggctggcaactctccagccctgaggggttcctcctgcctctgtccttcctgtagaggtgcagtcccctggtgggccgtgggggtgcagggggtgctggggccactgcctacccgtcctggttgggggtagacctcgctgggcagaaccccttcctagcacatggcccaggggtctgcttgccagttggattttcccttcccttccctctgaaattccctggttcttcaattttggtccctttttctgggcctctctgacttgtctgtaacagaagtgcagagaggtttggtggctgccgttggccgggacacaggcctgcagaacccgccttgctggtgactgcacaggccatccatgtgggtgtggggagcccctgtccctacacccccggctgctcctcaggcccccaggtgtgtccagcctgacacaggctgacgctcaccccctcacctgcggtttcagtcacatgtggtcagccgtggtccaaaaatgttaaatggaaaattctaaaaataagcaatttctgagtttttaaaattgtgtggcattctcagtagcagttgaggccccgcagtccacctgtcagtcactagcagcctctccaggtggcgagaacacagacgcacggggcccgggctccacggcttccggtgtccctggggccttggagtgtttctcgaagggtacacagttcccaaacggctggacatttaaacaggtccgggcagcagagagaccgaaccagcctgggattttccgagttgaggctgtttgcccaggtgtcctggtgtgggatgtgctttctggcattttccatggaagccacgtcagccgccttcttcccaactgctagggccggctgctgcacttgtcttggaggtggtttccagaacaaacttccagccagccgtggggcgcagcgcagggggactgggcccagacgggggtccctggctgctctgagcatcacgtcctccgcctgacagagccctgcctccaggaccttcctcccctttccaggccacgctgaccaagtgctttgcaggcgggcggctcctgggtgttgcgcacaagagtctaaaatctcctttcagaatgcttggagggtgctgtgcaccccatggccgaagctctgagggtgccccaggacgcagtggggagggtcggggccgaggggcagccgctggtgctggcacagaggcatccacatcggcgcgccctcagcaccgcgggccggggcggggcagagtcagagctgcgtctcctgcgagctcctccatttaccattcggcgtcttcctattgcgcagagtttggaaagccttgctgtgttcaggtgtggcagtgtggtctctccaccctggcctgccgctcttccagagcagacgctttgcaaacctgcagtttttcttgcttgattaggacaatagtttttaaacagcattagagttaaggagataaaactgtgcgtgtgagcatcgagtggagcatgtgggggctgtggggggctgcaggggggctgtgggggggctgtggggtgggggctacggggggctgctgtggggggctgtgggggggctgctgtggggggctgtgggggggctgctgtggggggctgtgggggggctgctgtggggggctgtgggggggctgctgtggggggctgtgggggggctgctgtgggggctgtgggggggctgatgtgggggggctgctgtgggggctgtggggggctgtggggggctgtggggtgggggctacggggggctgctgtgggggctgtggggggctgtggggggctgtgggggggctgctgtgggggctgtgggggggctgatgtgggggctgtgggggggctgtggggggctgtgggggggctgctgtgggggctgtggggggctgctgtgggggctgtgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggctcgggtggccgggccccgactgctgtggtctggggggctcgggtggccgggccccgactgctgtggtctggggggctcgggtggccgggccccgactgctgtggtctggggggctcgggtggccgggccccgactgctgtggtctggggggctcgggtggccgggccccgactgctgtggtccggcatcagtgggcgttgctgccttctggcctgcagggccactctgtgcagcctctttttcttgtgctgctgaagcaaaggttagagtgtagcccaaagctctgttaaaataaatttcagagcttttatttcttcattctttaaatcccttctgaggtctttctcccgcccttgtgccttccactgcctctctccttgctgtctgggacatcccacggggttccttcttccctgggtctgggctggtctctcctctggactctcagccggcctccatgccccttgcccttcctgcctcccctcatcccggccatggggtttcctacatcttgttgggagggggccggccagccccattccacacacacacacccttaacgtcctgaccccagcccaccaggtctcagggctgcagccctgctgcactttcgcctgttcacgtctctgcctcagggctggcctgggcgcctgcagccctgctgaactttcacctgttcgtgtctctgttcccccatggctctggtgcagacccctggatgtcgctggtgtgaggcctggctgggcacgcggaccctgggatccttagcgcctgctgacccgcacctgggtccctgttgccttgtccgcctgttctctgtcctctcagctctgcccccagggtagagggcatggcctcccgtttgattttttttcctgctgtcttggctgggcctggctcgtcgctgatgagctgttgaccacaggctgcccgctgtagccctgtgtgctgtgtctttagccaggtgccgtgctcccctgcagcccccagacttggggttttggccctggggtccacttgggcctctctgtgctggcagccggcctgggcctggatgggggctgtagcccctcggcgtgctcagctgagggctgagagctgcctttgtctgaggtctccatctgggcccgctttgttcccaggggtatccactctctcgctggtggtctccctggaccccctgtggtggggccccggccgtctgcactgctgcacggcgtgcacagggtcacgaatgagacaagaccccatggtggggccttgagacccaggcagggccttcctgaggcatccactccgcataggctgcgtcccccgtcctgtcggctgcccactctctcccgcctcttgccctagaaacctgcacatcagctcccgtctcagcgtctgcatcccgggcaactgtgtggccctgcagaggggagccattctgtaagatggactgggacgaggagaaggacggcagcctttgtggccgggcacttccgttctgtgattgctgcttcatgtaactgctctcttctgggagaaggaactcagagggcgtttagatgcttcaggaagacacttctggtggggttttcaggctgcatcatgcctttctttgagaaacgccctgaggcatctatttgctgcctgcctcttcgctgtgacgttctgtctcatgtagcagcgatggcgtcttttggaccattgccctgaatcgggaataggatgggtgtttgggtgtttgctcctggcgccctgtggggatgcacacagcatagccgggcaggttgccggctgcttgtagacttgcggcttttcaggacacactggcacctgccgtctgaccttatctgcagggtattttattgctcaagttaactgaagcagagatgagtgacagtactaagaccacccaggcctctcgcccctggacagttcccagttagctctaaagatgctcatttggtcagcccatatctgcggagaactgctcggttcaggaggggatgtgtgcacacaaccatagctgctgtgcctggtggaaggggaagtgccacagcctcagtgacaactgtgacgccatgaacactcagggacaggtgtggtggctttgggggtgatctgggagcctcgtggaggagcagactcagagtggcctggtgcacgggaaggattgagacacagaggagggcactgcaggcggagagaacgcatgttcaaaggcgcacatgttggcaaacacggagtgcgtttggctggggtgtagggcgagtacgtccgagggagcagcgagatcggcctggacacagacggacgttgcttgtaggggctccagagcctggctgaagggtcagtgcttcattcggtgggtgctggagagctgttgagtgctttgggggacgaggagggaagggtggtcataactgtggtggagacccgcacgctagtcagtgtggtgctacagtatttagagaatggaaagggaaggcgtttgggaaatgggtcatttggctggaaaggagcagttgttcccataggagcaatcgggttattccaggctggaacagtttgaatcacggaggagggtgagttgtacccaggacatggatggtcagccagagctcatactctgtgcaaacttcccggccagggtccccagtactgagcgctatgagaaggtggcttcaggcaggaggtcggctcacagatgggcaatgcacagggttccgagccgggcgtgcagaatcacccagtgtcggacaacggctgagatgctgttgaggtgactgtgagagaggcgatttgctagaggaggcatgggtcggtgagcagctctcagacccaatcctgcgccagggtcaccctgcattttcgagaacgtggactcccaggcagcacgccggggtgggcctgcgcactcccttcccagcacaccgatgccgccagggccacctggagagcaccccttttccggcacaccgatgccacccaggccacccagagagcacccccttcccagcacaccgatgccgccagggccacctggagagcaccccctcccggcacaccagtgccacccagggtggcatcttcctgtaggcagattttgccagtcgttgtgtgaaaaattaacgttgattagcttgtagtaccaaagaggatcgtggttttatgtcataattgctctgcccccacacactctgctgagtcaagtaaacacaatagcttaacttttactggattagaaagtgagacaaaactcaggattggacttatttgctcaaatcacagaattgtggagttggaaagagacccagggtcacctgaggcccagccactcagcttacagatggggaaactgaggcctggagaggttggatgagtcgccccaagccacctggttttggaaacagccgggcccatcatcctgtccctcagagtgcctctcctgagccttgcctgctgcttgagctctttgatgacttgtgagtgtgagtggacgcatgtgaaggtgtgtgcatgacataaacaagtctccattaatcagccgcaggaaggagtgaagccctgagactacagcatggaaaaatctagaaaacatgaggctgcatcaaggaagccaggtgcaggaggccacatgtgtgattccatttctgtgagatgttcaggacaggcaaatctgtagtgatagaaggtggattaatggatgccagggactgtagggaggggagatgggagtgggaatgggtatggggtttctttttcgggtcatgaaaattctctggagttagtggtgatggttttatagctctgtgaatatactaaaaaccactgtgtttacacttaaagggtgaattgtatgatatgtgaattacatctcaataaaaaataattgcagaaaattactgaaaagccccaaattattcaccaatggaggatgataggtagccaagtcattatttgaaaacccagtaaataaaagggaataatcaagcatttatcctgactttcctgtgtgaacttcactgatgggttactaaatagtaaattccgcttataaaattatttcatttcatgaattaaaatgaaaggtagaataatagcatcacctttaaccccctactagagcagcagatgaagtacatactgcatggttctgttgagctgagatgtaagaatagggtgactctagaactctgaagagtgctaagctttaggtggggcgggatatgagaggagattctggagcgggggagcccgcgcctcggtctcggtactgactgtgtggctgtgcacatatctaaacgtgtgagctctatttactgagtgtatattatagcccaacaaaatgcataaataaaaataatacaattaaatataagctctaaaagaagtatttatttataccctttcttgctccaaaaaaggatgtcaggtagaatgtgatgcatgtgtactaaacacattcacatttgccaatgttgcctctatcaatacttaggtaaacatgttttttttaagttgcaaaatacacataacatgaaattcagcattttaagaattttaaagtgtacgattcagtggcatttagcacatttacaatgctgtgcagccatcatccctctctagtttcaacactttgtaatcaccccagaagaacatcctttaagtaatcacttcccatctcctggcagccacaaatgacatatcacattttgtttatccgttcatgtgttgatggacatttgggttgttttcacctttttggactattgtgaatagtgctgctatgaacattcgtgtttgttttgatttgcacaccagttttcaattcttttaagtatatacctaggagtgaaattggtggatcatatggtaatgctatgtttagtttattgagtggtggaattgaaggtaacctgctcatatttcccacaacaacaagaattctgtacctatgcacagtcaaaagtctctctgtgggactcttgggattcagacattatcatacatccacaagcaccaagaacattcaggcaaatgtgaccttacgaaatggataaaataaggtgcgagagacgggccctaacatgatgatggagatgtgtgatctctcagacaaaggattcaaaatagctgttttcaggaagctcaatgaacttcaagaaaacagagactgaatttacaaatttatcagagaaagttaacagattgaagtaatagaaaaaatcaaatggaaatcttagagcagaaaaatacagtgaatgaaatgcaaaaatgaaagagagagcattagtagcagaactgatcaaatagaaggaggaatcagtgagctcaaagacagagtatttgaaaatacacagagaagaaaaaagaaaaaaaatgaaaagaaatgaagaaagcttacaagatctatgggacaacatcaaaagaacaaatattcaagctatcagagttaaaaagggaattgagaaaaacaaggcagaagaagacctattcaaataagtaacagcaaactttccaacctggagaaagatagaaatattcaggtacaggaaggtcaaaggtcaccaatcagattcaacccaaataagaataagacatactataatcaaaaaactctcaaagatcaaagagatgatgtcaaaagcagcaagagaaaagaagcaaacaacatttcggggagatccaatatacctagcagcaacttctcagcagaaaccttataggccaggagggagtgggatgatatattcagagtgctaaaggaaaacaattgtcaactaaaaatagcgtacccagcaaagctatcattcagaaatgaaggagagatggcagctttctcagacaaacaaaagctgaggagactcatcactaccacacctgtcctacaagaagccctaaagggagttcttcaaaccaaaggaaaaggatgctaatgtgattgtcatactaatactgtaattatggtgtgtaaaccacttctatcttttgtaagaagaatgaaagacacaattaataaaataataaccacaacaattagttaggagataggcaatatcaaaatataaattgtgacaccaaaaattcaaaatatgggaggagaagagagttaacatgtacatggttttgtctcttttttttacaatcaaaggtaagttggtatcagttttaataacttgttataactactgaatgtttttcataagccttatgagggctacaaaaggaggtcaattcagcaaggtgatataacaatagtaaatatatatgcacccagtaccagagcaccccgatatatataaagcaaatattaatatatctaaagagagagacagactgtaatacaataatagtaggggacttcacaccccactttcagcaacgggaaggtcatccaggcagaaaaatcaacaagaagcattggagttaaactatactctaggccaaaagagcctgacaaacattaacagaatatttcatccaacagctgcagaatacacattattctcattggcaagtggaacattctccaggatagactataggttagctcacaaaacaatctcaaaaaattaaaaaacgtcaaaattatatcaagtctcttttctcaacacaatcaaaaaaactagaaaccatagcaagaggaactttggaaactatgcaaacacatggaaattaaacaacatgctcccgaatgaccagtgggtcagggaagaaattaagagggaaaatttaaaatnnnnnnnnnnnnnnnnnnnnnnnnnnnnnnnnnnnnnnnnnnnnnnnnnnnnnnnnnnnaaattagtagaaggaaagaaataacaaggatccgagcagaaatgaatgaaattgagacaaaagagacaaaagatcaacacaatgaaaagctgatttttttgaaaagataaaattgacaaagctctagctagactaagaaaaaaaaaagataagaccccaataaataaaatcaaggatggaaaaagaaacattataactgatagcacagaaatacaaaggctcactagagactattatgaacagctatacaccaatacattagaaaacctagagaaattttataaattcctggacacatacaacctaccaaggtggggccataaagaaacagaacctgaacagacgtagaaatcagaacaaaaaatctcccagcaaagaaaaagcccaggccctgatggatcattcaaacatttaaagaactaataccaattatattcaaactaatccaaacaaatggagagaaggggatacttccaaactcaagcagtgaggttagtgttacctgatacccaaaccagacaaggacacaacacaaaaagaaaactaaaggccaatgtctctgatgaacacagacacaaaagtcctcagcaagacaccagcaagcagatgccagcagcacattagaaagaccattcagcatgacaggtgggactcatccaggaatgcagggatggtttaatacctgctcatcaataaatgtgatcggtcacatggatataacccagaacaaaaaccatgattatttcagtcagtgctggaaaagcatttgatacaattcagcatccctcatgacaaaaactcaacagattgggtatagaggaacatacctcaaaatggtagagcctgttgatgacaaaaccatagctaacctcataccgaatggggaaagctcagaaacctttccactgaaatctgggacacgacctcacaccaaatggggaaatctcggaagcctttccactgaaatgtgggacatgacagtggagggggacccatgtggccccagacccttcatctttcacagcagggagccagcagctgattttaagttgatctaagaaatagcaatgggactgttatttaaagttgaaatgctagctcaaaaaactaagaaattagtaactgtggttatttctagagagtgcgtctacagatgggcatggggctttagggctactcttaatttttaatcttggactcctatagttgaaagttttctaccatgcatttctggtattactgaacaataacaccaccaaaaaacatacatatatatgtatgtaacagattttatagggaaaccttcaaaaatagaatgttcccacctctctccaccttctacttgaaactttgaactggagttgtagattaaggctctggaacctcttgtattttctccaggaaaagggaactggctttctttttgttacgcatacctgagggccagccctgtgaatttagaggaagcaagggtctgcgtgttcactgcctgcgcctgctgcagagacgcccgtgcccgtcaggcatgtgtgcttgtcacgtgggctctctgctgtgaggtgtttttctcttgtagtttcacagcccatgctccagtgtgggcaatgtgaacccagactcacgctgtgatgagctcagggggcaagcctgcctggtcggaagcggaatctcctgggacaggagacccaaagtgatgtgttgtggaccttttgctgccacgcagggaggagcctcggtcccttctcttcagagacagtttcttcatctgtctggtcttacaccaaaaatattaactgtctcaaaactgttgccacaatcatgtacccccattttgccatcataaaacaaaacaaaacaaaattaaagacagatatttctctgactcaaagcaaatatataaccaaaaagacagtaacaagtgctgacgagggtgtagagacatggtaacgcttgcgctttgcaggcaggtgtgaaggcacggccctgggcaggcagccgggtggctcctaggataattaaacctgttgccgtgcggccccacccgttggtaaataatcaagagaatcccaaagctgtccgtgttcacatgggaacttgtgcacacttcacagcggcaccattcacaacaactgaaagctgggaacagcccaaacatccatcagtgattaacaaatacacagaatgcgttccatccgtgacatgaaatatcatctggccaggaagatgggcagagctgtgacgggctaagcacgggcgaaccttgaagacaggacgttcagtgaaagcagccaggcacagaaggggaaggaccgtgtggtcccattccatgaaatgtccaggacaagcagacccacagagacacagagtggactcgtggttgccgggggctgggggaggagggtgggtttcgttcagggggacggaaatgctcgcgtcaatcgtgataacggttgctcaactcggaatacactaaaaaccacgggatcgtgccctttaaaagcagggagttgtgtggtgtcaatcaagacacccacacacgtgccgtgaacacctgtgtgcaggctgtggggcggccgtgcgcggctgatgtctgtgcagggctgatgtccgtgcagggctggcccaggcctgccctttcctcctgcttcctgggtcaccgggcaactcttctgcagctgggagcaggggctaaaggcgttccttagttctgcggctgggtcagacagcaccttctgcttggtcctctgcctgggcttgccgggcacctgtgcggggctcaggtggccgcctcctgccctccatgccagggaagatcaggttgtattcaaatcaccctctgtgaggtttccaccaggtcctcaccttcattctctgcagctttccccttccccctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgctcgtctcccctcgtctcccctcgtctcccctcctctctcctcctccgaacatccctgccatcttggtctcttattttcttcacccttttcagctgctctgcccctctaatgagaactattagaaattgctgtgcaagtagcagaaagtgcagcaggaaggagcgaaggagcagaaggcttaggggacagagccctgctgggaggcttgaggggagctccaccagggattcgggactcgccaggctctgctgccctgggaggaggagctgggggctgtccctgcaccgctgtgctggtaattatgaacttcatatatggtggagtttttaatccctatttatttcttacggatcgtctctactttgtttccataatcttatttattgttattagtaaccagggaacattttaccatgtgaaaattaatttgggaattttagggccaggcacagtggctcacgcctgtaatcccagcactttgggaggccaaggcggttggatcacctgaggtcgggagttcaagaccagcctgaccaacatggagaaaccttgtctctaatagaaatacaaaattagctgggcatggtggcgcacgcttgtaatcccaacttctcaggaggctgaggcaggagactgtttgaacctgggaggcggaggttgccgtgagccaagattgcaccatcgcactccagcctgggcaataaaagtgaaactccgtctcaaaaaaaaaaaaagaaaattaatttgggaatttaaatgtgcaaatctgttcaaatccatcaagtatggccttcagataaggaagtcgaagtgtgattcttcaggcattcctttccctagggggcaagaggcttacacttgaaggagcccaagagaattgctgtagaagggatcagagcaaatggctgggagctccagggcggggaagactgagaaccttccttatgtggccctgagagtgagcagaactgtggctcaagggtgtgcagctgaggtgttagaaaataagtcacacagcagaattttttaagtctaaaggcacgttaatcattgacatttccaaaatattattccttaattgtgtaggccttcacatgtctattttagatttgttgtgtgtgtatctgtgactgatgtgtctctctttccttttattttttttgagacagggcctcactctgtcatccaggctggagtgcagtggtgtgatcatggctcactgcaacctccacctcctgggatcaagtgatcctcccacctcagcctcacaaatagctgggactacaggcgtgcgccaccacgcccagctaattttttgtatttttagtagagatgaggtttcgctatgttggccaggctggtctccaactcctgggctcgagccatccgtcagcctcagcctctcaaaattctggtattaaaggcaagagccaccgcgcccggctcattatccgatttaaggtttttggaaggaaatgctgctcccagaatcaggctgtgtgtgttgctgcctccggccctccaaggccctctgataagttgtctgaagttatctgtcactgaaatgggttgtggtggtgtcgggcgggcgccctgctggccccgggagccgtcagccccatgtcagcctggaaggagctccactgagacttggggctctgaggcaggctcgttcctgctggcactgcccggggccctccctccagaggcgcaggccggggctgcagagcgggtgcaggtgactttgccttcccaggtgcccccgcaatcccgccggctctggaaacttgctcatttcaaaagctcgtgtagcgcgcccatctccaggaggtctctgcgtggactcctgctgccaatcttcaggagttttatgcccagataaacacagcccccattcagaatcccatcacatacgctgaggacgaagggaataaatactccagactcaccacttccccgtgatttccccacaaggacgaagggaatcgatactccagactcaccacttcctgtgatttccccgcgaggacgaagggagtcgatactccagactcagcacttccccgggatttccccgcgaggacgaagggagtcgatactccagactcagcacttccccgggatttccccgcgaggacgaagggagtcgatactccagactcagcacttccccgggatttccccgcgaggacgaagggagtcgatactccagactcagcacttccccgggatttccccgcgaggaggaagggagtcgatactccagactcagcacttccccgggatttccccgcgaggaggaagggagtcgatactccagactcagcacttccccgggatttccccgcgaggacgaagggagtcgatactccagactcagcacttccccgggatttccccgcgaggacgaagggagtcgatactccagactcaccacttccccgtgatttccccgcgaggaggaagggagtcgatactccagactcaccacttccccgggatttccccgcgaggacgaagggagtcgatactccagactcaccacttccccgtgatttccccgcgaggacgaagggagtcgatactccagactcagcacttccccgtgatttccccgcgaggaggaagggagtcgatactccagactcaccacttccccgtgatttccccgcgaggacgaagggagtcgatactccagactcaccacttccccgtgatttccccgcgaggacgaagggagtcgatactccagactcagcacttcctgtgatttcacggcacgccattgctgctgggctccaggctgtctggctgggtgcttctggaggtgtgggtgcctctgaacggggccctgctctcctctctctggctttggggccacactggtcgcttgaaatcggccaggaatgttcacaccacagaaatcaggaagggccacacatcggaggaaattgagctcacgtttgaacaaaggttttgttgatcatctaatcttgctaccctgaattaaataatcttgtatatagcggttacactgcaatagcacaaaaaaattaagacaatgtttttctggcatttaaaacttcacctgattcaacaaagttgcttgtgacattgatgaatgagtgaagcgccagcattcccagtgtgaaagccagaagagatgtcagcttaatataatttgtatgagtgggagaaatgttttaatggtcgacacatatcacactcagtgatgacgcactttttgagaaccagctagcagagggtgcgttgcctctgtttgtcaaatcctggttaaatgcagcccaggattggcttagagacaagagtttgctgtgagaatcaattagctctgtgagtttgaagtagaggactgtgtatctcattattttttgtgagttgtgtgctacacatcttttacactagtgcaatgtatgacttaacctagttgagctcgtgcatgcatttttcccctagagaaccaggttgttaaacctctgttgggaccacccacctgggggtgcagccccaggcctgtcccttcccctcttgcgtacaggctgggtgtgaactaaacgttgcttgggttaaggaaagttgttttccctgccccccattccttctctggggctgcccccagacgggacgcagctgggagacgttcttcatggttttatctcagtgcggcgcatcaagggagaaagacccagttccctttgttcctcactctccattcaagcgcgtgtgtccacccggggagcagcctcggagcctcggagcacagggaggtttgcccactgtccgtgatcaggaagaaagcatctctctccgaggcagatgtcagcattgttgccactgcccgttataagagactagggttccccaggctcaggccctgctcccaaggtgcagccgatatgtgtgcaggcatcactgggttcccaatcccaatttggtactgcgtgaggcaaaccagggcacctgcagacgctgcagctctggctctgctgttgcggtgatgtcctttgtctcagacgtggacgtctcgggcctcctgcctgcccctgtgagacccgcagctccccggtgagtggggcgaggaggtaggggcatcttcacaccttctcagttctcagcagtaagtaatgcctctcagtcctggctgcacccagaaccacctgcaggctttctaatcaagacgaatgtctgttcttactgcctggagcccgtcctagtcaaagaatggcaatctctgggtggggtccaggcatttgtcctgtgagaagctctcctgtgtgtgcagctgcagccggtgagtgcaggtgtgaggtcctgtgtgtggactcaggagaggagtcacagccccaggagatgcagcctggatgcggggcaggctctgctgcgctaggaacacgggggccctgggggttcctgtgcagcaccggtgtgtctctgctcctttgtgaactcagaagggcggcttcatttcagcccacctttgccttctctttcctcgttattccctgggtgttttcagccgccagtgaaacttcggttttgaacccataggatttgcctcagtctcctggtggacacgtctctgtggaggagaggtcccctgtctgcaatcgccttctttcccatattttattacctgtttataagagtgagcacagttagaaccagctgacagggtttggagtcgtgtttctcaggatattccagaggcactcctgctccattcatctcaggacttgaagtattttccccagcggctcattgtagaccagctggattcacaggcagtcagaaccacgagagtgcatgtgctggtggccgtggtctgcggacagcatttccagagtgctgggtgatgcggcccccgcgccttgagggttatactgcatcgggagactgggcagccctggggaggcccggcctggacaaccttctggctgacctggctccaaggccaggtctcctcctagacgtttagggatcacttgggtctcgggacgcgtgagtctctggagtgacgtggcagcatctcctgtgtggcccgttgctaacagcctttgcaccaagcacgagaggagggtcatttgcaccaggagcgtgtaactggggtactgttgcgttttgggtgggcggccctctgccacgcagcactattggtgttctacgtggatggccctctgccgtgggacactcttggtgttctacgtggacggccctctgccgtggggcactcttggtgttctaggtggacggccctctgccgaggggcactattggtgttctaggtggacggccctctgccgtggggcactcttggtgttctaggtggacggccctctgccgaggggcactcttggtgttctaggtggacggccctctgccgaggggcactattggtgttctaggtggacggccctctgccgaggggcactattggtgttttgggtggacggccctctgccgaggggcactcttggtgttctaggtggacagccctctgccgaggggcactattggtgttctaggtggacggccctctgccgaggggcactattggtgttttgggtggacggccctctgccacacggcactattggtgttctaggtggacggccctgtgccctggggcaccgtgtgcagcaggacactgaacagaagacaccctgcactctgcccaccagatgccatttgcacagcccatagtgaaatccaagcgtgccctgggaggtggcccctgggggagacccctgtttcagtggcccctgggggagacccctgtttcagtggcccctgggggagacccgtttcagccgttgtcggggtcaggcctccagtaagcacagtgggcgccttctaggacccctcctgccaccccgtcaccatagactcattctccctgtggtggaagtttcaattacattgaatatgcccgttatttgggagggtttaacatctgggcctggtcacccgcccctcagcagaacctcccgtgccctctgaagagccgtggagactggagggagctggaggtgctctcaaggagactggacgacaggcagaccccctggacggcagtgctgggccctccctgggcaggtggtgtcacccagtgagttttggaatcagcccgcacagccctctcctccttccaccgcccacagaagcccgctggtgccaggggctcccagcagcccctcccggccaggaggattggggggtgccttgcttgaggatggcagcctgggcttctgtcattcataacccacaggagtcctcttgagggaggagcatggtgccctggagagccctggacaagacctgggcctggctccatccaagcccagcggcctctgcccctcctgagcgtgaggatagagcaggtgccgtctgccctcgactcggcccagaggaaaccccactcccacggcctcgccgagttctgcctatttctggcagcttcgcaggcccttcgggaaggcacttgtgttgccaggggtcgtgggggtcagggtcatgctgtgtcctcaagacgctgtgtcccctgcctcggggcccccccgcctcttcctcttatggcctctgcaccgcagtcagcccaccgagatgtgcagcctcgtcccacggagggtgccgggtggggaggccagtgcggacgggcactcaggcccactcagaggccagtcacggagcccccgtgtccagaggcgaacaggagccagggggcacatgggccttgcagtcagcagctcagagcccggagaggggtctctacccacgcatggcacagaggcttctgtgcctcactgagaccctgccagggcctggaggaggacctgttcgagtgaggatcccaggggccagggctgggatcgctgttccaggcttctaaatagcccaaagtagacggggctcttcatcctttattcagatattttagtcacaagactattgttccggtaaatactttatgttgttagaagacgctgtgtgcctagcaaaatttttaggcccctttgaatgttttgcgttgggacgactaaaaggctgaggttgggagccttgagagccgcacttcctccaattctcccgcagggtctccttccccaacaggccctgggctttattgctgggacggggttgctttcgctggaccatgcaccggggctgtcgccatcacctgttccacgttatttcagtgaggccgacctgtagttgagtaaaacgccgtgatgacgtgggaaagagaagagcgcccagcctgggtggacgcggccagtaccagcacagccctggcctctccaggacgtcttctgtctgggttggtgccaggagctttgctcagtggagccctgggccctcgtcctcacccgtggctgccttcattccttcctccgccctcttcactgggcgctgagctgagctgctgagcgcctgggagacgcccgctgctgtgttgagcagtacatgaggccagccccgcctgagggccctccccaggatgcctgcagggaggagcagtgctgggtggggtctgtggagacctccccatgccctcacagctcctcctgggtacaggggtgtggctccgggtgctgcgggcagccccgacagctcgctgtcagcacttggagaccctgtgtgggcctccagggaagcctgggcatcctaaccctcggtcagggctgggcctgtgctcaccctgagggtgcagcttccctccatggcccagaagggctgccgtgggcgtgggagtcatgacgctttggatcagggcctttgtttttgttactcactgcctgatccctggagttggaaatcaggttttgcggtgttatgctgtttacattaaatgtgtttaagtgctgccttttactcctgttagttgagttttcagagccgatgcgaggtgctgtgttggctgtcttcatcagtctgccggctggtgaacacaccgcatatgttttagaggcatggtctgtgggaaaagtggtcatgagaactgttacttatttggctgttaggatgaaaccagtttacttttcttttaattcatttattcatccatgcatgcaacagataattaggtacttactgtataccacagacagctttgtctttttatatgaacgtctctgtgcaccagaaaaaaaagagaaaacgtgtttcctctaagagagacagaacaggcacctttggtgaaggtaactgaatgaactgtttggggtgcggtggagaagaaacagttgcttgggagctggggcagcccccgtcccgctcagctgtggggctgcagggagaggctcggtcctggtgcatgtggcacacacggcgaggccccggggcgacgtggccaggccgtgctgcagcagccccagccctcctggtctgagcagctcattggatgttggtgcgtccagcaggctccctggtgttgctgtcgtcatagcaaccaggatgtttctcaggagttttttttttttttttctgtttcaatgctttattaacagttggaaacaaaaccagtgccttggaggtgatggcatcagaagcctgaggcagggaaatgggcttgcattttgtccccccacttttttttttattaaatgcatcatagcaaaagtagattaaaaagaaagagtctcagccccagatgacagtgagcaaggagaaggaggtaaagacggggccatcgggcggggagggaggaacctggtgtgttttggggccaggggactgggcatcatcgggcagggagggaggaacccggtgccttggtgccagtgcgggggaactgggcatcgttgggcagggagggagggagggatgaatccggtgcgttggtgccagtgtggggggactgggcattgtcgggcagggaggaaggatgaatccggtgcattggtgccagtgcggtgggactgggcatcgtcgggcagggagggagggatgaatccggtgcgttggtgccagtgtggggggactgggcatcattgagtggggagggaggaagggatgaatccggtgtgttggtgccagtgtggggggactgggcatcgtcaggcagggacggagggatgaattgggtgcgttggtgccagtgcggtaggactgggcatcgtcaggcagggatggaggaacctggtgcgttggtgccagtgcggtgggactgggcatcatcaggcagggagggatgaatctggtgtgttggcgccagcgcagggggatccggccttttcatgtcgtacggcgtctgtcttacagggactccacagaaagcttgtgtgtttccgtcctgcagtgtccgccttcggaagacccagctgttactgctgtgatttgaggccctgtgggaacaaatctcagttccgtattatccacaaacaccatctcccacaggactttcaaaagcttttttctctctccttttaagaaacacaggaacttacagctaaatatctacactcatttgttgcaaaaaacaaagaaatcccagaaaacaaaacaaaaacaaaaaactcccaaagacaaaaacaaaaaacccagtaaaatcccaagggaaatatggtcagcgtcaggtcacactgtaaaggtgtcagaaggaaagtcagcaaagtcaagctgtgtttgagggtaaggacttctatctgctgcagaagccgtcagttccaaaacagggccgggaggctggaggggcccctgtccgacttgctgggtgtgctgcggctgccctcaaattcaggggcagccgcggccaccaggaaggctgcgtctgctccgggaacctcaactgccatcccccaggctcccttccctctctggagaagctcgccggccatgttctccccttcgtgcctgtgaactcatcacacaccctgcctgcgtgtgccgcgtgtgtgtgcgtgtgctgcctgcgtgtgctgcgtgtgtgtgcggtgctgcctgcgtgcgtgtgctgcgtgtgtgcgctgcgtgtgtgcgtgtgctgcgtgtgggatcttcacatcggtgggagccttcggaaagcctgtcttctgacatgggatgaccgacctgaggcctggcctggagccaggtgcctcgtagcagcctagctgtgttctcccatgcagcgggtgaagaaggcgcatcccgggagagtcgccgtgttgaggtgttctgagggtccagtgcctatcaggaaatactcattttttcccaccaaccgattatcattgatgcttccttaatgattcccaaaataaaaatttccagaaccttttgaattagaggcgtctcagagccggaggagccttcgagagctgctgtgtctcttgcttttgcagttcaggactttgaggcccagagaggtagactgtgtgttgggggcactggcgggaaacggccgcaagcagtgagaccctgagagctgctccgtgtgggcagcagcgggtgctgctgggaacgcctgccggcgcctccacacgcagagatacgcggcgccgacacgggaggcttcgtcctgccggcgcctccacacccagagatacgcggcgccgacacgggaggcttcgtcctgccggcgcctccacacgcagagatacgcggcgcggacacgggaggcttcgtcctgccggcgcctccacacgtagagatacgcggcgccgacacgggaggcttcgtcctgccggcgcctccacacgcagagatacgcggcgcggacacgggaggcttcgtcctgccggcgcctccacacccagagatacgcggcgccgacacgggcggcttcgtcctgccggcgcctccacacgcagagatacgcggtgcggacacgggaggcttcgtcctgccggcgcctccacacgcagagatacgcggtgcggacacgggaggcttcgtcctgccggcgcctccacacgcagagatacgcggcgcggacacgggaggcttcgtcctgccggcgcctccacacccagagatacgcggcgccgacacgggaggcttcgtcctgccggtgcctccacacgcagagatacgcggcgcggacacgggaggcgttgtccagaccctggggcttctgctccttctcacagtgcctcaggttaatattgtggatgaaaagtctttaaaaagcttcaaactgagtttatctctgccctttggagttgctggcatgccagtttgcaaactggcatctttgaaatgagccgactgccccatgtgagccatgacgtgtgcgcttgctgagttgacgcgaaacattcagcgcggagtggcggaagtggggttctgagaaacttctactctgctcccgtttttgattttgtttgtttcaacaagaataaggtgatgtggccctgagtggcgccagcaggagccttggtgtggtctcagcgtggtgcctgtgcctgcatctgtcctctcatcctgcgtcgtggagacgccactgccaggcgtctttagagccaaatgacggaggcagaaaaggccctggggaggcgcgagtgtgtttgaggcgttttttttacagaatggacttaaactgggcatccgctgtctggattgacagctgtcactcatcccttcctgctcactccctattctccagtaaactgggccgttaggcttgccgctggggcatgctccgagcttccagcagagaagtcgcagctggggttcagttatgacctccagactgacccctggcaaacaaggagtccgggatcacgggcgttttctgcagggccagccaggaactggccccacttccttcaagcacgtccaggtggcgtctctgtgggcttgaaggagggagaggtggacctagcttaggtccctctgggacgcttctctttactggcaattcgaacagctggagtttacagttaactcacgtccacaagaaagagctctttcctttaattctggctccaactttgacctaatataaaataaaattcaaaataaaaagggactcagtggataaatgaataagcaagacgaggtccctttgcatcatggaagttattcaaccttaaaatagaagggaatccagtcagcggccacagcaggggccaccctggaggacatttgctgagtagagtgagccgggctgaaaggacacgtcctgtggatcccgccgacgtgaggccccagagtagtcagatccacagagacagaaagtggggtgagggccactgggagacagcaggagggggatgggagtgagtgttgaatggggaccgagtctccgtttgggaagacgagagtgttccagagaggacggtggtgatggttgcacaactcggtgaacgtggttaatgccacagaactgtgcacgcgagcaggtcagagatggaaaattgtatgttaaaaattaaaataaagggactaatgcaggtaaacaagacacagcaatcctgagtcccaggctggcaggtccctgcttgcgggacttgcattagagggtggcgtgcatgtccctcgcctttcggcagtacacatggggtgcacatccacattttgacttgtggtggcaaaaaaaccaaggctttatagagagctagtgaatgcacacaagcaaaggctggaaacgtgtctgcgatgtagcagggaacaaacatttctacgctgctgatgatgtatgtcgcttttactttttaggtgaagccaaaaaccttccctcttacccggggccgagcaagatgagggattgctactgcacggtgaacctggaccaggaggaggttttcaggaccaaaattgtggaaaagtcactctggtaatgtcttctgttgctttacttggcactgatgtgttttctttggtgtagagaatgtcccaagggtgtacgtcaccttcccattttcccatgtgtggagaacgtcccgagcgtgtacgtcaccatcccgttttcccgcatgtagggaatttttctgtgcgtagacaatgtcccgagcgtgtacgtcaccgtcccgttttcccgcgtgtagggaatttttctgtgcgtagacaatgtcccgagcgtgtacgtcaccgtcccattttcctgcgtgtagggaatttttctgtgtgtagacagtgtcccaagcatgtacatcaccgtcccattttcccatgtgtagggaatttttctgtgcgtagacaatgtcccgagcgtgtacgtcaccgtcccattttcccgcgtgtagggaatttttctgtgtgtagacagtgtcccaagcatgtacatcaccgtcccattttcccatgtgtagggaatttttctgtgcgtagacaatgtcccgagcgtgtacatcaccgtcccgttttcccgcgtgtagggaatttttctgtgcgtagacaatgtcccgagcgtgtacgtcaccgtcccgttttcctgcgtgtagggaatttttctgtgtgtagacagtgtcccaagcatgtacatcaccgtcccattttcccatgtgtagagaatgtcctgagcgtgtacatcactgtcccattttcccgcgtgtagagaatttttctgtgtgtagacaatgtcccgagcgtggacatcaccgtcccattttcccgcgtgtagggaatttttctatgtgtagacaatgtcccaagtgtgtatatcaccgtcccattttcccatgtgtagagaatgtcctgagcgtgtacatcactgtcccattttcccgcgtgtagagaatttttctgtgtgtagacagtgtcccgagcgtgtacgtcaccatcctattttcccgcgtgtagagaatttttctgtatgtagattatgtcctgagcatgtacatcaccttcccattttcctcctgcttagtttgaggaggagatgctccctggggctctggtgtgcaggcagctgagcttctgtccttggtggtgcgtggatgtgaactggtgttggctaaatgctcccgctgtccaggaagtgcatgtaggcggcggtccccctgcgtggactcgcacgagtgctttttaattagagatgaaccgggaagctcgcactccacaaaagagtacaaattaaggatttcgagagggggaaatactgagaaagcttttctcttcctgtaaaattttctaaaatagctatacagaagatgggtgttaactgaggtaagaggcctagaaagtgtttattgatatgatttgaggaagagaggagtcagccaagaaaaacaaactcttaaaatcaacaagtttccccctcaacttgagcgtgtgaagatgtgggtgccgaccccaggatgtccagagcacaaccagaacttgtgtttctgaaaagctccagctaagtggccaggccgtactcggaggaccactgcagttgaacaccaggacatggcacggggtgggatgcacagggacaggaagccatggcgatttatgtcgggggtgggaagagagaagccagggagagtgtgccaggcagggcctcagtgctgcggcctcgggggaagcatggggcggctgggttataagggagcggcttggggatcagagaagatgtccgtgtagctgtgactccaccgggttataaggagcggcttggggatcagagaagacatccttgcagctgtgactgcaccgttcagttcagaagcatgggtcgtgtgctttgatcaaaacagctattttgattttgagaacatgtttagctaaagaattatatccttgcatctggctacttccaagtgggaatgaacaacccatgctgatgactgggtgagtttacttactagaaaactgtgaggggtctcctgccctggagagactggggctcatatcactccgtcactgacagtgcttccaaaaggctttggcgcagctgccctccaggccgaggagtgagagtcatttgtgttatgttaatgcacgctccgggttctttgaaataactcgtcaaaaagaactgcaggctgaggggcattgtcaggcgcccagtctggctttatgagagtgtcttggggttgccatggcgatgactgggcacagccattcttctgaagaaaatgggaagagaccgagcccttcagaagtgcctttggagcttccctggataaaagtccattctgtgtttaaatggtctgttgttagaggcctatggattgtgggcctggagaattactggcagtctttctcaggccgggatcctctcagacccgctgaatcagagccagtgggaggagaatctgtttgggaacctctctttcaggtgaggttgagaaatgggggcctgttgtctttcagatatttcagaagaatttagaaatagaaatcatggttctggccgggtgtggtggctcacacctgtaatcccagcactttgggaggctgaggtgtgaggattgcttgaggccaggaggttgaggccgcagtgagccatgattacgtcactgcacttcagcctgggcgacagagcaagaccttgtctcaaaaaaacccaaaacacacacaacaaaagactgatagcaaagaaagagaaacccatgtgggacagttccaagagagtaaaactgtggcaccgtttagcgtggacgccggcagccctgcccacgtgtaacactgtggcgccgtttagcgtggacgccggcagccctgcccacgtgtaaaactgtggcgccgtttagcgtggacgccggcagccctgcccacgtgtaaaactgtggcgccgtttagcgtggacgccggcagccctgcccacgtgtaaaactgtggcgccgtttagcgtggacgccggcagccctgcccacgtgtaagactgtggcgccgtttagcgtggacgccggcagccctgcccacgtgtaagactgtggcgccgtttagcgtggacgccggcagccctgcccacgtgtaagactgtggagccgtttagcgtggacgccggcagccctgcccacgtgtaagactgtggcgccgtttagcgtggacgccggcagccctgcccacgtgtaagactgtggagccgtttagcgtggacgccggcagccctgcccacgtgtaacactggcgccgtttagtgtggacgctggcagccctgtccatttggagggctgtgcgggctggccgcccctgtagtgtgagggcaaaacgcaaatcaacccaccccatacaaaaagttggcaggaaaggtacttgaacccaaaagctggctctctcataaacttgcagctggaatccacgctacatctgtggtcggaagccctccatcggtgcacatgcattaacagagtcctgtattagtcattggtcgacatccacctgagaggcaggtgtcaggcagggctgccccacatgctggggagtttagtcctggccaccgccccctccttgctccatggtggcacccactttggggccggtcccccaagtctcctggtccccgagtctcccatcccccgagtctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccccagtctcccaacccccgagtctcctggcccctgagtctcctggccccctgagtctcctggtcccctgagtctctcagcccccgagtctcccggccccccaagtctcccggcccccgagtctcccagccccccaagtctcccagcccccgagccagccccccaagtctcctggccccccgagtctcctggccccccagtttcccggccccctcagtttcccggctccccgagtctcccggctccccgagtctcccggtccccgaatctcccattcccccagtctcccaccccccagtctcccgacccccaagtctcccaacccccgagtctcccgacccctgagtctcctggcccctgtgtctcctggccccctgagtctcctggtcccccgagtctcccggcccccgagtctcccagccccccaagtctcccggtccctgagtctcccagccccccgtgtgcttcctccaaggtcagtgtcacctttaaggtctgatggttcatttggcaaagtcgctgtggaaagaaaaaagcccacgtctgcatctctgagctcagaagggccccagggtgctctctggccgctgggtctgcagccgggcaggagccccttctcacattccctggggagaagcacttgggtcaagtttgatttgctgttgcccaatatcgccgtctgacttagcaggaagctgcaaatggaatgtgtgaggaaggaaaggcggaactcagcttctcttcttccctctttcccactaaggaggtcaccgacccagctccacctcaggcctgtgtcccccacgcctcctccctgcgtgtggcccgggcccctgggccgcgcgtccgaggccctggagtctgtggggcctctttatcgagtgctgagccgacgtctggggagagcgtcctctgtcttcccttttttctgtatttttcaaggtggaggttgaagggcagtgtctgtcacaggtttaacttcagaacgcatcgaagtggacacatttcagagaacaagccctttctctctggccttggcccttctccaaggaagtgattttggcagtttctgtcctactagaaaaataattttctgaggttgagagtgaactgtgttcacaatccataccttttagagcaatcatttttaatcatttaaagggcagccactatttgtttccttatttacttaaactaaaaggctccctgaaattgggttggcagggctggggcttgggaaccagcttcccgccctggacctcccctgggccggcacccacgaccctaaaacaaggagatgaccccgctccccaaggctgcgctgcagtggaaatcaccgtcttgtccagcagaaaggaacagctggcgtcacacacaacagaacctaaatctctccttgctgggttagtccagtcatttgcaagaatattcagtaagtgtcgtgtcctcatttccttccatccacgtaaggacgtggaatggtgtctgtccctgcctgcttcctctgcgcccacgtggctgacctctccccaaaccctcatccacgcagacagtcctggctcagggaggctctgcctcagggttctgggtctgaccctaccccctgccactggggttgaggctgggcaaagccctctgccccacgcggagccctggccccccctttctgtggagttgctcctgcgtcctttgcagggttcatttgcatgcccatctcggggagaaggggccgtggccacaacaggaagaaactgcaggcgtggctggtttctgtgccccctccacccagaggtgccacggcctgaactcctgctccgaaagctggttatgcgttaggttacaaagctgtgtctgtaggaaaagttcttttgtttaaaaaatcatgagcacccccaaaatgatctggatacgcagacaaaaacgtcaatgtgatgtgatttctgagaagtggaattatgggggagttcttgttcttttgtttgtgtgttttatgtacaattagaagttacaagtcaaggaacagatagatcttctagagctgagcgaggagagctgggtcttcccaggcagacgaggacatcagacatcaccagggaccctcacttggcagccctgaggggcaggctctgagctcttctgggtggaagcccgtcccgtcctgtgtgcacgcagtgggtgtttgttaaagacagggaggtttctttctgttcatactgcaagatgtaaatcacccccaaaatagtacttttgtgtagtagaaatgactaaaccaagaaatgtctccacagctccaaagtttttcgggaggggagaagttatttggggttagaaactgaaaggggcaggaggaagttggtggtttgggagacagacggttcattctctcagatgcttttaataaaaaccaagttgctgacttaggaaacaccgactttgacattaggcgactcatgaaaagtcacatttcccatgaacatttattttcactctcaagttagagcttaaacaaaaacctgcttgacacgactggaggcttcttgaagcccagaatatcccagaactgctggagtaggggacccatcctcagccccagagtaccccaggtgggggcccatcctcagccccggggtgtccgcaggtgggggcccatcctcagccccagaagtgccccaggtggggggcccgtcctcagccccagagtaccgcaggtgggggcccatcctcagctccagagtgccccaggtggggggcccgtcctcagccccagagtgccccagctggggggcccatcctcagcccaggttggggggcctgtcctcagcccaggtcagggggccagtcctcagcccaggtcagggggcccgtcctcagcccaggttggggggcccgtcctcagcccaggtaggggggcctgtcctcagcccaggtggggaggcccgtcctcagcccaggttgggcccatcctcagcccaggtgggggcccatcctcagccccagagcaccccaggccagggatctgttctctcagtcctggaatgctggccccaaatctcccagcaggtcagagcccctggtcctgtctgtatgacccccaagcccggcccagcatctccatctccacctgcatgtgtgtgtccttccgtgtcatgctggctcacaggagcgcacctgtgtcagaatgatgcagggggttctctcagccgcacaggaactcagccggcggagagcatgaggttgctcgtattctgtgagtactgagtgtctactgcacatggcaggctgccccaggcccaggcctggaagggactcatcggccgcctgtgcctgcaggagcctcctggccctgagctgtggctgggccactgcagggagaggctgggcctgtcacgagggggccgcaccgaggatcccatgaggagcaaaggccaggtccccccttctccctcctgcccgggcctcctctcgcccggccgcctcccgctcctcggccgctggccctctctcctgcccctggctcctccctggagagccccttttcccaccagggcctcactgagggtttggggtttgaggtgtctcagctgctgcaggggacccggtgtctggttgtgcctcctcctgagagtcactgctgcagtcacacatcgtggccgggccctaaagacccagccgattttcatttgtttgtaaggatggtggttcttttttggggggtatggggtgggagagaggaaagagcctcatgtgcaggagaggcgggagccgaggccacagtgtcccggggtgctgcgtacagtggtgtgtggcgtgtggtgtgtggcgtgcctggcgaccacagagcccatgagccgaggggcagctcctcggtgcccctgaacagatggggagactgaggctcggggaggtgaggtggctcaccacggccgctgcagctgtgagtctcagcccagcccgcctgctttcctcactgagtctttgggttccgtttgaagactcacagctctatttgccaacatttcaaaataaccccacccatcttgaaccacaggaggctgcaacccagtgtgtgtggggcttccgctgagacctgccgtgctgggtggtgagtgggctgtgagctgaccacggacccctgccctccagcctctgacctctgggagccagggctgtgtgaccctgcagtgctgggtggcgggtgggctatgagctgaccgcggacccccattctccagcctgcggtctgtgggagccagggctgtgtggccctgcactggccatgtgcttctgatgggtgtgttttgcctcctgtcctttgcggagatggagcattttccctggccaagttgccccttctctgtggggcgcctctgaggatgagtcaggcagtgactcaggaccgcagagctcagcccagaggctggcttgggagccccagggctgcttcgcagacccggtttggggtttggttcctcttcacgcagcctttaccctctaccccgaggctggggcagccctggcagctcccggctccccccagcgtttgggaaatgggccccgagcctgcggcagagcacagagctgggaaaccaggtttattttcttatgatcacgtgatgggagcagccgcaggcgggatggggcagcgccagccttgcgcagatgctgggaagtgactcagggaggagaaggcgggggtttctctgctggtcccagctgagcccctgctccaggctccaggaggaggaggaattcagttcagatggtttcccctcatcagagccactacttaaaggtcaactctgttttctgcaagaggttttttcttttttccccgtgaaagtttgcttgattctgtgaaacttcatttgcacttcttccagaaatgactgagggaaaggagactttgccagggtctctgcctcagagggagaggctgctgcgtgcgttaatttccttaggccacatggcaggatttcaggcgagcctggtcctctcaggccgcactttttctttatttggaaagagagttccagagccctcgggcggtgagtgggggccgcctgggccaggcattcatcccgcatctgactgctgctgacctcggctggagacaaagccggcctgtccaagagataccccgaggttaagctgctgatgggaaggggggcacctggtggctgtgtggcccctttgagtccatcagaaagaagagattgtccggcacaggccaccgaacaggatgggggatgggaggaatgccctagcgttcagccggtttcatttttcttttggaatacgcttcaaactctgctgcccaggaaggagaaagcacaaaccttcctgctgatgaaagaaaatgggtgcccccaccatgagacccacggacagcggggggctgtccgtgggcctgggctttgcacctgggagtgttggtgctgtgtggagggaactgaccctgtcctcaggctgagcctggagtccccacaacagcataggggggaaagctgctgtcctcagactccgcgtggcctccagtgatggtgctgtggccacttcctgccgggtgctcaccgtgggttctgggtggggctgggaggacatggggcgtaggccattctgcccacgaggtgacgtgatcgaggtggacgtggctggcctcgcagcctctgctcctgcaggtcctgggacgctgtgtccatctgctggagctcatttcagagttggctgatcacaggtccatagtcacccactggtgacaaatttaacaaatttgtgggggtttttttagttcaaaaaagatcctccttaaatgttgtgaaataatatgtcttttaagttgcaacacacattcagaagttcccggagggttaaatcctgagcatgaaaagatggtcattctaatagaaaacaggcccagagcatttcaagaaaaaatgagatttaaaactgctcataaaaagatggacattccacctcaccaatgagccagacatttaaaatttaagcaggtttttgccaccggtttagcaaactgtagaaatatttataagacggcgtatgctgggggtggacactggtccagactccctggagggttctgtggctttgtgtttcaaaggcctcaggacagtgcacatccttggaggaatttatcccacggggacaatcagccactgcacagatctgcgttcccagggtgctcacccctgctgctcccaccacacagcgtgcacatggcagggggacctggcactgctgtccacgcacacacgtgccgtctgaccccagcgttttatcagctctttggaaagtggcccatggcctgatgtgaaaggaaaaagctgactctgtcacagggaacataacctcacttttatttaaaaaatttatccgtatttccattcgtatcttctatatttataacataaatatttactattattgttaatatatttgtattataatataatgagtcattatagtatgaatatacttatatttgtattataaatattgtatttatgttataaatgtaatacaaatatatttatattttgtatattttaaacctataacatttatatattttattctattttatatttttggagaaaaaactccaggaggatgtttcctggaatgttaattccagatttcactttctgatttttttacgtatttaaaattttgtttctttaaaaatagctttattgaggtataattcaagcaccgtacaattcacccattttgaaatgtacaattcagtggtttttagtatatttgcagagttgtgcaacaattgccacagccaattttagaacattttcatctccctaaaacgacactcgcgccctgtaatcctccagtttccggcctgcagcctctcctggggcggcagacacgggtccccgttctgtcgccggctgtgcctctcttgggcatttcgtgtcagtggaagcgtctggcccatggcctctgtgtgcgtggcctgttggttggcaccacattgtggatgctgtggtgtggggccagggtccaggcgtccttcctctccagggctgagcaccgttctgctgttgctccctcagcagccgaggcccacctgccttgtttccactgtctggctgtcatgactgaggctgtgagcacgcatgtctgagtctgcgtgcgaacgtgggctgtgagcacgcgtgtccgagtctgcatgcggacgtgggctgtgagcacgcgtgtccgagtctgcatgcggacgtgggctgtgagcacgcgtgtctgagtctgcgtgcggacgtgggctgtgagcacgcgtgtccgagtctgcgtgcggacgtgggctgtgatgtctattgctgcacacctgggggtggaaccactgtgtcccgtggcgactgtgtgttgaacgtcggaggaaccgccagcctgttttccgtggcggctgtggccacttgacctttgcacaagttgtgtgtttggattcgcatctccacctccctacccttgttactgtctctttgatcacagccatcccggtgggtctgattttctttgtacaatgcgagccccccctcaatgaatttttgcttaaaaaaaagcaatttgttgtttttaattgaaatgaaaggaagcattctttcctatgcatgtgttttttttaaagcaaacaaaattaaaatcataagtaagtaaaaaaaaaacccacaggaaaattctaaaaacttgcacataaatggaattacgaatcaactcatcgtggaaaatcgtgtcttgctggatgtaggttatagatgtaaggttaggcacagtggaaagggagatggaacctgcagaccccagacgtggacatggtccaggacggcgccagtccgacccccgccttttctgcccaccgtgggatctggagccccctgcccaccatgtcccctgagctggcttgaccttgccgtcctccccgcccaacccctgcgccgtgtgctctgtgcagacacgtcccctgttgagtctgagatggagttaccaccgcaagcacaggtgacggctgaatcccactgccgcctccgtggatagggcaccagaaaccctctggagagaaggcagcctgccacgctttgtaatgagcagttcgcttaaggatcgtgttagactccgtggctagtatagatttcaaagctcgtatttctttctttctttttcttttttttttttttttgagacagagtcttgctttgtcgcccaggctggagtgcagtggtgcgatctcggttcactgcaacctccgcctcccaggttcaagtgattctcctgcctcagcctcctgagtagctgggattacaggcgcctgccgccatgcccagtaattttttttttttttgtatttttagtagagacggcgtttcaccatgttggccaggatgctctcaatctcttgacctcatgatccacccaccttggcctcccaaagggctcctgtttcataacccatcacccttaaagagccgttctctgaggtgggcctgggcgcctggggtttttagaaaccttttcaggcaaccgtagtttgcggttctaagaggaaaaacatcaagagacctgaagaacccaagccccacgcatcaaggcagcgtccccggccatggcggagggagccccgcgcatcgaggcagcgtccccggccgtggcgggggtggagaagggagaactgagttgggttttggtgtggctatttctgtggtattccctcgaaatatttgccactgaaaaaatgaaaaaactctaagtgcttttaagtgagtaatttctgtgcgaggtctcgggaagaagaaatgtctctgtgtgcagtgcccaggctccatctgccggctgtgggggctccgtctgccggctgtggggggctccgtctgccggctgtggggggctccatctgccggctgtggggggctccgtctgccggctgtgggggctccgtctgccggctttggaggccccgtctcccggctgtggaggtggcagagcctggctggggtcttcccgagggcccagcctcctgctcttcacagggagcctcagggaaggtgaggcctctgcctccctttcaagccactggacttgagctgaccactgataacactgcagctccaccgcgggcgagcgcagcgctgggggacagtcctggcctgagctccgggcgtgcgcggctccagctgcgtcctgcccgcctctcgcctcactggaagcagagcggaacggggcgtgtccggtcctggcccttcgcgtccccgcaggcccgtcacctcctgcaggagcccctctggcttcccggcagtcttggctctgccagaactgaattcctgtcgtccccatgaggacaaccaggatttgctcggcaccgtggcctctcgggctgaccgctgcaccttgcttgcagaaagccccacctgtggaggcttgggtgaccttcccttcctggtccactgtgccaggtctgggcagctcctggctgctgacctgagacaggtgattcctccctgcatgcccactgccccatccgtgcatccgtccatccagtgtcttgcacgggcctgcatattcccagctgctgtggtgaaatgtctgctctgcaccacgtgacctcggctgcaccctgacctctgacctcggctcccagcatgctccggtcctgccgtgccctgcccaggccacgtcagccttctccttgctcctacgtctttaccacacacaagccctgctgcctcgaggccttcgcacctggtgtccctctgcctagacccctcctgcgctctccgcgccgtccatggcctcattcatgcgttcccttgtcctcctgcgggtctcctcaccgtccacagcgctgttcaagcgctcactcgtccgtaagcctccctgtcccccgagcgaggccacagtgctgcccccgccagccttgcccgcgttggacattcgtggttctgtgtgctctttggctggctccatggggccaggactttgcttcattggctgctattcccacagtctagaacggggatgggcagctgaaacagtcatggagagagagagcgctgtggtttctgggtccagtgagccacgcctggcgggggccaaagacatcgaaagtgctccccgttgtttggtcctggtgtgtgggaggccctgccatgtgcttgtctcactgtgcagggcagaggaagaaacctccaagccaggcagtggtgtgtcctggggaggccgctttgggggcagagccactgcccttccccagccgagcgccctctgtgcccgcaggctgcactgtggagagggcggtgtcctgaggctgagagatgagggaactggcctctggcaaggcagcgttgaaacgtggacgtccccatcttcaaagtcgtgcttcccccggcaaggcccgtgtgggcacctgtgcctcctgggtacctgtgcctcctgggtacctgcgcctcctcgcattggcttcagcgacgtctgtcacagattcttacatttagacgtgccatatagtcttcctggtggagaccaacgtccccttggccttgtgaagcttaccagggcctgaattaggttggggggagcagctgcacctggggactgtgctgtgaagatgcaggagggcctgacggcggctcctccaggcgggactgtgctctgaagatgcaggagatgcaggtgtttggttttttgagacaggatctcgccctgtcactcaggcaggagtgcagtgctgtgatcacagctcactgcagcctggaaccccgggctcaagcaatcctccgcttcgctgcagacgtgcgccaccaaacccatctaatttttaaattttctgttgagttggggtcttgctatgttgcccaggttgatctctaactcctgggctcaagtggcgcttctggcatggcctcccaaagtgctgggattacaggcgtgagccactgcatctggcctggatgcaggtatttaaaagagcttagggaagttcttcgaaaaaggctctggccttcaactcccacttctactcctgattttggttctcattgggatataagtttcagagcactcctgggctcaggagaagagcagctcccctgcgaggggcagggtcacctgtgtccacagcagcaggacttggtccctggggactgcgggtcggcatagtccagggtgcccatgaccagtcctccgaggagcagggcctgggaagggcattgtcgggcaggcgaggacgggcatggttgctggtctgggcatcagtggcattgctctgagagggaaggagatgctgtcccagcaagggtggcctcaggtctggaccctcaagtggacaccgtgttttggctctaggactggcatggcccaacaggattttctgcaaaacaggaaatggtctctgtgttttccgtccggtctggtgaccacaagtcacgggctggtgagcacccgaggagctgaattctgtggtgggaatccaggttcgggagaggtcgtcaggcaggtgtgcagacaacgtgagtggtgagcctcacgcccgaggaatccgctcttcctgctggacgcgtggatggtggtgacggcctcgccgcagcagcagcacctggagctggcccctgccgggtgggtggtctccatggggctcatggcatctcgggggtcttggggggatgtcactctggtgctccgtttgcaggtacaaacctgccattctaggagctgactgatgatcccggtcctcgcccctgtcctcacacccctgagtggtcaggcaggggcttcactcggctggttctggcctccgtgctaaaatgaatgaataggacaggacagtgaggaaaacgcacacctggggaagtgacctgggaactcaccacccccacccacctccgggactccgacctcccagggcctcagccaggccctgccctcttcagcacattggaaacacctgcatctacccagtgtgcgctaggatggcagctctccagcctccatcctgcaggccgagcccgcaccccagggaagccattgttctgggtcccctcgtgctgagcgccctggccagaggtgccccttccaggtctgggtgtggttggcggaggttttatgggttttagctgtgggttcattctcagaggttaactgcccccagaaggtggggaaccgcctccactctcctccttgagctgggggttttacattcttccaggagtttcttcagggctccctggctatggcatcgtggccttgggtgtcaggctggctctgtgcacagtcattgtggggagaggtttccttcctgtgggggcctccactgtccctggaatcgcccttcttattccctaaataaatcatcggtctaagaagctgaacgaaccctctattctggcacagagactggctccagctttccttgaaatcctgcagagccttcattaaaatgagtgcaaggcctgtagcacggccgcctctccggaccccactgccctgcaatgccttctgctcgtccagctcgtgggaatgaagcttggtcacagtggttggtggctcagagctccgttgataaggctggccggccgcctgcagatgtcctgcctggtttcctgaaagacttgaggtgacccgcaggaaacaaagttagtaataactttattactttaagtttaaaaagttatatgaaataagaagaaaaacattaaaataggcaattggaaccactagaataaacgacatcagacatgcaaaacactcacccatcgcctgtgctggagcctgttctggctccagggttctcagctgcaaatgtgtaaaatggaactgtgagtgtgacgttccccttcttcaggaggggggacccgtggttcccaaggacaacagctcctcttagcagggggggcagcctgacagagggccccaaagcgctgcctcccctgctgcgattcaggagcaaggttctaaagccattgctggagaaattcctgggtggaggctggaggaggtcttgctccccaggggtagtgcagcagggccatgctgtgttgctataaaccgcttttacatttagaaaggggcacgtccagtctgtggtgataattttatggagttcgtatgttttcttgtagcttcctctttctgctatttttatctctttttattgaatggatttctggtttatttatgaattttaagcacctcaatttccacggacagctgtcagcaccaccagaagcctcacgggaccctcccaggtgcccagccagcacgggcctccccccaccgagccccccactgccaagcagagttacagagagaggagccacttgtgcagagcctttggcagagcaactgaacaccccgctaccgggcagcgcccagggacgccgcactctcagccctgctgcccaagccctggggttagtttcgtttcatcagatgttggagtgcctcggtttcccaccctgtgcatcagggtggtgaggaagtgtgcagggttaaatgccaggtgcgcggcgcccgtttgtggggtgtgcttagcgctggcatcctcatctcaccgcccctcaccacgcaccggacacgcaccaaatatgcatcagacacacatcagacacacaccagacactcaccactcaccagacacgcattggacacgcactggacattcatcggacacacatcagacatgcaatccagcccgacccacttcctcctccctgccttcctgccaggcaggcacaggcccatgtggtggggtcctcagtgcctgtgcgggggcggggggctctcgggaaacggtgacgcgccaggtgaaccccgaggcctgggttgctctgaagctgctgcagcttcctgacaagccggctgctggagtttgtgccaatggagggcgtccgttccattctctggcagcttggctatcggtgccggtggttctgaggttcctccatggtgaacgaagcttgatttacgccttttggttacgcatttgccgcaaggcccagagctgtgcgtgctcccgctgggcttcttgtgtgagatgcaccgcagccaggacagcctgggcacctgccactctggagcaggaagtgaagcctccagcccttggttcttggggctctgccgggagcgaacggggctggaaacgccaagtccaggctgctttcacacgttcaaacaccacggcttcctgccatcacttaggcctcagtggccctgaaagttgctctaggacgtacagaagaggccgttttgtcgttgtaaaaatcccaaatgttttgtggattactattaattgttaacgcttgtcctgtgagtagctcgtcacctgaggccttgtcgtgaatattaaaatgcacgtctggtgtcccttttggcttcgaggttgatagtggtttttcctgccagtggggacgctgtccgcagagcaccaagcttctccagggaggccacagggcgctgcctggggagtgtgcgtcctgccccgagatcctgcagctgtgactttacacagggtggaggcagggtcacgacccctgcgccttgttatgaaagcagcgcattgtgtggggcgcatctgtggtgcctttgtgtacatgtgcacccaagtgctccagggcacatgcatgcacacatgaacatgcacacatgcctgtgagcacacatgtatgggcacatgcatggcacatgcatgcacacacccatgcacacgtgcctgtgggcacacacatgcacatgaacatgcacacctgcctgtggggacacacatacgggcacacacatgcacacacaaacacgtgcctgtgggcacacacgtacaggcacatgcatgcacacacccacacacatgcctgtgggcacacgcacccatgggcacacacgtgcacacacccatgggcacacacgtgcacacacccacacacacatgcctgtgggcacacacacccctgggggtccctgacatcagatctcggcggtgcccacgcagacgcaggagatcagaggatggctcgctgcgtcaacgaccaacgcgagaatgtgtttaaaggaaacgtgactttctaatgggccttcattaaccaggatgctgctacaatggagtcggtggaagtccctgagcattctgccttcattgaaagataaagtgatgtttcttttgtgtgtaaatggatactgctgtgtttccaaaatgcttaaaacaacctaggcattttaggcttcccttggaagattgttttatgacaaaaaatggttttctgagtaaatgttacccagtctctgacccagttataaaaatactgaaatcagtgaaatccaaatgaaatgcctgtcattaaggccgctgcagggagaaggggtggggcctggactctggacccctcccacctggactctgggcccctcccacctggactctgggcccctcccacctgggctccgggcagcaacagtcgcccgccccaggtttgggcttatgcctgtgccgtatctcctggtttaatttgcattttctcaagggctaatgacatggagcatttttaatacattgttggccatttgtctttggtgatatgtgtgttcaaatcttttgcccctttttaaactgaattatttgtcatcatttattgagtcataagagttctttatatattctgtatataagtcttttatcagataactgacttactaatattttttctagtctgtcttttcactttttatttttttaatttttattatttttttgagactgagttttgctcttgtcacccaggctggagtgcagtggtgcaatcttggctcactgcaacctctgcctcccaggttcaagcgattctcctgcctcagcctcccgagtagctgggactacaggcgcccaccaccatgccctgctaatttttgtatttttagtagagatggggatttgccatgttggccaggctggtctcgaactcctgatcttaggtgattcgttagtctcagcctcccaaagtgttgggattacaggcgtgagccacagcactggcccttttcactttttaaataatgcttttaatgcaaaaaagtttttaatgtttttaattttgatgaagtttgattttccatttatttttcttttggcacttgtgcttttggtgacagatctaagacatctttacctgactttagggtgcaggttcattctcattttcttctgagaggctagtagctccaacccttacacccttacagatgggtgcggggtctgagctcatttctgtgtgtggctggggtggggcctgtgccgttggtgactgtgtggacgccccctggcccagcacgttgaccttcctttgctttctatcagaatggttcctccttgaataacttacatctttcctattttggaccttagcatcaatgtgcatgaaagtgggcttgttttaagttctgagttggtggtagctgtgcgtgcaccgcagtaatcgccaacaggtccggcgtggggaggaaactaaccccacctgtgccagcccaggacaacaggaaggtttgctgaatggcaaagcccactggcttctgcttctttattggggttgtggttatttcaagtctcctctgtggggcggctgcatctcctggtgactcacgcatgggcggcctgagccatgcactctgtaagcacagtcagcagcggggtcctctcccccaggagctagggcggctgggcagtcagcagcaggggcctctcctccgggagcaaggactttaagtacagtcagcggcgggggcctctcccccaggagcgaggactctaagcacagtcagcagtgggggtctcttccccaggagccaggactctaagcacagtcagcagcgggggtctctcccccaggagcgaggactctacgcacagtcaacagtggcgatttctcccccaggagcgaggactctaagtacagtcagcagcgggggtctctcccccaggagccaggactctaagcacagtcagcagcgggggtctctcccccaggagcgaggactctacgcacagtcagcagtggggatttctcccccaggagcgaggactctaagtacagtcagcagcgggggtctctcccccaggagccaggactctaagcacagtcagcagcggggatctctcccccaggagcgaggactctaagcacagtcagcagcgggggcctctcccccaggagcgaggactctaagtacagtcagcagcgggggtctctccccgaggagtgagggcggctgggcagtcaggactttgtactggatctctggataaaaggagcggtccaaggcactggagtgctgtgttttatgtttaatgcataaagggagccactgcctgccccaaaccaggtaccttcgaaacatcacgatggccctgaggctgcacctagacctgagcacgtagcatggaagtcattctggcagtggccgtggtctctgtggaggtctcagcttccgggccgccaggcagcccagtacagaagttcatctgtgcagtgcaaaggctcgaggtggaggccggggagcagctacgaggcccttcaccccacagggagctgcaggttcatgtctcatgcgtgccacacagtgcagggcattcttatggcatgtttaaaactaagaccacacgtgtgtgccccgggggtgaggcgcaagcgtggcctgtgttctaactggcgcttttctttgtctcactagcccgttttacggagaagacttttactgtgaaattcctcggagctttcgtcacctgtccttctacattttcgatagagacgttttccggagggattccatcataggtaggtgatgaatgagcatttacttccccttttctgcctgttctgtaccaggcgagtattagcatttcagtccagagcctggctggatggtgctgaggggtcgctgcagggcttgaggtcacagcagccctgggtgttcctcctgatctgctcttgggatctggcctggcatctgtggtccctgctagagcatcacaccaggctcaggtcagtgagcactgccagtcgaggcttccatggcccctcaaggcaagagcacagcatctctggccctcttcagacaacttcccagggctgttccccggggcatctgtggggggacctttgcatggatgtggggcctccctcctcaccacgtcttggctgtccctgtcccaactttagtccccacagtgtgggcacaggaagggcgggtgggggtgggggcatgttgcctcagtttccccctggtttttggggcaatactgttacttccaggagatggtgtgtttggagcaggggtggggctgctcttggagaaagctcatgggcagccctgcctggtatcacaggaaggcggcatcctgtaagttgtggggcctctgggcagagtggacttcaggttactcggggagctccttgttcctaaatgcagccagaggaccccgtcaggagcagacctcacgcagcaggcgtgggaggctgagggatcaggctaattcccgccgtgacgctgggagagccaggaagggaggaggggtcctgtggcgcctgagctcacgcccaggacgggcggccggggagccagtgtgtactggctgccacagcctgaacccagaccccaggtggtgcaggctcctcgtcttcatggctgccgggatgctgagtgggacagggcgagaggaggagtcccccagggggacccccagcttggccccaggcagcctgagggcccgggggtgcaggaggccagcgaggccacgagggtgctgtgcgtgggcggggtccgcgtccatctgacgctcgctgctcacactggctcctcacaccgtgtcacggccgctccaccccacgccggctgccccctttccccagcgctcacctgtgtccctcagctgtgggctttcttcatcgtccctgttcctctgtttgtgagccatggaccaggatctgtgatctgatccattcccagtgcttggcacacagaagtgagaggcacggccaaaggtccacctcagagcttgagtgtcctaaaacccagcctgtccccactgggcggccggcagctagtgtgtgtcagcacgacgttgagagagagagggggcatgagagaaacgggctagtaggtaacgcgtaggctgtctgcactctgccatgtcccgggcctccacagcaagtcccctgacagagatgagatgcctatcctgaccagtcttgctctctgcctggcattgagaggggcttggctgggtgagaggccctcggggccgggcagggcctcacctggcattgataaggccagtgccccctcaccattgcaggggtcgggacccggacatttttgggactgttgttcactgtacccaagtgattattcttagaaactgctgtgcttttcatagaagtctccagagtttgtttagaaaatacatggaatgggtcacatggatctcagataattgacatttgacttcattttgagcgggaacactgtgctgggtgcttccgcagcggacaccctggccctgaaatgcggctgcagaaggtgtctgagtgcagcgggcacctgaccccccttcagggtcttgctgtgctgggcttcatggagccttgtcggtgagatggtcttgagggtccagcgtgacccctgcacccccttgctcagtgtctgcctgggaggccctcaggttcaggcccatagctttatgtcgcgttcaagctgggtgctgcggaagggttccctcttcctctctccctctgaccagggcatcggctccagggctagtggctggcagttctccctcctgcctccgggctcagccgctgtgcaccccactcctgaggcacctccttctccatccccatgtcctgccatgcccacctctgggactggggcctgctgcaggagatggcctccgaccccgcggcatgggtgggctgccctccgtgacctgcctcccctgccccactcgttggttgtggttctcttgcctgttgtgctgtgtccactggacagagcttcctggagcccatggtcctgcagggcaggcctgtgtctcgctcctgtgttctcagcccctgccaggggcctccaagggtgttctcagaagaaagggaggcatggaatccagattattcagcggaggctaatggtgtatctggcggggctcagcctgtgccgggcgccacgcgcgaattgaggtgtgaccgtgtgtcaggcctcgtcaccagctccgtttatactcgagaatccacagggacttgattcgttctcgaaggtgtatgagacattttttgagcgacaaccctaaggaaaaagaaatttaaaaaatttttgcacattttagtaagagaagctgatcaagttagttctggagttatatgctctgaaaataaccaaataagatgtttattaatcattctgttgacgtcgtctgctagtagttcttggtggctttacgattatggtgactggacttagatgtttcactgtggctttcgcagctatgaaaatgggtggctgtctggatctccggtaacgatttatctttatgatggtaattatgttgttaccgggcatgaaacaccaggttctggggaatgcgtttctgggtggaagtgcgcggtggccactggcttcctggctgcgtggttctcctggttctcgtttctagcagccgcccacgccctgaggaaaccccacctgccagcaagtttcccttggggcagccacagctgtgctcagttgcaagttcaggtccaggagtgagaggtgcactggcaggtgccagaaggaagtgggggtgcattcctatggggtcgggggtgtgggttggggacgggagggcatcttcagcctggagggggagggcggtggcgacagaaaccgagaaaggcagctgaagccgtgccgggatacggcgccccggcaagtgagacttggggaaataaaggcctgccctcagccctccccagcccaccccggcacctccaccggctgcagtcagctcccgccacagcaggagcaggagaagtgtccagtgtcggcgggtcccgggcggcgtgaccgtagcctcctctgtccctgggtccatggcccacagagcgctgctgccggcgggaactgtcagtcaagccgggctcccagctgcagggccgtgacctgcgggacacacggggcgcaggctccttcgggattccaggcgcagggaggcggcctctgcctggactcggctgccgggcgctgccctcacagagcacagaccggaaactatggctccccgcagctgggatgcgggaaccacggaaatgcgcgaggcccggctcggtgctgtcaggagcattggggtctccgcccccgatcctggcgcctccctccttttcccgctaggcctccaccttcctctgggccccggctctggtagcaccatgtccccctccatttgcccctccagcccctagagactctctgaggcttcccaatggggtgggggtgcagtgagacctccattcttttcttcttctttttttttttttttgagacggagtctctttctgtcgcccaggctggagggcagtggcgcgatctcggctcactgcaacctccacctcccgggttcacgccattctcctgcctcagcttcccgagtagctgggactacaggcgcccgccaccacgcccggctaattttttgtattttcagtagagacggggtttcaccgtgttagccaaggtggtctctatctcctgacctcgtgatccgcccacctcggcctcccaaagtgctgggattacaggcgtgagccaccgcgcccggccgagacctccgttctttgtgtataaatcaggtggtctgcaactgacatatggtaaagttcactgttaggtgtagccttcaccagtgtatgcagttgtgtagacagcagcacagctaagatatgttcccacagcccggaacactcctttgggcccctttggggtggatttcctaccctggcccacagccccgggcagccactgctctgaggcctgttcccacagttgccttttccaggaggccacgtgactcaaaccctggaggggccgtgccctctgccactgcgctggtcccgcgctgtgcggctgtgagccaggccgcccccttccactgcccgtgggtttccatcatacagacacagctcagccgcctcatccaccctctggattgtgtctaatcctcaggaattatgaataaagtcaccgtaaacattctcggataggtctttgtgtggacaatgtttctgtttcttactctgagataaatgcgtgggagcgaggttgctgggtcactgtagggtgtgtgtttactttcattaaaactacccaaccgtgtctccaagtggtcacccagtctgccttctctccagcagcgggtgagagcagcaggtatttcgcatcctgcccggcccttaggactgtgagtttttattctctagttaccgtttgcactcccataggtgtgtactgtctcactgtggcttttattgcgtgtccgtgaagagtggcgtcgaggaccttttcttgggcttagtgacagctccattccttctttagtacattgttcaaatcttttgcccttttaattgggttgttttcttgttactttttaaagttccctgtatattctggatacgagtctatcacaagtgtgctttgcaaatattttcttccagtttgtggcttgtatttcattttcttaccattggctttgaagaacagaagtttttaatttcgatggtccagtttatcacatttttttcttgtatgatttgtacctgtggtgtcatgtctaagaaagtcttgcctattccacggttgtggcggttttctcctggaaagcatgtgctttcagcgttcacatttagttccatgatctgtttcaagctaattttcacttatagcacaaagaaaagggtcgggattctgttttttccatgtagacatccctttgttccggcacccttggctgaaagacgacccttcctccgttgatgactttggcacatttacagcttagttggctgcattgtgtgggtctgtttgtggcctctgtattctcttccatctgaggtaggaggcgggactggactctgaaggcagggctcggacaccgaaccaaattgaggactagctgagacagggatgggtggaagcagctttccatcggacacgcctgccagtgtaccatgtcaccttaccattgccatggcaacgcctggaggttaccacccctttccataggaacaaccccgtgactcggaaattaccaccctttttctagaaatgtctgcataatcttttaattgacatatagttaaaagtgaggataaataagactgcagcagtgcccggaggtgccactctcaacaccctgcctatggggaacccttctctgcaggaacggctgagactgtcaacaccccgcccgtggggagtcctgctgtgcaggagcagtttcagagctgccactgccgcctccataaaactgttttcttccaccaccacctcattctcgaattctttcctgagtgaagctacagaccctctgaggctaagccccaatttggggctcgcctgctgtgtgtcatattgatccacctgtcctcatgccaataccacgcagtcttgatcactatagcttcatagcaggtcttacattgtagtgtaagatcatcaaatttgttcttaaacttgtttttctattctagatgctttgaattgccatatatacttttgaatgagcttctcaatttccaaaatagtcccacaggaattttgactgggattacattgatctatagattaatttggggagaattaatatcttaacaaaactgagtcttcaaatccatggacatggtatatctttacacgcttgggtctttccaatttctctcatcagtgttttgtgatgtgttttcagcctacacattttgcacatttaaaaacatttatttccctgtgttttatgtgtttagtggagtggttaaagatttctgaggtagtccaccaaaagcacaaacctaaaagcataattttgtgaaaggtgctgtttttgtgtaattttcatggtcattgcttgtatgtacaaacgcagtcgacgtctccacactgactttgtgttctctgttcttgctgaacacaccaattagttctattagctttgcctgtagatttttttttgtacattctatgaataaaggcttttatttcttcctttgggatctgtatggcctttgttttttcctcgtggccctggctgggacacaggtggggtcagagggaggcgcgcgcatttcagccgcattccctgtctcgggcagctcttgctcagttgtgtcctgtggctgtttcccctttttctggtccctctgcagctggtcccccgtctgatgccctccagacccctggctcctcctttctgaacgggcctggccagcacagatgcagcagaagaaagtgacccttccggcctctcgtggtgagaaggcagccgcctttgcccaagtgagaaagggaggcccagagtgttcggtaaacttttcggtgtgactcaaatagatggggacaaccctgtggattaggcacatcagagaaatttaagtagacgccgtggcttttagatcaggcattctctcaggtcagcatctggagatacgaacacgcatgcttcaaatgtccacggtccccattgttgaatgtggctggcttctagaaggaaaggttgggggctggtgacagaagtgaccccacgtcgggaatgaggtggcaggggcagggatcccttctcgaagggattttaaatccttttgaatgttgtggattttgttctgtttctgtgttacctattaaaaaattaagtgaagtacttctaaaattaaagacttgtaatcatgtgccagttacaagattcttatccacgtaaatatgtgacttctcccgtcccagtttcagctcataaaaatgtgaagacacagtgacattgcaagtatttaaaacttcagacttcaaaactgaccctcctgtccagctgaaggcgtcttggagtctgaagatttatcccttttcactgaaatatattgcccaactcagttttaagaagtttttgctttcatgtggctttattcctgtgagactcaaaactgaggttcgtgttgtgggggaaaggggaggttatgcaagagccacgcagcggtcgtcagaggagaggacagagcccccactccggacccttgaagtcaaaggcgcccgcccagggctgccggtgggagggcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcctggtggcccaggcccacgggctctgagattagtcacggaatggaccagtcaggctgagaggtctcgctcgcatgagcccgcgaggcagaggagctcctgagggaagatgcgtcctgggacctcgcagggtggggacgccaacataggaaggaacgctggcaggaaggcagggacggaagctccctctccctgcagccccggcctgctcgtctgtggggtgtgcagagtggtacctgctcctccagggtcaccgcaggaccgactgagatggcacctgtgagaggctggcagtggagtgttcccgaatttactgaggctggacagagaatcaggcccaagcatgtggctgctggatgccaggccagggttgttccgatgggagcctgcggaagttttttgagacacggaaatataaaaggatcttccttggaagagagaaccggggctgggctgcgctgtcctggcgtgaggcagggtggccgggtaggaggcccaggccgctcccgggagcccaggtcatgcacaatgtgctcagaccctgtggctgcggacgctgcggtgaaccgggtctgcggggacccagagtttctcgcttcagtgactggaccaagatccttaaggagggcgtgtgtgtctctgggtgcagaacgaagacgtgaggagtctgccaacatttccttcctcactcctgctctcgtgtgtgctctgtgatgggctcagacttcacatgtgtgtgcgactccctaggagttcacgtgcatctgtcaacagaggtgcatgtgctgccgtgggtgctcaccgtggtgggtggcgtggtccgcagtgtgcggaggccactggcagggttgacatggtggtgccatgaagggacgcaggatgggagatggctcggtgcccagcgcctgacaagccctgtcctgccggggatgggatgggcacacgtttgccgcgcctcgggaatgtttctggaatgaggtgaacgtataagcagataataatggttgcagatgcgaatttacacacataaatccatactaggtaaacgtatattgtacaaatatattctgatacgtattttcactggaagcgtagccccaaagtactaagcctgtttaaggcacgggaaactgtttagagtggacgttcccagactttggggcccacacaagtgcccagggacctgtggtggtgcagattccagcccacaccagagcctctgttctcctccgtctggagaaggccaggaatctacactttcaggctctccaggggtcccagaaggcggctcattcattacactttagaggcacagattcagaccaacccacgtcgcgtgggaaggtggcagctcattctggctctcagtcctgcctgtgaataacctgagcacccacatgcatgcacacacgtgcgtgtccacacacacggaaagcaccctaggcacacgtgtgtttcaggctgtcgctcgcacgggtgcacacgtgtctcttgtggcgtgatgctgctgccttggtggtgtgtgaggcacggggtgttcatttgtgagatcagagctctggtgcagccagctccgaggcacctcctgctgtgagaactggccacggaccacagtgaaagtgaggcgcacattgccgatggagcggacgttcgcgccttcacagcgaagcctctggaacgccttactggaagggacacagtggagacttaccgctgcacctgattattttgactttttaatatcaatttttagagatacagtgccaccatgcccggctcattcctttattttttgtagagacaagttttcaccatatcgctcaggctggtctcaagcgaccctcccccctgggcctcccaagcgtgggggttccaggcatgagccccgcacccggccggtgccccattctgaattaaactgttggaaataagctgcggtgatgatgggctggcttctgctcacaggcgtcctggctctggggcctgtgcccgtggtgaagtcttctctgcttgtgttgcagggaaggtggccatccagaaggaggacttgcagaagtaccacaacagggacacctggttccagctgcagcacgtggacgctgactcggaagtgcaggtgagactctcggcgcagccccggaaaccagagccctgggacaccatggggcttcgagacgggcccggctccgactgtggctaaagacgtagatcgggcttcggccttgactgggaataacgatgagcagattgcgtgttcgcccacttgtgctcggagtgagcgcgggctccgccatggattttgggttgtgcgtgttcgcctgcttgtgctcggagtgagcgcaggctctgccatggattttgggttgtgcatgttcgcccgcttgtgctcggagtgagcgcgggctccgcgtgtggattttgggttgtgcgtgtttgcctgcttgtgctcggagtgagcgcaggctctgccatggattttgggttgtgcgtgttcgcccgcttgtgctcggagtgagcgcgggctccgccatggattttgggttgtgcgtgttcgcccgcttgtgctcggagtgagcgcgggctccgccatggattttgggttgtgcgtgttcgcccgcttgtgctcggagtgagcgcggtctctgccatggattttgggttgtgcgtgttcgcccgcttgtgctcggagtgagcgcggtctctgccatggattttgggttgtgcgtgttcgcccgcttgtgctcggagtgagcgcggtctctgccatggattttgggttgtgcgtgttcgcccgcttgtgctcggagtgagcgcggtctctgccatggattttgggttgggcgtgttcacccgcttgtggtcggagtgagcgcaggctctgtcatggattttgcattgtgtctgttcgcccacttgtgctcggagtgagcctgggctccgtgcatggattttgggttttccctttgcctactgccgccctttgtcatgcacaactgaggaagctgtgaaaacaaacacggtgggaaaggacaggcacgcgtcattgaggcccaagagaaaacatgggtggggaagggccgagccagggtcagccctcagggaccctcacttccccacggttggctgggcgggctgttgcctggcacgcggcaccaagaagggtctgagctgaaagagcgttctggtctcccgtgtccattgtcgaaagtggccaggggctcaccctggcttgccgggactgtgtgctgactggggctcaccccggtcctgtccagtggggggagcttgtcccacctccccacgcaagaccgggggctccagtgctggggcccatgtcccagacccttgtgttcacagctgctcacggacgcacggtgcccagctgcccggcaacagctgctccaggcttgcctgtaacagagggagcagtgggggtcagtccaccggagcccaagcctgcaccagctcctgtggggtcaccctgagccctggtctgtgacacagagcagctgcaaaggccacaagcaagaggcaccgtggcccaaccctgggacgtgggagggtttcccaagtgggtcctcagctgggaccacagtaagtgtctgagtgtagggttgcggcacagggtccctgggacaccggacggcttcctgggtcctcagctgggaccgcagtgagcgtctgagtgtagggttgtggcacagcgcccttgggacgcgggagggcttcctgggtcctcagttgggaccgcagtgagtgtctgagtgtagggttgctgcacagcgtccctgggacacaggagggcttcctgggtcctcagctgggaccgcagtgagtgtctgagtgtagtgttgctgcacagcggccctgggacgtaggagggtgagtgtctgagtatggggttgcagcacagcggccctgggatgtgggagggcttcctgggtcctcagctggtaccacagtgtgtgtctgagtgcagagtcccagcacaggccgccaggctcggagccagctccctcatcggattgttgccaacgtcctttgcaggcctcagttttcccatctgggtgggtttgtgaagcgtgctggtatggcgtgtgtgccactcgaaggcacctggcgcatcgtaaattggtggctgtgatggttatttttacacctggaggctggcatcctggacaaatccccaaaataggttccttgtgaggacttcgcctgagacttcagcagaggcaactgggtgggtcggatggaggctctgtgcccgcaagttcagggcaaatttgggctgggggactggatggcctggtgtcctctgggaacccttgtcccccggcaaccctcatcctcctggaaccctcatccctcgggaaccctcgtcctctgggaaccctcgtcctctgggaaccgtcttgccctggcaaccctcatcctctgcgcttcactgggtcaaggttgccatttgccaaggtcatgagctgtgcacacgcccatggccagcaaagggttcattcatgaagttgaccatgagcccagctgtgggggtggggtgaggcccttgacggaaattaaggagtggagccaagaagccctggggatggccctgccccaagggacctgtgctaattgtgcgtcacacttaattaactctgcttcctgggaaagcactggctggggaacccacacgtgctgtggaaagtgaaggacgctgtgattactgcagaactaatgactgtcctcgcatccccggagcacaagggccccagcgtgctgctcccacggaccttggcgtcccggcagaaaggcggggtttcccacgtgctgcccgggagacggggcttggtgactgggccgctcccgcctgcgtgtcggcgagttccccagctcttctattctgggatacccgccgtcgctggggtctccgtcacaacggcctctgagcagctggcagagtgcggcctcgtcgtttgcctcggattcaagtttggttttattggcaggtgtagcttttcctctttcttgccttttttttttttttactgatttaattttgaaatggttatagatctataggaaggcatcaaaacagtacacaggagtggcgaggggcgaattcccacctttccctgaaaacggaaggccgtgctcccttctcccggctcccccgaacggaaggccgtgctcccttctcccggctcccccgaacggacggccgtgctcccttctcctggcttccccaaacagaaggctgtgctcccttctcccggcttccccaggcactgccatgcgcagctggtgcaacgtcaaccaggacgccgacgtttgtgcagtccacggatgttatccagatttcaccagttcacaggcacgtgtttctgtgtgtgtctctctgtgtattctatgctattttttccagttttttatgtggtaaaacagagacatgaaatttaccattttaaccatttaaaatgtccaattcagtggtatagcattgaatatattcataatattgtataaccgtcaccaccacccatctctagagctcctttcatcttgcaaaacggaacctccgtcccctctgtcccctggctagagttttattcacacgctcccgtccgccccttccccaccggcagccccatggcactctgtctctgacgcaggccactccccgtggctcatgggagtgagctctaccctgctggtctttctgaggctaatgtcgctctgcgtgacatcctccgggtcgcttgtggtatcagaacctccttccttccaaggctgaggaatggtccgaggtgcgaagcgtgtgctgttgctccagtcacctgccgatgggctgttgtgacagtcggtgcaacttcatcacagggtagatagtgtaaccaccatgacgatcaggactcagacgttgcatctccacaaagctgtaaataagaatgccgcaggttgatctcacagctggtggaatctcataattaacgcccgaggctgcgtacccgtggccaagcccagcgtcctccaagcctgactctcactgtccggaacatgaggatcctgaaccgagtggtgtcagtctcccgggaatttgcactttatggaaggcaaatgcgagctgttgtctaaaagggaggaggcaaggtcattgctctccaatgcccgctgctctccaatgcgttgcttcactgatgcagtcagccccaacgccgcccaaaacgtagcgtgacagggagcagtggccctgctggactccagccaacctttaaaacctcaactccaggctgggcgcggtggctcatgcttgtaattccagcactttgggaggccgaggcgggtggatcacctgaggtcaggtgtttgagaccagcctgaccaacatggtgaaaccccgtctctactgaaaatacaaaattagccgggcgtggtggcgcatgcctgtaatcccagctactccggaggttgaggcaggagaatcgcttgaacccgggaggcggaggttgctgtgagctgagatcgcgccattgcactccagcctgggcaacaagagtgaaactccatctcaaaaaaagaagaagaagaagaaaaaaaaccccacaactccagtctcaggagccgccgtttcatcataagatgtcacagtgaccattttcaggaaggcagggggtagccatgtggctccatgagtccctccgctctgtgattcccaggaacagtcctgtgtccggacagcgagtgtcacagaagcagcccatgggggaggccagcaagtgagtcacagaaatgggggaaacacaattaaacctttcttgcttccttctggaacggccactgttggaaagtctttgttaaatcactttattatgcagagttgtgctctctgaccctcccctgatgcagggccagcgggggagacgccagcgtcagatgccagtgggggagatgccagcgtcagatgccagcgagggcaccgcctgtgacagcgaggcatccgcggtgatctgggcgcctgggggtcactgagctccgtttataaaccaggctttcaagtgcatctgtgacgtattcagaaaatagcacagccctgcaggggatcacagcaaacccctgggtctgccatccgcccaagagacacctacgtgtttcccccttggagccttccagttgcaccgtgaaatctcactgggctggaaattccagcctcctgctacagcctctgggaattttgtgtttgtgcagcagacagtcctcttggaaggattttcggagcaaacaaagtcaccgtccgtcgtcaagctttcacatctctccagggttgtaagaggagacggccgaggctgggcttccttcctcatggcctctgcatcctgtctcatctgcccgcggacttcgtctcctctctgcggccggcgtggaacagtcctgcatccaaggcacctctgtcctggctgctctctgggccgctgcccgctcagtgggggacacggcaaccggtgggtggggccaggaccctgacccggctctgcgcgctgctctctccctggggaaggccttcctgagaaagatggatagggaccattggctgctttttaaaaattaattaactctgttttgggggcagttctgtgttcacagggaaattgagcagagtacagagtttccatacacccctcagcagcccccgcccagggccccatgggtgacactgcagccacacgttgtcaggagctggacgctggggcccctttgctgcgtctgtgagttcgcaggagtgcagcgccagggacctcagtgcagcgtccaggcaggtgccagggtcggcagccaggtcctctcgttcctttcctgtgggaatttgtgccttttcccttttgctcttagtagcctggtttgaggtttattaattttattgatctctcaaggaatttgccgttggctttgatttttacctattggtttccgatctgacttctgttttctgttcttgggctctgggtttagtttactcatttttctcagtctcccagctctaagctcaggtcagcgttcagatctcccttctgctctaagctcaggtcagcgttcagatctcccttctgctctaagctcaggtcagcgttcagctctcccttctgctctaagctcaggtcagcgttcagatctcccttctgctctaagctcaggtcagcgttcagatctcccttctgctctaagctcaggtcagcgttcagatctcccttctgctctagtctgtgtggccggcactccagattcccctccaccccgagcacggctcccgcttcatcccactgattttgatgagtaacactttcatttctgtttattccggaacattttaaaatttgtcttgcgttctctgatctgtgtgttatttagaactgtgttgtttaacctctaaatgtctgggattctccagcctgcgccagcacctgcagatttactcattggcttttctggcaggagaaagggccttccaggggtgggttttgtttgttcccactcctgaatcagcagaagacgaaagcacacaagtcagctggtcgggagggattcatgctgcaggaacaggagcagcctcaggacctgatggtgaccagccaggtgcccctggacccggccaggagccgggagagcacacgggggccgcacagcctgctgccaggggccgggagagcacacgggggccacacagcctgctgctggggaccaggaccccccacatgcagtcgtgactcttcctgaagctcccgaatgtgaatagagctacctccgtctgcacagccttgcaaatctgaacgcttctgtcctgagagagtttgcgcccggcatttgagaacggggatgaagcagtggggattcttggttattcttgggtcaggcactttctcctgtctttggtggtcaggccactcctttagcccgtggatagccacggatagcaggcccagtgcccggctggtgttcagggcactcctttagcccgtggatagccacggatagcaggcccactgcccggctggtgttcagggcactcctttagcccatggatagccacggatagcaggcccgctgccaggcggtgaggaccacaggcgatactccgctcagccctgagctctgatgggtgtgggaagaggagctgtggtcttggtggggtctttgttgtcattttaggcacctgttttccccgcccacagtgctggcgtggggttcatgcccaccttcccggcccaacatccttgtggcccctcaggacctgctctggggctgcagccacagggcgggaaggccacacccaacctccagaccccagagtctcaggacagcagcggaggccccacctcccacacctgcctgggcagcacagacccagttccattccccctgtgagcgctgggtcaagtgtgggggtgccgtggggcgtggtgtcagtgtgggggtgccgtggaacgtggtgtcaagtgtgggggttccgtggggcgtggtgtcaagtgtgggggtgccgtggaacgtggtatgaagtgtggggtgccgtggaacgtggtgtcagtgcgggggtgccgtggggcgtggtgtcagtgtgggggtgccgtggggcgtggtgtcagtgtgggggtgccgtggggcgtggtgtcagtgtgggggtgccgtggggcgtggtgtcagtgtgggggtgccgtggaacatggtatgaagtgtgggggtgccatggaacgtggtgtcaagtgtaggggtgctgtggggtgtggtgtcagtgtgggggtgccgtggaacgtggtatcaagtgtgggggtgccgtggggcgtgttgtcagtgtgggggtgccatggaacgtggtgtcaagtgtgggggtgccgtggaacgtggtgtcaagtgtgggggtgctgtggggcgtggtgtcagtgtgggggtgccgtggggcgtggtgtcagtgtgggggtgccgtggggtgtggtgtcagtgcgggggttccgtggaacgtggtgtcaagtgtgggggtgctgtggggcatggtatcaagtgtgggggtgctgtggggtgtggtgtcagtgtgggggtgccgtggaacgtggtatcaagtgtgggggtgccgtggaacatggtatcaagtgtgggggtgctttggggtgtggtgtcagtgtgggggtgccgtggaacgtggtgtcaagtgtggggatgctgtggggcatggtatcaagtgtgggggtgctgtggggtgtggtgtcagtgtgggggtgccgtggaacgtggtatcaagtgtgggggtgccgtggggcgtggtgtcagtgtgggggtgccgtggggcatggtgtcagtgtgggggtgccatggaacgtggtgtcaagtgtaggggtgccgtgggacgtgttgtcagtgtgggggtgccgtggaacgtggtgccaagtgtgggggtgccgtggggcatagtatcaagtgtgggggtgccgtggggctgcaccgacgcggtgtcaagtgagggctgaagggctttatgttccactccctgaccaggggcttcggggtgtgcaccctggcagggcaggctgcgcccacgacccaggcaccccgagggttcacaggcaagggtttcagaaggtggggaggctgaggttgtggcaaagtcataaatcagtacatggaggccgtatgtcagtttgacctgagaaggcagacatcacgacgtgtggcccatgggtcggatatagagcgtttttgatttgtgattggttaaggaggagaagctttgtccaaacaattgagatcagcagaaaagaatgttggctctggcccacaggcatgacccctcctggcccctgaggaagaaattcagaatagagccgggttcagggttcgggcctgtgatcccccctgcatttgtggtctgtgttggtagatctgtttggtgagggtctcggtttttgaaaaacaatttagggacatatgttaagatgctatttttaacttgtatagggaataaatatctcctgactaattttttggctattattttattatttattttgcttgttaggtgatttaccactcaaggctggctaggtgtctgatatatttttgaaggaactcgaaggttttttaatcatttaggtgggtggggcctaagcgaggtccctgctccatccgaggttctgcaccaggccacgtgctgcagggctgctgtcggttctgccgtccacgtcttagcgccaggcattctgcccgtctgtcccaccctcccacaggcagggacaagccctggggaacaggccttggccttcccggagcctcaggagctagagctaagggccgggccaggcagagcccctgaagcatggatgagtctgtgtttatcccatccattcattgccattcaggctggagcaaatacagggacagcggcacacacaggtaggcacacatagccgcacacacacacaggtggacacagtcacacatacacacaggcggtgcacacacaggcagacatgcacacacagtcgcatgtacagacaggcggacaaacacacatacacaggtggacacacagccacgcgcacagacaggcagacacagtcgcgcacacacacagaaggacatgcacacagccacacactacagacaggtagacacacacagagttgcatgcacatacaggcagatgcacacacagctgcttgcacacagacagacatgcacacatagtcgcacacacacacagaaggacacacacagccaaacacacagacaggcagatgcacatacagacaggcagacaccgacaggcagacacacacagtttcatgcaaacacaggcagacacacagccgtgtgcacacagacggacacgcacacacaatcgcacgcccacacagacacatagccacatgcacagacaggcagacacacacagctgcatgcacacacaggcgaacatgcacacaggtggacacatacacacaagcagatacacacaatcacatgcacacacaggtagacacacagtcgcatgcacacaggtggacacagccacacacagatggacacacagttgcacgcacacaggcagacacacagccgcacacacaggcggacacacagctacacaggcagacacgcacacagcagcacagatggacacacatagtcgcatgcatgcataggcagacacacatagacacacacagttgcacgcacacaggtagacacacagccgcacacacaggaggacacacagctgcacacacacagccagatgcacagacacaggcggacacacatacaggtggacatgcacacacagcagcatgctcacatacacagctgcacacacaaaccgcacgcacacaggcagacacacagttgtacgcacagacaggtggacacacacccacagccgtgcacacagacagacaggtggatggacacagcagcacacacagacagactgatctagagagacaggtggacccgcagggcagccttgctgtctgctctgctagaagcccccgtgagccttgctgtctgtgtgagtcttgccctctgtgtgagtcttgctctctgtgtgagtcttgccctctgtgtgagtcttgccctctgtgtgagccttgccctctgtgtgagccttgccctctgtgtgagccttgccctctgtgtgagtcttgctctctgcgtgagtcttgcctcctgtgtgagtcttgccctctgtgtgagccttgccctctgtgtgagctctccgaggttcctgcgggcctccatccggcctcgcccgaggggaggtaaaggcagtggcccctgcttgggagacagctgtgcttcccctctggtttgtcccgacggacacacgagcagcctgcagcatcagagcctttgggggtctgcttcactgaatgaccgtctcctacacggttggacccctcacttctgaggcagcgacctgctctcagcagagccaggagcctgggcagccacatggggctgagcagtcaggcaagcagctctcctggagaaaggccacagctgggaccctgcgtcccgggggtggagtggaggggctggacgtgcccattggccagggcagggcggggccgcctcctccctttgccctctaggctttccctgggcgcgcggccctagtggcctgtgggagcagcgccacagcctctgacaccccatccttgtgccttgcagggcaaagtgcacctggagctgcggctgagcgaggtcatcacagacactggggtcgtctgccacaagctcgccacacggtaagacacgtcctcactagagaccgagcgcacagcgagtggcatgtctggctcccgaggagcacacaggggttttcacaccaacgcacaagaatttccagagccggtggctgcccaggatgacactgtttagaggtcctggcccaccaggatgatgctgttttaggggtcctggcccaccaggatgacgccattttagaggtcctggcccccaggatgacgccgttttagaggtcctggcccaccaggatgatgctgttttagaggtcctggcccccaggatgacgccgttttagaggtcctggcccccaggatgacgccgttttagaggtcctggcccccaggatgacgccgttttagaggtcctggcccccaggatgatgccgttttagaggtcctggcccccaggatgacgtcgttttagaggtcctggccccaggatgatgccgttttagaggtcctggccccaggatgatgccgttttagaggtcctggcccccaggatgatgccgttttagaggtcctggccccaggatgatgccgttttagaggtcctggccccaggatgatgccgttttagaggtcctggcccccaggatgacgccgttttagaggtcctggcccaccaggatgaagctgttttagaggtcctggcccccaggatgacgtcgttttagaggtcctggccccaggatgatgccgttttagaggtcctggcccccaggatgatgccgttttagaggtcctggccccaggatgatgccgttttagaggtcctggcctccaggatgatgccgttttagaggtcctggccccaggatgatgccgttttagaggtcctggccccaggatgatgccgttttagaggtcctggccccaggatgatgccgttttagaggtcctggccccaggatgacactgttttagaggtcctggccccaggatgatgccgttttagaggtcctggcccccaggatgatgccgttttagaggtcctggccccaggatgacgccgttttagaggtcctggccccaggatgacactgttttagaggtcctggccccaggatgatgccgttttagaggtcctggccccaggatgatgccgttttagaggtcctggccccaggatgacactgttttagaggtcctggccccaggatgatgctgttttagaggtcctggcccccaggatgatgccgttttagaggttgccccaggatgatgctgttttagaagttctggcccccttccaggatgacgctgttttagaggttctgggcccccaggatgacgctgttttagaggtcctggctcccagatgacactgttttaggggtcctggctcccagatgacgctgttttaggggtcctggcccccaggatgatgctgttttagaggtcttagctcccagatgatgctgttttaggggccctggcccccaggatgacactgttttaggggtcctggcccccaggatgacgctgttttagagatcctggctcccagatgacactgttttaggggtcctggctcccagatgatgctgttttaggggtcctggcccccaggatgacactgttttaggggtcctgccccccgcccccccgatgacgctgctttagatgtgctgtcacacactgctggcgtccacgctaaagcacatgctcaccttagaggtgttgttttgggcttttgtgaatggccagcgtgattcagcgtcacaccgaggcagaatggctggtgtggccctccctgccttccggtgaggaaacctcatctcacagcttgaactcaggcctcctgcctggcccagagctgtctcgccattcgcccaggtgtctgcgctccctcctgacgccgcctctgcttctctcctcagcatcgtcgagtgccagggcctccccatcgtgaatgggcaatgtgacccctacgccaccgtgacgctggcaggacccttcaggcaagttgcctcacgcttcaggtttctgttctggtcctggggggctagggtccagctctgaaatcacgagaccactgcctcatttgggaggagtcaggaggttgcgctttgaggtagaatgtgaatttttacttccttttgttttctttattgctccaaaattgctttgtagaaaatgaaggcttcatgctcttcacgctgggtatttttggctgagtaaaggttcctgatttgcataccatctggagttggagaccagcagaaatatttataaaataaataaagccaataagtgacttgtgcatttgagagctcggttttaccactgagagacttggaatcagcagtgttgttttaatcccaatcctttctcacttgataacagatcagaagcaaagaagacgaaagtgaagaggaagaccaacaatccccagttcgatgaagtgttttattttgaggttggtatcttcatgggtcaacattaagtggaaactctgcacccgagacacgttggcagaaagtctggatccagaatgatctcagtctcttccctctggaagttccttccggagaggagcgagccccgccagccggccctgggttccttccggagaggagcgagccccgccggccggccctgggttccttccggagaggagcgagcccagccagccagccctggggattggacccgtggccacaggaccttccctcctctcccaagagagaaaggtcattcgttgtctcccgaactggcccagatttgagttaaaagatgacagattaatgctttccaaattaccaggaccttgggggtttttgtttttttggctgctctgcccaagcatccctgagaggcggaaggcttgttccagtggaaataggcagggttttgaaacaaaggggaaaggattcagacacagagatcctctcagaacatgaagcaccaaaatccatgaaaaggagggtgcaagggtgcacctggtggaatgtgaccccgtttgggatggctgcatctcgtggagtgaggacctgccatgtggccggtgcggtttggggacagctgtgtgcagggcctttaggcagatgttcttcccatccacaaacattccggtgcacaggccctggagatgtgaggatggatgaggcctctgtggcaagagcatggccagtcacatctgaggggtcgggcgggctcccctgagccatgatggctgagtggggctcgatgcatgcagctctcaggggaccgtaggagagtggacctaccggtcagtgggtcctgactgagtaggacccactggcactgctgaggctcgaaagggccccacaggcagaggtgggaacttggtgtccaaagccagggccaggctttcagggccactgtgaggagggctttagaggtggaatctgttctctgtctcaaacggaagcctcacttatagacaggcggagaagatggttttgccagagcgagggaaggcagggagctgccaggctcccagggggagggtgggccctgttggaggtgcaggaggcatgcagcatggaccgagttccaggtggcagctccccccgcctcggctgctggcttggctgccacacacagagctgtcatacacacagtggggtagagctcgcccactgcccggccacacacgggtgctcatcacgcttgcagtgttctcatgctgtttctactgtgtgcactcctgtttcactctgtaaagacgtgggtctcagcctacaggagcaatttagtgaccacagacagtctgaaaaccatggtctgcgtcaccacctgtggggctccagggaaggcccggacctcgctgaccgctgctgtgtgggacgcgcggggccctgctctttgggctctgtgacctttcactccgtctcctccccttccttagcagacctctttcaccaggactctgtctctttcggcttcagctgcttctgacccagctggaggctgagccccggggagggagcacatcccccgcgggctgtggtcagacagccacctactgggagcagacccaggaaaacagatgttccgtttctatgggaagcagcgtctgtaccattttcttccaggataacaactagacacattaagaccctttaactctctaaatgagattaaataatctcataaatttggtaggagctgccttcattcactcaacacgtgtcaggtgccagcaccgtgctggtgatcagctggtgataagatgtggcagaaaacagaggagtccaaggccaccacaccaggccagcatgggagggatgcaaacagacaagcccctacaatagctcccgacctgccctgcagagagggcgtgaggcaggggcactgggggcttcctggaggaggcattgcctgacctgccctgcagagagggcatgaggcaggggcactgggggcttcctggaggaggcattgcctgacctgagttttgtgagatggggaagttggggggaagcaaatttttggacagtggtgtgtaggtcaggaaggaggaggcgtcagcagccctcaacccgaagcagagaactgcccctgcgtgatcttcacctcagtttaccaatcaggaagtgcaagctcagaggttaggcagttttagcaacatgattttggtgtcaagccttacatcagaacttcgagctgagagctcctgagccagcatcactgctgaggcccggagaagggggggcagggagggaggccgggcaggacggagcccttcttgtaaacgcaggtgacctggtgcacggctgatggtggttaaatcggaactccaggtgataaccactgtctcctggagcctgtgggtcggcctcctgctctgctgcaagggccctgctggctggcggggggcggtcccggagcctcgacccttcacgccttcactccgtttctgttctaaggaacccacggtgcggaggtgtcaggaggaaggtagcagcgtcttgactttccaccgtctgaccctccctggagtgctggggcctgttcggggccggccaggttcaggctccacagacctcacgcgtttcacttcctgttggcaaatagagccttgaggtggggccacgggagggcggcgctggcttcgtctccacggcagaggggaccctccctccctcacggggtggcaggcccagagcaggcgcaggtgacggacatttaggtacccagagcccggcacccatcaggagccactgggagagtccggccgtggccgtgaacagccttggggcaggtctcacctgggtctgcccctccaggggcgccgtgagtaggaaatgctggcactcaggaagccaggcctgaatcccgaatcccgcctggcgccttcctggttgtggcccttgagtggtgtgtgggtaagcgcagagggtagggcagcccggggcctaggtccgcatatacccccgcctggtggcaccgcggtctcagcgctttctctctcgtctgactccaggtgacccggccctgtagctacagcaagaagtcccactttgactttgaggaggaagacgtggacaagctcgaaatcaggtgagaaaaccaggctccgcgtccccaacttggcagttttcacccaaactcctcagctcttttgttctttgttactaaatatagggtcatagatagaaatgaatttccattttcttggtaattttcacaacaggatgttagaagttgtagttgaagtgacagcctgtgggtggtgttagggctcaccttgcaatacctgcgaagaggcgaaagccagaggtccgcatccctctggccgtaaggcttcatccacctggagtgacgggggctgcagccgttcttaaggtcttgttctaagccctccgccttccatgggttcaggcctcactcagaggtcgcagggcctggcgggtcagcacgacgcctggccctgaccgagcaggacccactggcactgctgaaactctcggctgggtggcctctgtggagaccctgtcccctttgactcgagtgaaacactctcacctggcgtcctgggttcatgtttcctgtgtatggtcatagaagctgcatcttcagcctttgcccatggagcccccaccgccctttcctggctcctcaacgcctcccacgggaaacggggaaatcgcttgtgggttcacgcaggtcaggacgcgatctcaggcccaggatttagagagccccacgatcccgctgactcagagttctggggagggcaggcgtcagaatgtgcccttcacaaaccccggcgggttccctcctcccagtgaaaataagctggattcctgtttatttttgaacgtagcctctgttccttctgtaccaacgaatgcctccattccctatgaagaggcagatgagcctcccctgaagcccccgaatcttcccatgctggacagagaaggaaggaaacggctccctcctgaccctccccagccggccctgagaccccgagcctaggatgcccccgagcctgggatgcccccgagcctgggatgttccctgagcctgggatgcccccaagcctgggatgttccccgagcctgggatgttccccgagcctgggatgtccccgagcctgggatgtccctgagcctgggatgcacctgctttctttaggtcattttggagaatgtgctggccatcaaatccctggtcacgctccctcccaggggctaacactgccctggggggacccttaatgggacacgtggagccggtgcgtggctcaggccctacggctgctgggaggcgtggttttgtggttgagaactgtaggaatgtccctgatgttatcggtcagatccgtcccccatagttgtctccatcctgaaccatagaatgtccctgacgtggtcagtcagatccacctcctgaggggtcagggtcctgaaccatagaatgtccctgacgtggtcggtcagatctgcctccccagggactcacaccagcccctttttcaagagaaggaagcgccattgttggtttctttttacaccaagttttgaattcaggagtgaagtcctagttattaaattttttaaaagcacacaaaacatgttttaaatatttcccttattaaaggcaaatgcgcctgcctggccactcagcatatttttttaaagtgtccatgggcagatcagcggtcccctcatgttccttctgaaaggaacgcgctgtgggttcctgtgcagcctgtcagccctccccggcccagatgccagtgcctctgtggtgccacttccctgcaggattcgcaagggtaacaaaatccccagccttctggaatcttctccctccagggggatgcccctgatgcccacagtgtggttaggcctgccgagttttagccccctgggtagggctggccacgtgtaactgtgtggtttcaggcccgtgggtagggctggccacgcatgacttcaggtgtttcaggcctatgagtgggtcctggccatgagggactgggttaccagccctgtagacttgttgcagccggggatgctgtatgtctgtcagaatttcacagccccaggtctgaggggacacgtaccatcccacactaggacagaacattagtgggagccgctgctgtgttagacatgagcagaagcttcacaatgctgggcctgcggtagtcacggagattcgtggaccgtgctgtggtttgtggccacagttctccccccgctgtggtgtgcatggcccctgaatccactttgtgcccctagatcatgagcaatccatggagacagggttctacatttgcccgccgtgcacagactgctggtgctgggcctgttgtgggcaaaggggacagatggtgctggagctgagagtggcagcagccacatagctcctgggtgcacacagcaactcctggctccctcctggcacagagcgacgcctggctccctcctggcacagagcctggggtcatgtagctcctgggtgcacgcagcgacgcccaggctccctcctatgtaagagcctggggtcatgtagcttctgggtgcacgcagcgatgcccaggctccctcctatctaagagcctgggtctgagtccgggcccatggccttccgccttcctctgcctgcccattaccactgggagacactcatctttattccaaagccacaggctggtctgacgtgtttgaaacgtgccctgtgggctgagccttgatggagactctgggaggcgctgcaggctccattctgctcctgggggaacaaagcgtggcctgtcatctttgctccacacgggctgcccgccgtcagctagagctgtcctgatgctgtttttcagagttgacctctggaatgccagtaacctgaagtttggagatgaattcctgggagaactaaggatcccgttgaaagtcctgcggcagtccagctcctacgaggcgtggtaagatgatgttgcacctgcagacttccgcatctctgagagccacaaaaacacgtgctgcctctgagtggaaaggcacagaggccacatgtgctggtcctcggctgtgcccagcacccacctgctcttactttgcatgtagctctgacgagctctggcttgatgagtttctgccccacagcaggtgagaaatggcaggtgaggagaggcagcagggatcacactgagcagggactcacaatggctggcacctcaaaacaagacagggaacgtgggtgaaagcggccctaagccacgagcagctcacggggtctgatcctgggtgaaagtgggaccctgagccgcgagcagctcgcagggtctgatcctgggcgaaagtgggaccctgagctgtgagcagctcgtggggtctgatcctgggtgaaagcggggccctgagccgcgagcagctcgtgaggtctgacaccagtaggggagggcatcagcagccggtgcaggagcccagaatgcgcacacagcagggctgcgccgcggctgcgctccgggtcttgttctgggccctcggcagcacctcctgttgagggcgcattacagggttctctactcccctctgcacgtctagacctcagtggtcggctctgacccagaacccaccccaggacatgttgtgtgttgctgcctcctgcctttctttcctgttgtctccaggtgcttggtgttttggtggaaggaacaggccattgtttcattttatctccagttcatgtgtgtcccttagcgacaggcagctcctgagagggcccggagtcacgggaagcgtgcactcccaggcgtggactgtgtgccggggcctcgcgccccatgtgtccctctgccatgtgtgagggcaggtttccatcccagaaaccgtgaaacacgcgtgtcttttgattctacgaagacggcacgggcacaggccccctgagctgagttaggcttcctcctatgctgaatgaatccctggccctggtagccaaggcagccaccacataccccagagagccccagggtgctaatgcctcgcacacaggctctacctacctggggcgatggggggcggctaatgcctcagacacaggctccacccacctgaccggggctgctaatgcctcggacacaggctccacccacctgacagggctgctaatgcctcggacacaggctccacccacctgaggggggctaatgcctcggacacaggctccacccacctgacgggggcgccaatgtctcagacacaggctccacccacctggcgggggctaatgcctcaggcacaggctctatccatctgaggggggatctaatgcctcggacacaggctccacctacctgacaggggtgctaatgtctcggacacgggctccaccaacctgaccgggctgctaatgctgcagacaggctccacccacctgacgggggctaatgccttggatacaggctccacccacctgatgggggcggggcctcggacacaggctccacccacctgagagcttagactgcctggcccacaaatgagagcagaagagggctcctgggtgactgcgtggggtagaaccaaagatggaagaatgtccgggcagaaaacgtctcttacaatgaccaggtgcccaggtggcctgccaggctcactagcccaaggcccccaccccgtgacatcgggagccacggcacactttggttgagataattttcatttccacctgctgctgacactgctgggtgtgggtcttagggcgggtcactgaccacttctgtgccggttcccggaaacccgttcctgccacgttccacccccatccccctccgcgtttccccccttgactcctgcgcctttggctccaacacttgcctcctggggatccccggtgaccagccctgctgggggtcttcggtggggagtccccaggggctgcactctgaggggtcctacaggatcaccctcctgaccagtcgacctcaagcaggcagctgggcttccctgagagctgctccttggcagatacagcctcatgcctcccctccatgtgtccctcccacccaggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggaggtgcttgtccacgccgtggcctgtgggtgtgggcaggaggtgccacctgcctggggccccaccctacacccgggcccaccccagagggcaccttctccctgagggggcctttcccatgcctcccagcctggcctgtttcccgtccagatgcctggacccctttgctgggggcactggtccgtcgacagttagagccgtgggagcctggtgatgctaaggactctccgggttgttcgagggggaccccatcatcagagtccctctaccggctcaggggccctagagctggctgcatgggggggtcgctaggaggaggtgcagatgcccctccaagggtccagccaagcagcagcaaatgggaagtttggtgtttttgtgaatgtgtgtgtttctgtctcagcaaagagccgtatctattgtggctggaagtgagaccccagccaaggtggggacaggcctctggggttcctgcaccccgggccctggcactgacctcacccctccccgcagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccagtgagtgcccaccctgccccgggggagagcggcctggacccgctacagggatggcaaggtcgtcgccgagaaccacgtgtcctggggcagggcttgagggaattcaagggtccccagaaaccatgttgattcaggttttctttcacagacccagttaatgattcttttttttttttttgaaagtcccatttgcctttgaaatcccgggtagagtgagtgagtggggaggggaaacggctcctggggctcgaggacagctcaggtcccctccctggggcactttgggagcccacaaaaatggagcacagcttccctcaggacctgcctagtgctgtttccggacgccctgttctagaaacatctggctgcacctgcagccactgtagctgacaggagggtttgcttctctgctggcccttggatgctgccagggtctggtgcccaactctctgcacaggcagaggccgcagaggggagagggcgggagggcgaaggccagccaggctcctcctgagctggtggccacgcaggtagccgaacggttccctctggcagtgttgacacaggacggttccatggccagggcctccaagcacctggcctggttgtgctccttgtaaaatgtcaggaagccgactgatgggcgtgcactgacctcacagcccacaggcaggtgctcggggccaggctctgctccgtctgcacttccgcgtccccaggagacaaacgctgtccccatcgccatttcccagggaccccaacaccatcttccgaggaaactcactggcgtccaagtgcatcgacgagaccatgaagctggcggggatgcattacctgcatgtcaccctgaagcccgccatcgaggaggtgagcacggggccgagagtcctcagcctcacgaggcgtggggaggatttcccccaacagagggcactgcactgggatccagccagaccacgagctgggcttgaatgtcggcccctctggcctcgccacggggatgctgattcattcacttttatcaagaggatgttccctgtgtactccagaaccttccaaattctcccaaattaaaactatacataagaaaatccaccactccacaaaggagaacatgcaagaaaagcctggctcttcccagggagaccttctttctccacatgtcctgcagtcccctgtgtttgggccctggctgcgtggcatgtttgagctgcacgcccagtcctcacccgaccctctgatgcccgcacacccactcctcacctgaccctctgatgcccgccaggctgtgccccccgtttatgagcgggtttgtaaacaggttctttgcaaatgtgagaaaattgaacatagcattctggtttgctctgtgggcaaaatcatggcagcattttgaagtaaaaatattattaaagccctgtgaggcctagtccgtgtgggctggtgcacatcactcctgagaaagcccgattcgtctgatcgcgggcgcacatcgctccctgagagagcccggctcgtctgatcgcggccatggactgggccccgtgcctagtgtttgcgcctgacctctcacttgtccctccgcagccagtgacacaggcccagggttgcccccttgcagctgaggctcgggacgacaccaccccacggtggccctgcagtccggcctcaccgtgcccctccgtgccagtggccgggttcggggagctgtcgtggcattttctggatgaggctcagggtctacatctcagccaggcctgagaccccttccaccctccctgcctgtgcccccagaacccactcacagagccctgtcttaaacctctccccagatatgccagagccacaaaccctgtgaaatcgaccctgtgaagttgaaagacggagaaaaccttgaaaacaacatggtaggttttgttcatgaaccaaccaaagccagtcacctgcttggggtttttcagccgatggctgcctggaagctctgactcaccccgtgaccccggttggggtgggagcaggaccaggcgtggggatacccgcctcacccggctgcagtacgctggctgcactactgggaggcctcagccaccacctttggcctggcctgtgtgccgggctctgcgtcccctggggggtcccggccagctcttcctcccctggagtgatccggtctgcatgccccagctctgcccccccggagggtctgccctgcacaccctgctctgcctcccctggacaatcctgaccagctctgcctccgccccggctcctccttcccttgggcaatggctcctgcccctcccttttcctaggacaggatggcctccctgcctccccaggctgtccccagagctgtgtactgcgttttaaaacagcaaaactccctgatgttgaacttgctccaacattttagtcacttcacatgatacttcttgcagagcgtgctgtttcgtcatttctgtatgtaaatgacagagctctttgccttgggcaggcacattctagtgaacgtccattccccactcagtaaacgaggtcggggccgagccggggagccgacgtggtgcctgtgtagtgattttcacgcgtgaattgccacagctcccagcacagatttccagggagtggctgttcacacgtgtctcactgccgcagctgccctgcgcccgccctcagcccctccccacgcgcccctccctgggcgtgccctggtgctacacgcacctgtgggcagcctcgggagtgggtcccagtgccgtgtcccgttgcaggagaacctacggcagtatgtggaccgcgtcttccacgccatcactgagtctggggtgagctgcccgaccgtcatgtgtgacatcttcttctccctccgggaggcggcggccaagcgcttccagggtgagtgccctgaacaccctcatgttgctgagaaactgccatagcgctgtgcagggtgactcccacccaggcagaaccccccgcagccctggctagactagaactgcggggtcgtgaaccccagttccgatgctggatttttccggggtttgtgcccgggccagtgttccctagttcacaaccgcagtggtctctgggggaccccagccctggagttcacctccacagtagtctccaggggaccccagccctggagatcaccaccgcagtggtctctagaggggcccagccctggagttcacgaccacagtggtctctgggggggccgggaagggtggccaggctttgtcggggtggaatgtgaattttcctgatgtggacccctgggttttcccagtggtttctttttgtggccgaccctggcagggcccagagtggtgttgggggctctgcctgcccgtgtcttcgaagagacaggacccctgggggagctgccctttcttcaaacccccaagccggagatcccctagggacctgggcatccagcacccaaaccccacttctcaaccttgccgaccctcagggaggagctgggtgcctgcacccacccatcacctgcgatactcaagaccccgccaggactcaggctatgtatggggcgctgagaggctcagcgagggccttgctgccggctcctctcttccttgcgtgtcctgtggcctcgggacagctgcagacaccccggggtggccatggtcctgcagagccgtccacgcttctgtgtccccaggagacaaacgctgtccccacccctgtttctcaggacatcagacagtcagacagcgccggccgaggggcccagggttctgggggaggcagttcccaagcacatcccagccccagacccactttgaacaaggtggaagtgaagagataaaacacatcctctcacccagatgagcacagaccactgtggaatgagacaccaaaggggctgcgctgtgtggtggtgatgagagatggagagaaacagggagagatggagagagaggcagagacagaaggagagagacagagagagacaaggagagagagagagagacagggagagacggagagagaggcagagacagacggagagagaggcagagacagacggagagagagatagagacggagagagagagatggagagagacagagacagacggagagagatggagagagagatcgagacggagagagagagagagagacagagagatagagacagggagagagagacggagagagagagacagagaaagagagagaaaaagagacagagatagggagagagacagagagggagagagacagagagatggagagagagacagacggagagaaagagacggggagagagagatggagttagggagagagacagagagggagagagacagagagatggagagagagagagccagagacagacggacggagagagagagggggagagagagagagacagagatagggagagagacaggggacaaagagagggagagagacagagagatgagagagagacaaatagagggagagagagagagacagagatacggagagagacagggagagagacaaagggggagagacagagagatggagagagagagggaaacagagagagggagagagggaaacagagagagggagagagacagacacaggtggagatagagccaggactgtggctggacttccatgcggaccctcagggggccggggcatggtgtccccacgaggccattgtgcccgaggaaaacggtcaccctgcttctctctcccgcagatgacccggacgtcaggtacactgcagtgagcagcttcatcttcctgaggttctttgcgcccgccattctctcccccaacatcttccagctcacgccgcaccacacggtgagtgaccggctgagggaccgaagctttctgagctgtcctgcgacgccggcctgggttggggcatctgcgtggctgtagggggccgaccgtgtggagtgtggaatgcgtggggagtgtgtgaggaatcaggagtgagtggggagtgtgtgtggaatgaggagtgagtggggagtgtgtgtggaatggggagtgtttgtggaatgaggagtgtgtggagtgcgtggactgcgtggggagtgtggaaggcatgtggaatggggagtgtgtgtggaatgaggagtgagtggggagtgtgtgtggaatggggagtgtttgtggaatgaggagtgtgtggagtgcgtggactgcgtggggagtgtggaaggcatgtggaatggggagtgtgtgtggaatgagtgagtggggagtgtgtgtggaatggggagtgtgtgtggaatgaggagtgtgtggagtgcgtggacagtgtgtggggagtgtggaaggcgtgtggaatggggagtgtgtgtggaatgaggagtgagtggggagtgtgcgtggaatgaggagtgtgtgtggaatggggagtgtgtgtggaatgcatggggagtgtgcatggaatgaggagtgtgtgtggaatgcgtggggagtgtgtgtaatgagtgagtggggagtgcgtttggaatggggagtgtgtgtggacggtgcatggggagtggggagtgtggaagacgtgtggaatggggagtgtgtgtggagtgtgtggacggtgcacggggagtgtggaaggtgtgtggaatggggagtgcgtgtggagtgtgtgtggagtgtgtggacggtgcgtggggagtgctggtggatgcgctgggtcctggaacgtcctcgttgcaggtggttcaccgacctatttaagctgtgtacgttctgggggagtcgagacagtgtcacaaaagcagtggacggtttgtccagggttttagctgctggtcaccgccctgctctcctcccctgcccatcacatatggagtattgatgatcggcgtatcatccgtgtattgagtcaacagattcctatttagcactgattttctccaggccccaatgtggttgctggggccgcagctctcagggtacagggatctggggtgaccgtgttgcacgtgcgggtggcagagctggaaggagatggccagggcgaggggacgtgagggattgcccattccccagcacttctttttttttgagacagagtcttgctctgtcaccaggctggcgtgcagtggtaccatctcagctcactgcaacctctgcctcctgggttcaagcaattctcgtgcgtcagcctccctagtagcttggattacagacgtgcgccaccacgcccagctaattttgtatttttattagagatggggttttaccatgttggccaggctggtctcgaactcctgacctcaagtgatctacctgcctcggcctcccgaagtgctgggattacaggcgtgagccaccaagcccggcccccagcacttctgagttgaaccttcaaaccctgtgaaggctgagatgagccccaggcagggccaggagactcagcaccccgagactcagcgccccagagccatgaccccacctgatgctttcgactttgagatgcaccctgcacgctgggccgagagagtgggtcaccgcggtgccgtcggatgttgctgcgggatggtctcagcagctgcctgagactgtgggacgcccaccccctccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggggtctggcccctgcgccttcagcctggggacccctctgccaccttctcggtgaccttggagggggacgtctgtgtcccacagccaccccgtgtttctgacacaggcctgtcctccctcaacctccacccagaggtccctgggagcatcagagcccatcaaccttccttacataactgacacgtctgcccgtttccaccaaccccgtcctgtggcccggctcccactcccgctcggggctttgctctgcctggtgtggaccatgttcctgtattttttatgtgtttgccaacatgtcgggcacaagtgcagttgtattggatggggcttctcgtgaaaccgtcacctgaacgggcactttgtgcccactgagtaatttctcattcctctcccgctcccacctccacccttccgaggcctcagtctgtgattccgaatacgtgtcccagagcgccccgcccctccgtgtttatctcctatggaccagtgagaacatggggcgtttggcttttcgtctctgagtcatctcccttaagataacaacctctagttccgttcacgttgctggaaaacataagatttccttcctcttgatggtggagtagcatgtcgtggtgtatttatgccacgttttctttatccagtcgtccgttggtggacacgtggattccgtgtctttgctgttgtgagtggttcagcggtaaacgtacgcatgcaggtgtctttttggtaattgctcttcctttgggtggggcctggtgtgggattgctggatcgaatggcagctctgcctttagcttcttgagaaatctccgtgggtttccttaagcgctaatttccattccccacagcgtgcaagcgctcacgtcctccacagctctgcagcgtctgtcatttttccgtgttttatttgatcccagccattctgcccggcgtgagctgggttcaggcggctccattctgcctggcgtgagctggggtcgcaggtggcttcgttctgcctggcgtgaggtggggtcacaggcagctctggctctcattcctcaggtgatgagccacgctgggctttatatcgtatgcttgttggccatttgtcttctgaaaaacgtctatccccctgtcctttggccacttttaaatttttttttaatttttattttttttgttaagttgtttgagttccttctaaattgtggctgttagtcccctgttggatctgtgctttgcaaatatcctcccattctgcaggtcgtctgtttgctctgttggttatttattttgctgtgcagaagctgtttagtttaattaagtcccatttgtctatttttgtggatactctgttagagccatctgctgaaacctggatcatctctgggtcactggtggaccataccccagtggcattacttacattgctatttttcttaaaatcaccttcatttaacttaatcatatattaaccaataacatttgcaatacacacatttcatgttagaaatgcaaaatgtttgttcttcggtgccataaggaaaaattagcatttagacaaaaagttctttcagcgaggcaatttttactttctgcagaaagggtgtccctggcagaaggagtaatggcaagggcacacacagaataaagagacgccagaatatttattccttacgcacgaggttcctgttgtcgtgtcctgtccccattgcctggagccggacctcacaatctaaattaagacctgattggctaataatttaaaacttttttaaataggtagaaaaataataatatgtttaaataaggaaggggcataggctgtgagctgggacatgcctatgagtacgtctaacacaattgccttggttaaggtacaaggacacagaatatattacgagcctgtgggcacgtccaacagctacacaggatagagcttaacaaagagttattagcacaaagcaaggaggcttgaaggaagttagtctttaaaagaaactattatttctaacacttatgatttattctttaacaagaagggaaactttgaagaggaaactttttactttctacatttcataaattcacagctttcaaagcaacagatattcatcctgtaatccctaaagcaacacaggacactcagggcttgtgtgtctgacgccgagaagctgctgtagatacaggttcaaggacaggcgcctcccaggtgccaccagccagaggttcaaggacaggcgcctcccaggtgccctggatgcagctgaggctccaccagctccttccagcagctgcaccacctgcgactcacaccaaggttttggtccatcaggccctcgagtttccagcccctggatcagcttctcctccggcacctcagctctgtcacatccccaaacctagggccaccctcggttgtgcaagcatgggccgtcctagggcctcggttctgccatctcagcccttggtgccaagtgtgtcttgccatgttcgtccatgtgtgggggtggtgatgaccatgtttcctgagggctcaccctgtgctgagatgctcccacacctctgccgtctctcagggctgtgtgtgtcctcacccactgggacacaggactggggacggggcctctgcagcgcagcgtgtgtttgctgagttgagttggccgtggctgcgcggggccgagctgctttcagcctgaggcttccggcttagccgtggctcctgcctccccgtcccacacgcgcgatgggcccggttagaaaaccgactcctggagagccaggcgcccagaccagagctgtgcagtgaggagccactggcttctctccactcagtgctgccttaacctggaaactgcacataaaattcacatgcagcctcatccactgaaggccctcagaaagttggggttcttaaaaaaatcctaaagccgaaaacatttataacaagactgctactcaaatctaactgctacatggtccagagtcttctcagaggcgccctgttgccctcaaggaggccggcatgtcgtggagctcccagtccccccccaacccccgtctgtgtaggccccgccctgcgcatcccactgggtcctgctggtcctcaacagcctcctgggctgacttcctgcctgtgaatccctggaatgaacggcgttcggcatccactggttgtgaactgcgctgtcctggcggctcccagcgccccgcccttttctctcttgaacagctcccagcagcttccacaccctccggtgtgcgtccacagctctctggccacatctggctgtgttgctgctcaaagcccctctttccgatttctgagtgcgcttgtcgaggtgcgtctcccccgcccacctccccactctgtctctccagcttggcttctcgtcctcagcttccacctctgtcctccagtcactctgtctggccactttcttctcctccagctcggccgccggttctggtcagggacccctgcccggcaatgaaggccgagcctcagagggccctgggctgccgggagggtgttcgaggaccctgcccagggcaaggcttgaggtcctcctcgctgaggccttgcatcctcgatggccatcctgtctcctgctccccacgtttcctgaggacgtggcccagtggcgccttctaccacagcagggctggccctgagggggcaggtttggtctggcagaggcgctggtgcgtgactcccgcacaacacaggtgtgggttttgtgggcgtctgctgcctgccccggccccaagcctgtggctgcaggtcctctgagtatgggcgtctgctgcccgctctgaccccgagcccgcggccgcaggtcctccgtgtgtgagcgtccgctgcctgccctgaccccgagcccacggccgcaggtcctccgtgttgtgtgggcatccactgcccgccctgaccccgagcctgtggccgtaggtcctctgtgttgtgtgggcatccactgtccgccctgaccctgagcccgcggctgtaggtcctctgtgtgtgagcgtccactgcctgccctgaccccgagcccgcgcctgtaggtcctccatgttgcgtgagtgtccactgcccaccctgaccccgagcccgcggccgtaggtcctctgtgtgtgagcgtccactgcccgccctgaccccgagcccgcggccgcgggtcctccatgttgtgtgggcgtccactgcccaccctgatcccaggtccgcggccgcaggtcctccgtgttgtgtgggcgtccgctgccctccctgaccctgagcccacggccgcaggtccgccgtgggagcatcgcattggcatttccagtggcagcaccactgttgaaagttcagtgtgggaggcaggagggttggagatctcctaaaacctggtgccatcaccaactggtgactcaaagcagtcagcgctcaacttttcaaaggagaggcattgccttccaattttaatctcatcactcggagtaaaatgataagatattgaaaatccactgcctgcctcaggtctcagaacgcagaaagtggggggtgtggtttttcacctgtgcagggaggcagctgaggcccggaccccggccctgtgtgctcttcacacaggttcatgatcaagagggcccaaggacggaagcgctttgggatgaagaattttaagaagagatggtttcgcttgaccaaccatgaatttacctaccacaaaagcaaaggtaaggagcaaggtcgctttccctggctcttgctggagcgtgctgggccctgggactgagtctgctttttcagggggagagctgaggggaggaaggattcagtgctgcgggcagagcccggggccgcggtgacccagagccctctgcttctggttctcccttcaaagatccctgaaggggtctttcagacctgctgctggaaagtgagggaaatctgcttccccagagaaccagtaaacgcagagctgaccacatcagtaaggtgcttttctgtccacgtcccttcctcctctggtcgcctcgtcatggccagggtgccgctccgccgaggtagacggggcttcccaccacctcctgcccctcgctgtcagatctgctggctcagatctagattaggaaatatctagcagtttctcccatgttcatgtcccagaacgggaacatgttctggggacagagcctgaggccacggcagctgtgaggatgcgagcattgggcccagcctgggtgcatggcagggccaggtgggtcccaggcttcctcagcccccgcacctgcagcctgtcagtgattcagccatcatccccaaggagatgaacatggggcacctcctccggcccagggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaccccccagcagaggccccctggcagagaccccccccggtagagacccccggtagagacccctggcagagaccccctggcagagacccccccagcagagacccccggtagagaccccctggcagagaccccctggcagagaccccccggtagagaccccctggcagagaccccccggtaaagaccccctgggagaccccccggcagagacccctcagccccacccggaccccagccgggacagcggggcccgcacccactgacagtccatctctgctgcaggggaccagcctctctacagcattcccatcgagaacatcctggcagtggagaagctggaggaggagtctttcaaaatgaaaaacgtgagtgtggggcccccaagcctctctttcgggttgaggcctggccaggttttctctgctctcttcccgtacctggccctgggctcacccttccccacccactgcactccaggcttctcagagtcttcgtgttactcgggttgttcaccaggtgctggtgagtttgtgtcggaatctcgcatcaaagcagccacactctctgtgcccggggtcaccggggtggggtggaacctgccggaaggtggggcctgagctgcttcaggtggcgtcccccgcagggtccccaatgtcaaggggccctctgtcaaagacatcccagaagcaggcttgggaccgtctggaattccttttggaagcttttttattttgatataattttgaatttatagaagttgcacgagtagaacaagtactttccacacacccttgacccagacccgtgtgtggcctcgttccccggtcacgcttgacccgggcccacgtgtggcctcgttccccggtcacgcttgacccggacccacatgtcgcctcgttccccagtcacacttgttccttctcccttcacggtcccgcccgtgcttttctgaatgtatcaacacttccaagtgtgtttcccaccgtgcagtccccaaaaccacagcagccaccatcgcacgtcgccggcgcgaccacattcgagtttgccgctgtccagtcccgttcttccggctgtggttccttcccctctggatccagtctgcgctgcattctgctgccccctccgtctggcccactggacactcccagcctttctttgtgtgtggtggccttggcatctttgaggcgtgcaggccttcggttttctggacatccctccctgtgggtttgtcggatgtgccgacgtggcaggttctgatgatgcatttctggcgggaatcccctagaggtgtccgtggcgtcaccattgtgtggtggcctcccagagtcggccgctggccacgttctccctggtgactcagtgccccttcagccagtgaccccgccgtccgtgccatcctgaggctgaccccgtaccctgacacatgctggctgggacaagccttctgtgccccgactgcagcatgagggtcatagaacagttgcagggaaggcacagtccctgggcctcgtgccaaagttgacgcatgttccttaccattggcagaattttactagcatgttattcacaggcagtccagacagatcctgcaaaaggcataagtttggagagtaatttgaagaggagggcatgggaagaggagggctgggaagaggagggctgggaagagaagggttgggaagaaggggagatgggaagaggagggtgtgggctcaatgcctgctgactgagggggatggccggaacctggccctgagaccgtccctcgaaggaagcagtgtggacatgtcctggaagcacctccagcccttcacatagattcccaataattccctagtttcagccgcctgttcccagctgttcattcccactgacttcctcagagcccgattcccctgaggccactgccaggccaggctctcaccagctggggagacctttctgaaggctgctcctggtggcagggccgagcctgggatgatggccaggacgccctccatgggggatcacagccatgcacgggggcgtccagtccgagacctatacacatgtgccgggtgcaaggcgggaggctcctggcctctgtaaataagacctcagctgttcaccagaaacctggagcccaaatcctccccagatgagtgcagaaggcccgtcccctagagaaggccactgtccccctgactcctgacttaagggcaagtcccacatgagagccctcccaacctccagtcagtctcctactcagaaaacctgtcttctgtgtgcaacagagccggctccttctgggagcttctgacctccaatcctaggatatctgtcccccctgccccagcacccccgtccctctaatcctaaggcttctgtcactcctgccccgggagacctgtccctccaatcacaggacccctgtcccacctgccccaggacctttgtgcctcccatttcttctgcctttgacaccctttgcccccaccccctgcttaactaactttgagtcaacgccgactacagcaccaggactgctcacttccagcttctgctgacacctgccctcgtttagtctttcttggtggctgcaggttcagtagaaactctatgccaggctttgtctccgggacataggagagtgctggtgctcagtcatgtttgttgaatgagtaataaatggtaaaggttgttgctgccccgagacgcttcaagaggaagcagccccctaaccccagctgggaggaggaggaagaatcctgggctggtcagttggggaaggagctgagcaggccgggccacctgggctgacacagcacgagcaccacgtggatgggatgcctgcagtcagctgcaggagggccttgtggggaggccacagggcccctcttttgtcttgaatggagacctccaaggctccaggacataaagggccttggccaagctgttcctggccacctggccacatctccagctgcaccagttctcacctccattccccacggccccagctgtcaggttttagggtggcagagagctccatgcaccccctggccttggcctcttctggggcttagagctccaggacttttgggcctgtgcaccctcagcgtcccctcttacgactccggcgaggacggccaggtgcctggtggactcttgcacgtgctcagccacgagacctcatgtgcgctgtcctgagcccacctgtgtcctcagatgttccaggtcatccagccagagcgtgcgctgtacatccaggccaacaactgcgtggaggccaaggactggatcgacattctcaccaaagtgagccagtgcaaccagaagcgcctcaccgtctaccacccgtccgcctacctgagcggccactggctgtgctgtagggcgccatccgactcggctccgggctgctcgccctgcactgggtaggtctgtgcctcggtgcccagctcgtgcactgtgcaggaaatgtggccaaggggctgagtagggagggaccagcagacagtgcatgcctgcctgtaagctgcacataaacagggctgccctcgcctcctcccaggagcctcccacccgaggggtcctccctcgagggagcatctggggcccagcctctggaaggctctgcgcagactccagggtgccacaggccttcgagggtcttcctgaggccctgccccgggggagcgggaggtcagggtgaagggggactccccaggccgtggccatcctgcttctctaggaggaggctgggagcaagcccctccctgaaagcttcgtctggcccaggacacccaccttgataccacatgacgcagcagtccgttgtcttcccggccccccatcagccgggtccccatcagccgggccccccatcagccgggccccccatcagccgggcccccccatcatccgggcctccgctgcagccgggaccccctgcagccgggcctccaccacagccgggccccaccaccaggcgagtccccgagcacgcgggcccccgattagccgggcccccccaacaaccgggccccccttgagcggggtcacctataagccgggcctccccatcacacggacctccccatcaaccggggcccccgtcagacgaacgccccgtcagcccagccgcacaagagcccgacgagccccaataaaacccctggacaccggggcccacggagagccaggcccacttgcgaagggaccagtgcgtccagaacaaaagagagaagtgcctggagtctccatgcaccccttcaagccaggcccgctccgcagggtccccagttagcgacgaagccaatcggccggcccccctgttaggccccccattagcagggccccccatcagccgggcctctggcagttgcacagaggcttgggtcatacccgccggtcctaacgaggaggcctgggtgtctggcgctccccctgggtatgctccgcgttatgcagctcgctgttgttgtgggtatgtgatgctttcgcataagggctctgcaggggatgagctgtgctccattctgggccaccgttgcatcctcccacaccctcagaggtgggaccttagatcctgcttcgtggacacagaggctgaagctcaggaagggggcctggctgctgctcaggcatgcgtggccaccgccccagaatcccccaggagaggccagcgctctcccatgtcctcgcatcccaggacagcgggaagcattgcagcctgacgaggagagaaaacctggcctgtccccacccgcagccgaccgtgcagggaacacagtcccaggaggcttccttccaggccatttatctccatgagaacacgtctgccgagtttgctcactgccttggcagatctgtgggtcccaagaggctccagccgctgaggccggacagctcgggagcctcccctatcccgcacacccacagccagcctcagttctcccagctcggggatgcttttttagttttatgtctttgagatgggatctcgttctgtcacccgggctggagtacagtggtgcaatctcagctcactgcagcctcgacctcctaggctcaagccatcctcccacctcagcctcccaggtacctgggactacaggtgtgctccaccattccaggctaattgttttaaggttttttgtagaaacggggtttcaccacgttgcccagactggtctcaaacttctgggctcaagcagtcctcccacttcactctcccaagtagctgggattacaggctgatgccaccagcccagctcattaaattttggttttttgtagagacggggtctcactatgttgccaggtctcactgtgagggtctctccatgttgcccagggtggtgttgctcaaactcctgggctcaagcgatccttcttgcctcggcctcccagagtgctgggattacccacatgaactccctgactggccagggatgtgttttaatgttggtcacttcatcttctttcttcttttttttatgataaatgcatttcattatttatttagatgtttaagctctcactgcaaagtttttacaagctgttgaagactgacaaattatttctcacacagaactataaccacccatccccagacagcataaatatatggttgaacatgaataagtgacacaattttatcaattacctaataaaacaaatgaccaagtatccaaatactgagctactcagctcaaaaggcatatacagtattgacatctgatcagttcattagcagaaacccacttctttttttacaagagaagttgggaagaaaagggaaaaactgtcatacttcaaacaaaaataagttggaaacaatttctaatcagtatggaaaaaattacagacgtttcagaaattttatgatttaagaattgttttagctataataagcatttctgccttttaaaaagtatttactaaattaaagagcatatttcacacgttctgcacaaggcagcattttgctaaaaataacagccccgcgcgttcctatcaggccctccctgttggttgcacctgcgtgcaaatgtgaaattaaccgtgaggccactttgtctgaagccatcaaagacgtgcttctgtacaatgtagattttcttttcttttctttttttttttttttttttttttttaggcagagtctcgctctgttgcccaggctgaagtgcagtggtgtgatttcggctcactgcaacctccaccttccaggttcaagcgattctcctgcctcagcctcccaggcagctgggattataggtgtgcaccaccacacctggctaatttttatatttttaatagagacagggtctcaccatgttggccaggatggtcttgaactttttacttcagatgatccatttgtgggggggtgccaaaagtgtggggactacaggtgtgagccaccacacccggctatggaggtttttcataataacacaaagtaagatttataaaaagacatgaggccgggctcagtggctcacgcctgtaatcctagcactttgggaggtcgaggtgggtggatcacctgagctcaggagttcaagaccagcctggccaacatggtgaaaccccatctctactaaaaatacaaaaattagccaggcgtggtggtgtgtgcctataatcccagctactcaggaggctgaggcaagagaatcgcttaaacccagaaagcgtaggtttcagtgagctgagatcgtgccaccgcgctccagcctgacgtgtgctggtgtgaacataggagaagcagacatagaatgagcagggaaacaagcacacagcctccttctgtgtttgaaatgactgaaggaataaaccacatgaggtctggagtgttcatagttcctgggaattgagttctgtatgatactaaaaatgtacaagtattacatattacactggggattttagcacctagtcttcctaaatttcttatgtattgataagattctggagtaggaatagatttaaacaagacataactcagtactgcgtgatttcaggaaaggtcagttagtacaaatgataagcacattttaaatactaaacagcaaggatcttttgccacgtgtccaaataggccaatggtaactgaagcagaggttgctagttagttccggtttgcagcctggtgacactgctgtccgtgctgctgtggacgctgtcagccttgctcagcaagccaacacaccggctgtgcacagacggacagcaaatcgatcctgtcgaatttcacttccaacacaatcgttgtctttcttcagtgacattttaaaaatgaatgtcattattaaaagcatcgtttaaataagtgtttttatctttctgttcttgctgtgtctggacagcggcctcccagccaacatccagctggacattgatggggaccgtgagacggagcgtatctactccctcttcaacttgtacatgagcaagctggagaagatgcagggtgagtctgcccggcacacagatctgtgcagcgaggggatggctggcgaggccccggcctcaggagcatgctgtggggtgaaaacctgtggtctgagcctctggtgtagtgtgggctacatgtagttgtctttgtagcacggatggatgcgaaaagctttttgcagggtaggcagctatctgggggacaattacctgtataataggttctatagataatttttagatggaatttaacttgtaacctctgtactgccaagtttctttagaggacctattttttcattcctttgttttccagagggataagtgcatgtgtgtggacacgtatgtgagtgtgcttgcatgtgtgcggacacacgtatgagatgtgtgcatatgtgtaggcatgtgtgagcgtgtgaatgtggacatgtgtgagcgtgtgtgaatgtgtggacatgacatgtatgagtgtggatgtgtgaatgtggacatgtgtgagcatgtgtgaatgtgtggacacgtgtgagtgcatgaatggacgtgtgtgagtgtgtgtgaatgtgtggacatgacatgtatgagagtgaatgtgtgggtacatgtgtgagcatgtgtgtgtggggacacgtgagcatgcatgaatttgtgcatgtgtggaaacatgagggcacgtgtgagtatgcatgtatgtctttgggcacatgtgtcagcatgcatatatgtgggtacacacatgccatctaattctgtaaagcaattcaatgtcacagataacgatactgcatatatatttgaaacagtgccaggcacaccgtgtgtttcaaatctatatgcagtatgtatcattatctgtgacattgaattgctttacagaattgaaatagcaatccagataagcccagttagaccacatggggacagtggtttgaggtctgtgattcaggagaggcagagacaagaaaagcccacgggggtgaagcagctgcgtttgtttctatgccagtgtctggtagaactcggatctgctcttggagatcatatgacagggcccttgagtcccactcagaatggaaatagagcggaatgtgcctggagttatgcctgttagattttcttcttttcattcccctgatttaacccagaagtgtcaagtgtgccttggcctggaaacacatgagtcctgcctgagtgtccatgcagctgcccatctgtgagcttggccacgcctgttctccagccccacacgccctgggtgtccgcgcagctgcccatctgtgagcttggccacgcctgttctccagccccgcatgccctgggtgtccgcacagctgcccatctgtgagcttggccacgcctgatctccagccccacatgccctgggtgtccgtgcagctgcccatctgtgagcttggccacgcctgttctccagccccacatgccctgggtgtccgcacagctgcccatctgtgagcttggccacgcctgatctccagccccacatgccctgggtgtccgtgcagctgcccatctgtgagcttggccacgcctgttctccagccccacatgccctgggtgtacgtgggttccaggcctacactaacacacaggcacatacacatgtatgcatagccatgtacacacatgttcccagcaatacatgtgtgaaatgaacatacaggtacatgtgtgtgcagacaggcaaggcaacaatacctgcacacatgtgcagttgaacacaacacgctcacatgtgcaggcccatgtgcaggcatgcacacacatgtgcagacaaccacacatgtacacactcatgggccaccacccaccacagcgtcttctcccccagcaagtgtgcgaggtgctgtccctgggtctgaggtccctggatactgtgaagatggcacaaggcctcagggtggccaagacagtgggtctggcatcagccagcctcttcccagccctctcatagcaggaaccgacacagcagaggccagagtcagggagcctcggagagggtgaggtcatcacacacaagacccaggttctgaaagatgctgaccaggccctccatgatcagcttgctccctgcaccactgtccaaccttgctcagctcctcctaggccgtgcgccccgcatcacggctccagctcttcctctgctgggaacacccttgcgcatcaggctggcagaccctgtttaccttggaagtgtcttcctccaggcgcttcccaacctcaccatccccatagcctggtgtattagttctcatgttgctataaagaaaagaagattgattgactcacagttctgcaggctgtacaggaagcatggttggggaggcctcaggaaactttcgatcatggtgggagggcaaagaggaaggaaggaggcacctcctacatgcaggagcaagagagagagatgggggtagatgccacacacgtccaaacaaccagacctcgtgagaactcactatcacgagaacagcaatggggaagtctgtccccatgatcccctctccttcctccaggcccctcctccaacactagggattacagtctgacctgagatttgggtggggacacaaatccaaaccacatcacctgggctcacctgtgtcaccaaagtcacaaccatctcccatctcctcagcttccatatgcagtgaccttcctgggcctggcacagaggaagtgcctagcacctggatgggtgtgctggacagatggcggggcaggcagctgagtgggtgggtagatgggtggatggacggttgggtgagagatgggtggatggaaggatgggtgagtgacgggtggatggatggatggatgggtagatgggtggatggacagatgggtgagtgatggatggatggacagggtgagtgatgagaggatggactggggtgagtgatgggtggatagatggatgagtgatgggtggatggaaggatgggtgagtgatggtggatggacggatgggtgagtgatgggtggatggaagcatgggtgagtgatggtggatggacagatgggtgagtgacgggtggatggacggatgggtgagagatgggtggatggaaggatgggtgagtgatggatggacggatgggtgagtgatgggtggatggacagatggtgagagatgggtggatggaaggatgggtgagtgatgggtggatgaacagatgggtgagtaatgggtggatggacggatgggtgagtgatgggtggatggacagatgggtgagagatgggtggatggatggatgggtagatgggtggatgaacagatgggtgagtgatgggtggaggacagggtgagtgatgagaggatggaccgagggttgagtgatgggtggatggacagatgggtgagtgatggtgatggacagatgggtgagtgatcggtggactgacagatgggtgagtgatggtgatggacagatgggtgagtgatgggtggactgacagatgggtgagtgatgggtggatgggccgatgggtgagtgatgggtgtacagacagggtgagtgatgggtgtacggacagggtgagtgatgggtggatggacagatgggcgagtgatgggtggatggacagatgggtgagtgatgggcagatggaccaatgggtgactgatgggtggatggagcaatggacgagtgatgggtggattaacagatggttgagtgatgggtggatgggcagatgggtgagtgttaggttcatggaccaaagggtgagtgatgggtggatggatggatgggtgggtcagtgatgggtggatggatggatgggtgagtaatgggtggatggacagatgggtgagtgatggatggatggacagggtgagtgatgagaggatggactggggtgagtgatgggtggatagacagatggatgagtgatgggtggatggaaggatgggtgagtgatggtggatggatggatgggtgagtgataggtggatggacagatgggtgagtgttaggttcatggaccaaagggtgagtgatgggtggatggatggatgggtgggtgagtgatgggtggatggatggatgggtgagtaatgggtggatggacggatgggtgagtgatgggtggatggacggatgggtgagtgatgggtggatggacagatggatgagtgttgagttcatggacaaaggggtgagtgatgggtggattgacagatgggtgagtgatgaatgggtggatggatggacaggtactgggtggatggacagatgggtgcgagcacgatggatggacagatgggtgagtgatggatggacagatgggtgagtgatnnnnnnnnnnnnnnnnnnnnnnnnnnnnnnnnnnnnnnnnnnnnnnnnnnnnnnnnatgggtgagtcatgggtggatggatggatgggtgagtgatgggtggagggatggatgggtgagtaatgggtagatggacaagatgggtggatggacggatgggtgagtgatggctgggtggacagattccttattgcgattttttttctagttattgccagttttattttttaatcaatattccagctgagaattttgcatctgatacatggtccatggactcattctgggtgagagtggcattctgatggccctacccgcttcagggtccttcttccctcgtcttgaagaatggcacatgttcacagctgaatagctctatggcctggcttgtagggcttaagacaccgcagcctgccttcatttcatcctgttttctctgtttcctggtttcttctggcagtgcctctgctggtgcggttccttctctgctcccggctgttgctgagatggttggtcaagtccaaggctcagccccacacttgtctccttatcagatagccacacagccacctgcttaatggtctcttccaaacatgctgtctcattttttttgagatatgggtaggctggaattttaattctcaaatcttttaactcaaccagcctttgagttctggttcctttttgctcaacaattccaccttcaaatcatctctctccccccattttgctgtcagcggtcaggaggaaccaagccgctcccacagcattttgcttagaaatctcctcaattacgtgtctgatgtcatcactcgcgagttccaccctcccagaacacgagggcatgaacacaggtccactttgtcacgaggatggctttttctccacggtccagtagcatggccgtcctttctgtctgagatgttgttagaacagccttgccacccatgctcatgccaccattctgttcagggttacttagatatcccctaagacaggacttctctgcagctctcctctcccgagcccccagcattgtcctttaaggacattcatggcagccatgccttttccgctctgcacccccaaaccccttcagccttcgcccagcacccagttccaaagccagtccacatttgaaggtacagcagcagccacttctcagtaccaagttcttggtgagtttgggctgccgtaaaaattgtaccataggctgggtggttacagacagcaggaattcacttcccagattgaaggcctgagaagcttgagatccgggcgtagcagtgctggtttaactgcgggtcctcttctgggctgcagcccgccagtgtctcattgtgtcctcacatgtggaagaggcaagccagcttccttggtgtcttctatagggatgcccatcccctgcacaagggttccaccctcacgccttgtcacctcccaaaggcctcatctcctgatgccatcccttgagagttaggatttcaacccacagatttgggggcacaaacattcattccatccagatggacacagctgcagggcgtcggtgctggctccgggagtgcgtgcccaggcgctgtgagcagtgaggcagagacgtgtacctggttcaggtgtttggactcaggtggcgcagggccctgccctggctcaagggttccatggctgtccgctaggggcgaggcaccagaatggccttcagcaggagtgatgtggtccgattaggaaggtggccccggtgcgtaggtggggtccggggcagtggtctttagaagctgcggcacagactggtgtccgccctgtgctcggccagccctgggctaggcctgtcctggctggacatgctcagtggcagctgggtgtgaaatgtgctgaaccccatcgtgctcactccctcagctgactcttcagggctgccccagggcccatgagccagcccagcgtccagctgcaggtgtctctcctcctggttctggctgggcgggctggtggggcgtgcagagatgtgcacatccccctgtgagaatggctgattggtgacaaggctgggagctgggggcagcagagccctcagaggtgaatgaggttgctcagcatccagctcccaatgggctttccctgggctcagtgtgggcacaactcgcctacctgcgggaatggtttctatctccgtctgcgtttacgagtggtggtcagccctttctggaggagcttgcgttggaaggatgtgtaccgtgggtggggcctgcagcgacgcagctgtgtggagacggggccggtggcctgggctcctgccctgcgctgacccctccgccctccacagaggcctgtgggagcaaatctgtgtatgacggcccggagcaggaggagtattcgacgttcgtcattgacgacccccaggagacctacaagacgctaaagcaagtcatcgctggggttggggctttggagcaggagcacgcccagtataagagggacaagttcaagaagacgaaatatggaagccagtgagtgccactcccgtgcctgccctggacggccagtgtagtgggcgggagattgcagtgggggtggggctgcagggagctcccgggtggggccgcccgtgctcaggtgtccgcctgggaggagagtcccacttgcaccgggctggcacctggcggtagtcagtggacgtggcccggcgctgctggtccctccttcagagcaggtgctgcctttgctctccaggcccccagccagcgtccgggctgcctccctgacctgcttcctcccagcctctctgctatactggtgtcacgtgctctggcagtctctaggcccaggtcttgttctgccttggttcagtggcacaccctctggcatctctccaggccacccatggtgcccgggagcagggccagctctggacgaaacccactcttgtctcatgaggcaggtgtggcgaggttgagtacgttcagcttagtcaccagctgcaggctaggtggcgcttagctaagctccactccccctcactccatggaacagagggttgtaagaccctcatgagttgctggaagattgacttaaactatgtaaagtgctaggctggctcttagcctggagtgagcagatgtgtctgtgtcactctctccatccagtgggtacccaggtccaccatggcagaagcccccacacgggctcattcaggggcgggtaagccctagagccctgtgtagctgtacagcctcctcctcacttccatcctcctgctcactcctctctttggtcctccctcccttcgatcctccctctctcctcctccacccttcttctccctccttcccttccttccttcttaacccctccttccttccaccatgcgggtctggtctgggaagggcagtggtgaggctccaggagagtgacaggtccctgtggcccggacttggaccgagttgctcaggggactgagcctgcaacacctcctgagtgctgtgacttcacctctgacatcatcatatcagatccctctcgatacccttctggggagacagccccatttgccttccaaatatgttgcctcgttgatatcagcaggtccatcaacctcatggccaaaagccagcaggttgaaaatgcgcgaagcatgatgctgtttgttgtagtagaaggcgcacacgaggcacacatggtacaagatgcacacacatggcaggaggtgcacacacatgggtggaggtgcacacacatggcaggaggtgcacacacggaggaggtgaacacgtgggaggaggtggtgcacacgtgggaggaggcacatacacggaggaggcgcacacacatggcaggaggtgcacacatgtgggagaaggcacagacggaggaggtgcacatacatggcagaaggtgcacacgtgggaggaggtgcgcacatgtgggagaaggcacacatggaggaggcgcacacacagcaggaggtgcacacacatgggaggaggtggtgcacacacgtgggaggaggtgcacacacgtgggaggaggtgtgcacacacgtggcaggaggtacacacagaggaggtgcacacatgcgagaggggtgcacacacgtgggaggaggtggtgcacacacatgggaggaggtgcacacacaggaggcacacaggtgcacacacaggtgcacacgtgggaggtgtacacacggaggggtgcacacacatgggaggaggtacacgtggaaggaggtgcacacacgtgggaggagatgcacacatggaggtggtaggcacgtaggaggaggtgcacacacatggaggtagtggacacacatggcaggaggtgcacacacatggtatgagggaggtgtgcatgtggggaggaggtgcccacgcctgctgagtgtcccagcactgggacagatctgtgtccctggagctcatgctccccacacatgagcacactctttgcagtgcagatgtgcacattctgcacacgtgccatacactctacatattccacatctgcacatgtatatgcgctacacacgtgccacagggagagcacacgtgcacatgtacttgcacgcctgacccacctgtgcacacacatcagagtcaccgtgggtgcttccgggggcactgtggttcctttggctcctctattttttgtgtggattgcagtgtgagtgtgtcacatttaggaacaggaaaagctcccgcagccacgggtgagcaccaggcaacggggtctgtgcctcattccctctcccatcccccttttcagggagcaccccatcggagacaagagcttccagaactacatccggcagcagtccgagacctccactcattccatttaaagtctgcgggacgcgcccagtggcgccagcaagctgcccatgcaaagccgcagcctttgggagggagaagagaaggaagagcgcagagccggcaaagtgagatgcacgccgtcccggcccatagacaagtggcgctggggtttccctctcccagaaccgctgccaccaccgccacgccctccgcagaaagcccacctggccctgtggaacgtgtcgtcatttgattctgtgctttttgctccttgtttgtggggatctggggatcagctgaaggatcaggaagtgtgggctgtgccctagccacaccacagccagcctcagggagccacggcccgtctagtcgactgtgacatgcacctccggccgtgtgtgcatcagtctcgtgcacgtctgtcttgcgtgcacggtgcgtgtgacgctgggctctgtggctctgtgcccgggaggcctgctggccccgcctcggctttcggcttcatcacattgggaggttcagagcattactctcccactgtgcctgccatccaggcagccatgggaggcggcctccctgttccactttcgaggttcgtttgattcctggctgaggggtcagttttatggctgggaggtgcagaactacacagaagtcccagtctgaggatgtccttggtgcttgggggatacgggttctgtccacagagtcccttggagggaaaggtgtgggctccagcttctccaggcgtctgcggagcccacagttgaagcccacatcgttttgctgttgaatggggtttaaaatcagaattaacatttgccaccccccgtggaagtttgaagattttaaaaatagaaatgtacatttttcaagctgtttttctttatgtttttgaaggaccatttttaattagctctttgatacaaagtaactcagaacgtcaaaacctatacccactaaagggaaggctgccgggaaggcaaatggaacaggaatggagcctgtctcaggaaggccagctgcaggtcctccagaaaatcaaagaagggaagaaactctgagtttgaggtacaggggcttcggggtgcagacgtccctccagggcccatggtcagtattgcacctgtgttatgaacccccagatgctgtgcagggcaggggcgggggctgctgttttattggggaggggagcatcctaaaaatggggtccaggcagacccctccagacctcacactgccgaggaggcctttcccaaagggcgtcctcccgggatgcagacggcaggtgtgtgggaagcgccgtttaaatacacagcacgacgtatccttgtaccgacttctcccggttcttgtttgaaaatactgtagttcaggctcttgatctagatggcagataggaactttcttgtcacaaaaatactggaggaaaatgttgtaaaaatagacttttggacacacagctgttggggctgcactgagctgcaatttttaacatggatttataacttaatgtttctgtttataaaatactaatgatttgcaatgtattttactggccaattaaaacagatgttttattctttctgaggactggcttggttttccagtggtacccactgggaattgcacatgtgggcattaggggtggggggtacagggaggagggtggcacctggggagcaggatgacattgctgatgccaagtgacgtccctggtgatgggtgatgctgctctgacaggtggcactgccctgatgacaggtcacattgctgatgccaagtgacatctctggtgacaggcagcgctgctctgacaggtgacaggtgacatcgctggtgacagttgacgcctcatgacgggcagcgctgctctgacaggtggcaccgccctgatgacaggtgacatcactggtgacagttgacatctttggtgatgggcagcgctgctctgacagtggcattcacctgtggtgcctcaggtgagagtccggccctgtgataacctcaggaaaggtgtgtccactcaaggagtgctgggcagacagaccaccacgtgctgccatctccaggaatgcagagggggaggccacttggaggccctgggagaagagaacggactgtgcctctaggcaggtggctgctgtccctccaggcaggagagggttaaggggggctctgggtgaagactccatgatacgttgcctcatttctttattcctttccttgctccatttgaattcctcttttttggtaattctattgtgagtcagctctggtatgagaaaaatgaggaggtgtggctttggggacaccaacccaggcctttctcccagggaagggtgaggcttggttcagcctggccggcctccttagtccatgctgaggtgtggggtctgccccagtccaggagtggctatgggtggtggacaaacccttgcaggtgggggcatcctccccgggaggccagcccgtcctcctggagccacacttcccggcagggcctcaggcagtgtcgggagccagggggctccgttcacactctgggcacagctgtgctggggtcagcccaggagggccaaggtcagcccctccaagaggaagtagaagggcaaggaggacgaggccccagggaacgtggagaatggaagccccttctggaacagccaggagagtcctacagggcagtgggaggtgggagtgtatgggggccggaagcccctgcgcgtctccactgatatggtttggctgtgtccccacccaaacctcatcttcagttgcagctcccataattcccatgtgtggtgggtgggacccagtgggaggtgattgaatctgtgtggtgggaggtgattgaatctatgtggtgggaggtgattgaatctgtgttgtgggcgggacccggtgggaggtgattgaatctgtgtggtgggcgggacccggtgggaggtgattgaatctgtgtggtgggaggtgattgaatctgtgtggtgggaggtgattgaatctgtgtggtgggaggtgattgaatctgtgttgtgggcgggacccggtgggaggtgattgaatctgtgtggtgggcgggacccggtgggaggtgattgaatctgtgtggtgggcgggacccggtgggaggtgattgaatctgtgtggtgggcgggacccagtgggaggtgattgaatctgtgtggtgggcgggacccggtgggaggtgattgaatctgtgtggtgggtgggacttggtgggaggtgattgaatcatggggcggttcccccatactgttctcgtggtataagtcccacgagatccgatgtgaaagttttatgagggtttctccttttgcttggtctcattctctcctgctgctgccatgtaagacgtgcctttcaccttccaccatgatcgcagggcctccccagccatgtggaactgaatccattcaacctcttctttataaattacccagtctcaggtatgtctttatcagcagcatggaaactgtctaatacacccaccaagagactgcaggtggctttgtggagaccccagtgacgcccatttgcccttgttgctccagacgacccagcacttgttggagagagacagcggcctcctctcccatcctggcagcatccgcggggctcccgacatcagagtgtccaaagcaggtgcctctgaggaaccgtcccaggaggccaggcagtgccagagcgtgtgtgaggccaaggcccccaccctgcacccaccacttgcccagagagctgaggcctcctgggtgctgagaggctgtgggctcttcaaaagaagagatcagaaggaggggagcctgcagcctgggggtcacacctgcttccccctggctgaggagccccgggtgcgggaagcgggtcctgggggcgggggggtgcgccggctcgcgaggtgcctgtcaaggggcagaaggggctgcccaaataagccacactgttgtaagggttgttttgagctgaaacagccatccacaaggataagaacgctgctttcttctggctctggagagcgtcttccccgtggggtgttacctcctctttcgggaaggaaaggccattcccggccacacagaccgtgctggagtgcgtgtgcctttctccagctcatctgctgattttaattatcaggcccgaccaaaaaaccccaagaggtaaaatgttgcctccccacccaccgtggtctggaggctggaggagacagcgtgccggggattttctgttcggctcagtacaggctgaactctgtcccggcaaatcctcatgctggagctgtgaccccgtgaccctcaggacctcagggtgtggctgcacttgggcgtggagctgtagagattgtcaaggtaaagcgaggccctgacccagtgtgaccagcgtcctcatgagaaggggagacgaggacgcagcacacaggaccaccacgtgaggacacggaatacgtcatcttcgcgccaaggagagaggcctcgggtaaccagcgctgcgagacaccttgcccccagcaccggagggaatgagctcccgctgtttaagccgcctgcctgggagtgccagcaaacccacgctgacctgtgcagttcacaccgtcggcccggaaagccctcgccggagccccggccacagcagggtttcgtcctggcgccgtgtgggtggggagaggcgctgggccggcagcatttgcaccccaccactgcctgcaggggctgcctttgtcttcctgagttgatctgtgtcccatttgccctgatagggagagaaagattcaaataccctgtcacagagggagaccggcgtctcatctgcaggccctgctagggctggtgccagttccccgccctccctggtggagagaccagagatgtgaaaacgcagaacccgccccagccccggcctgcgggaaagaagaagggaagacgcagaacccgccccagccccggcctgcgggaaagaagaagggaagacgcagaacccgccccagccccggcctgcgggaaagaagaagggaagacgcagaacccgccccagccccggcctgcgggaaagaagaagggaagacgcagaacccgccccagccccggcctgcgggaaagaagaagggaagacgcagaacccgccccagccccggcctgcgggaaagaagaagggaagacgcagaacccgccccagccccggcctgcgggaaagaagaagggaagacgcagaacccgccccaaccccggcctgcgggaaagaagaagggaagacgcagaacccgccccagccccggcctgcaggaaagaagaagggaagacgcagaacccgccccagccccggcctgcaggaaagccacgctgtgctgccagggatcggctgatctttggcctctgaccttacagtgatgtcacagcagacccatggcaacgcactcccagcacctcctgactactccctgcgggacggctgggtgtgagggtggcagccttgtgctcaagccgaggctgggctggaggatggagaaggacacggggaccacacacaggaggcaccggcccggcctcagggccctgccctcaggagtggcccttgggcacctcaaggcggccagtgaggcctctgaacttcagcgaagcaggagtctgggaggcctgcagcccgagggggaccctcccagccgccctaggaagcctcacaaggagctgggtaggggctgtggggccgcggggagcgggtggacggcgcggctgtcccaccaggcactgaacccaaagtacctgcgtcagagcccagcccagttagaaagttctaggaagttcccaaggttagggatgcgccgagacagccccaggaggtccaacgacgtgtgtccaaggcggggcacggcctgacgtcatacattgcaggggggcgtggggcatcaatcagcacctgtgagggggtacgtcggttctgtccggaaagggacagcctgaagcaggaggggcttccaggtcgtaggtagaggagacacagggctgcattctttgggtctcgatcagcctttcactgaacacacaatttacacgtgaggggactagagggagagtcacttgtatcctcgtccggctccgtgactgcggtttttcatgagcagcccagagggagctgtcggacacacttgtctcaggtgagcagagggaggaccgtgatctctgtccctgtcctgcgcctgttgacggtcagctgtccatgtgcattcccagcgtgaaactccacaaaactgcttagggcagagatcttaaggctcacaaggaatttcctcgtgggtgaatgatgagggaggcctgtggccgtttatctctgcagctcttgtttaggaagaggatgggaggcaggtttgtctgacacattcccagccttactcctccccttagctcagtgattcagggcccaagattcattttccttccaccggcagcagggaccgggccgggcctcctgcctcccgctgccctgtgctcggaacgctaagggcggaagtggggagcactccaggtccacacccgtaacccacccagggctgctgggaaggccttgcgctgctggggcggagctgtgggggctccagccgggcacagccaagggcgggaggggtgagaggagggcaggcctgggaccctcatgggcctccgaagccagccgatgcctgaagggaggatcatagccaggcgccccgtttgcaagaaggccctggtgagggcctgggtccctgccaggagctctgggcctcacccaccagcaaggaacctgcgtagctggtgtttgacacggttggcttctaaaccgcgaaacgtgtaggctgcccctgtgtcggtccacactcgccactctgagatgtttccaggtgtgccgaacggacggtggtatgggcctggggttggtgctgcagtcacctcctcacaccttgaatactggcccagagcacagggctgaggggctgacacggagctgcgagctggcgctcccctcccctcccgcggcctcggcagctccgcctccccttcgcaaaggtgtccacggggccgtggaagtgagacagcccggtaggacttggggtttgcttgctcaagccctggggacaattttaagaggtaatgatgtaaaaatatgtgttcttctctgagtttaaaaatccaaatatgtgctatttggggggcgtgagtagttaggaggctgcaccctacctccctccccacggggttccctcaagacgtgcaaagttctcaaaagaataagttacgccaaggctgcttagcgggaatttaagttggggcggggagcggatctccaataatgccgcccgatgccaccacagtgcggacttagaggccggggtcggatggagggagggattgagccccattgtggctgacatttccctcaacacctgctggatttgcccaaaactgcacgatgggaggtgccgcagcagggaggccgggcttctgtgtggccgcttgtcctgtctggcaaagatgtccaccctgcacagcctcccccaggcaccagcaccctcagggttcgagaccacggcccaggagcgcatcctccctggagctttgtggctgcccccagacaactgagattctgccggagaagagcaggaggcatttccagccctgtgacccgaggagaagggccaggccttgctgaccactggtagagtccgacgtggccttggtttctgcagggactcagctcctcacccctcgcagacttggtgggctccatgacatgcccagtgccacgtgcacccacaggtgcccggatgtgtgagacgccgcgtccacttcacagggaggcctccgggatgcgggagacgtggggtggccgacttcacgggggcaccagtggggtgtgtctgggcctgggccatgcggagcacaggagaccagcgctcacggagggcagcccagagaggccggcaagagcacagtgagaatctgctgggttccagacccactgaggccctgccttgagcccacatgcaccctggacgcctgttgattctgcaaaggctctgcgctccacctctgggccccactcgtggcttctctgttgggggcagcccctcgtggtcggccattggtctcatttccctggaagagccccattccccagctgccccttgggcctgtgggctgagctgagtgacctgcctggagtggcccatgtgactctgccgagctctgggaggaggtctggtctcttccatcacaagcatcatttaaagctttggaatcatccctgttgtatttgaatcccgggccaagggggcgttgtgggaagagggagtagctgcgggaagccagggtctccgcaaacattcccggctccgatgcggctggaggccctgtgggatctggaatccgctcactccaaggctctcctgagcacctagggcttggagaatcctctgccacatgacttcctcacaaggctgtgctggtttgcaagctcctgggaacggagaactcagtgtttaactagaatggaatgtttcacgttggccaagtcagtcaacacctttagccaagtgtgccagggagcagtgtgtgctcggtgcaagccggtggccaacagccaggcttgggttcctgccgggagcaccagagcaccgctcacccgagttgatgttcctgggcccctgtcctctgtcacatcaaggtaaagatcctcacgagacataaagtggtcccgaaaaaagactgctagaaacatcccgcaatgcctctcggggagcccagagaccctggggattggtggattttcctggacaagccaagtggggtttcaagtcccacctgtccgtgagaggaagcctgggtggggggtagtagccggcatgggcaggtcttgtgggcttctcccaccctcccgctcagctacctccagccagctgtgctaggacaaagaggagtttcaagaggtcccggagcctcatgtgtttactgtaaggcggctggccatgcctcaccctgagtcctgcagggagaaggtggagcccaggtgtgggctgagctgctggggctgagccaggctcaaggccctggcaccaggctgtggaaagtgccgatagcaaataccggagggccgggcatgggcacaggtcggggagaaactcaagttagctgtagccatggctgagagttgagctctgctgtgggtggctgtgggcggcttggggcaggtcctgagctccggtagctgcggtgtaatggtgctgacggctctgtccttcctccccagagtccgaagatcaagggaaagacccaagcagtaacgcggaagatgccagctggtaagcagcctgtccgacgctggcctttgtgaaggtggagctgggaaaagtgaggtggacacaggagagggtggggtgtgggagtggtacccgggcatcaaggtagacacttagaaggggacagagggagccctgggtcctgcgaagaccccgcgcagggcctggatgggagggctgggaaatcctccttattttgagaggaattcagcgtgggaacaggacccacctgtagcggggtggtgtcctcaggactcgggccctggcctgagggtcacacagctgcatccctctcagtagacaccccatggccctctggggaaggaggcgtcgtctcactagtggactgctgggcccaccttagatgtaaacaactcgagtgctcctttagggagagggcgtggggccctggacagcacatccccacttcgtactgccgagttcttgcctccctgcacctcgcgtcccgttctaacccagctctggttctcccacccactcaccctcctgccatcaaagaagacttaaaagtcattgaattcctcaaaaatttgtctcagatctaacaaagtcgatttaccagcaccatggcaaggcacgggccaagtcccccttatttacaaatggctcccgttgagtggagaccaaggaaggtgtccggccgccgaagcggccaaaggtgcaatcagttggtgagagtgagtgttcgtgtgttagacagcatgtgtgcggcgcctggagcctcccactccgtagagctcagggaagctgatggccttggtgagggcagttgagctgggaagaccacacacctttagggtggcaaagctgaaagcgtctgctcacgttggccaagtcagtcaataccctcggccaagtcaacgccattgcagatggtggcggagcccctgtcatcctcactgcctgttgcattcctcttgcccctggccacacaccatagcagaccacagaaggggtcacgaggttggtgcgagtaacagcagggccaaccgtggaccctccagcctactggccagcatggcccatttggtatccacatggagtgtggatctgcgacagggtggctgcatcttctcatcagattttggttctttgagcaaggttagaccctgctttccaaaataagcccaggttggctgtaatcccagtccagaccctggctgtacagggtaagttttccaggcaagatgggccagcagagggagccaggagggccaggctgtggggcccttcagagccagaactctgtgctgggtcagggcacctcataggtgcccaccagaccccaggggcaccagcctcaagcccaaggagacagacccggaggagaccaggagctgcccgcagctatctgccgtctcttccaaaccactttccctgctcctcccgcagtcagaaaaacctagcacaagacaagaaggaaagcttcagcacccttgggaagctgggtcatgagagtggaaaacaagacccagagagggagaagagcgacttggaggccagcatgcaggaggtgcaggaaggcgagcacgcagacggaggcttgcaggaggccaaggttgggccacgctgaggagcggtgcattttttcctcttgccttggagcccggccttcacttaacctctttggtcttacaggaacaggaggcagagtccataaagctaaatgaccttcaggaagaagaggcaagagcttttccctttagtaatagaagtgagaagggaggcctgtccaggcgggagttctgccggagcctggacctgcccgggacggtggcctgggggtcagctcagcaggcgccaggctgtgaagctggactgactgggcccctgctaccctagagaggcttggggccaagctctgagactctttacccgatcccagggcagcctgacccctgcttgccaaacgtgcagtcactaaaggtgtatgaggccctgagaggaggtgccctcagcttgaccttggcccagaaaacacccagagccccaggcttgatgtgttgtccagggacacgtcatgctgtgggggttctcacgtggcaccgtgtgaaggaaagtggcttttgttctccctccaagctgtgtggtggggacggtaacacaaccagacacgctgcttgccaggcgggccttgctttcattccagggctcttgggaagtccttcacccacccccagacactgcccttggagttgactcaaatgctcccatcagacacacgttctgggct

SEQ ID NO: 1367 - DNA, 3974 bp, Homo sapiens
ctggcggtcttgcaggcgggcggaccctcggccgcgctcggggctccggcgccgccgctcctcctgctcggcctgagctgcccgggctcggcgcgcgcttggggcgaggctcggcgggcgcggacgcgcagcatggcggtggaggacgaggggctccgggtcttccagagcgtgaagatcaagatcggtgaagccaaaaaccttccctcttacccggggccgagcaagatgagggattgctactgcacggtgaacctggaccaggaggaggttttcaggaccaaaattgtggaaaagtcactctgcccgttttacggagaagacttttactgtgaaattcctcggagctttcgtcacctgtccttctacattttcgatagagacgttttccggagggattccatcatagggaaggtggccatccagaaggaggacttgcagaagtaccacaacagggacacctggttccagctgcagcacgtggacgctgactcggaagtgcagggcaaagtgcacctggagctgcggctgagcgaggtcatcacagacactggggtcgtctgccacaagctcgccacacgcatcgtcgagtgccagggcctccccatcgtgaatgggcaatgtgacccctacgccaccgtgacgctggcaggacccttcaggcaaaagcaaagaagacgaaagtgaagaggaagaccaacaatccccagttcgatgaagtgttttattttgaggtgacccggccctgtagctacagcaagaagtcccactttgactttgaggaggaagacgtggacaagctcgaaatcagagttgacctctggaatgccagtaacctgaagtttggagatgaattcctgggagaactaaggatcccgttgaaagtcctgcggcagtccagctcctacgaggcgtggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccaggaccccaacaccatcttccgaggaaactcactggcgtccaagtgcatcgacgagaccatgaagctggcggggatgcattacctgcatgtcaccctgaagcccgccatcgaggagatatgccagagccacaaaccctgtgaaatcgaccctgtgaagttgaaagacggagaaaaccttgaaaacaacatggagaacctacggcagtatgtggaccgcgtcttccacgccatcactgagtctggggtgagctgcccgaccgtcatgtgtgacatcttcttctccctccgggaggcggcggccaagcgcttccaggatgacccggacgtcaggtacactgcagtgagcagcttcatcttcctgaggttctttgcgcccgccattctctcccccaacatcttccagctcacgccgcaccacacggttcatgatcaagagggcccaaggacggaagcgctttgggatgaagaattttaagaagagatggtttcgcttgaccaaccatgaatttacctaccacaaaagcaaaggggaccagcctctctacagcattcccatcgagaacatcctggcagtggagaagctggaggaggagtctttcaaaatgaaaaacatgttccaggtcatccagccagagcgtgcgctgtacatccaggccaacaactgcgtggaggccaaggactggatcgacattctcaccaaagtgagccagtgcaaccagaagcgcctcaccgtctaccacccgtccgcctacctgagcggccactggctgtgctgtagggcgccatccgactcggctccgggctgctcgccctgcactggcggcctcccagccaacatccagctggacattgatggggaccgtgagacggagcgtatctactccctcttcaacttgtacatgagcaagctggagaagatgcaggaggcctgtgggagcaaatctgtgtatgacggcccggagcaggaggagtattcgacgttcgtcattgacgacccccaggagacctacaagacgctaaagcaagtcatcgctggggttggggctttggagcaggagcacgcccagtataagagggacaagttcaagaagacgaaatatggaagccaggagcaccccatcggagacaagagcttccagaactacatccggcagcagtccgagacctccactcattccatttaaagtctgcgggacgcgcccagtggcgccagcaagctgcccatgcaaagccgcagcctttgggagggagaagagaaggaagagcgcagagccggcaaagtgagatgcacgccgtcccggcccatagacaagtggcgctggggtttccctctcccagaaccgctgccaccaccgccacgccctccgcagaaagcccacctggccctgtggaacgtgtcgtcatttgattctgtgctttttgctccttgtttgtggggatctggggatcagctgaaggatcaggaagtgtgggctgtgccctagccacaccacagccagcctcagggagccacggcccgtctagtcgactgtgacatgcacctccggccgtgtgtgcatcagtctcgtgcacgtctgtcttgcgtgcacggtgcgtgtgacgctgggctctgtggctctgtgcccgggaggcctgctggccccgcctcggctttcggcttcatcacattgggaggttcagagcattactctcccactgtgcctgccatccaggcagccatgggaggcggcctccctgttccactttcgaggttcgtttgattcctggctgaggggtcagttttatggctgggaggtgcagaactacacagaagtcccagtctgaggatgtccttggtgcttgggggatacgggttctgtccacagagtcccttggagggaaaggtgtgggctccagcttctccaggcgtctgcggagcccacagttgaagcccacatcgttttgctgttgaatggggtttaaaatcagaattaacatttgccaccccccgtggaagtttgaagattttaaaaatagaaatgtacatttttcaagctgtttttctttatgtttttgaaggaccatttttaattagctctttgatacaaagtaactcagaacgtcaaaacctatacccactaaagggaaggctgccgggaaggcaaatggaacaggaatggagcctgtctcaggaaggccagctgcaggtcctccagaaaatcaaagaagggaagaaactctgagtttgaggtacaggggcttcggggtgcagacgtccctccagggcccatggtcagtattgcacctgtgttatgaacccccagatgctgtgcagggcaggggcgggggctgctgttttattggggaggggagcatcctaaaaatggggtccaggcagacccctccagacctcacactgccgaggaggcctttcccaaagggcgtcctcccgggatgcagacggcaggtgtgtgggaagcgccgtttaaatacacagcacgacgtatccttgtaccgacttctcccggttcttgtttgaaaatactgtagttcaggctcttgatctagatggcagataggaactttcttgtcacaaaaatactggaggaaaatgttgtaaaaatagacttttggacacacagctgttggggctgcactgagctgcaatttttaacatggatttataacttaatgtttctgtttataaaatactaatgatttgcaatgtattttactggccaattaaaacagatgttttattctttctgaggac

SEQ ID NO: 1368 - protein, 253 aa, Homo sapiens
FMIKRAQGRKRFGMKNFKKRWFRLTNHEFTYHKSKGDQPLYSIPIENILAVEKLEEESFKMKNMFQVIQPERALYIQANNCVEAKDWIDILTKVSQCNQKRLTVYHPSAYLSGHWLCCRAPSDSAPGCSPCTGGLPANIQLDIDGDRETERIYSLFNLYMSKLEKMQEACGSKSVYDGPEQEEYSTFVIDDPQETYKTLKQVIAGVGALEQEHAQYKRDKFKKTKYGSQEHPIGDKSFQNYIRQQSETSTHSI

SEQ ID NO: 1369 - DNA, 105305 bp, Mus musculus
  misc_feature (1)...(105305): n = A,T,C or G
cagggatccactcctacaaagtaagattgcacacatgttgcagcatacccagggaaaagaccattttctaggcctgttcataaaatcatatcagaatcgatgaatgtgtcagttttcctagcacgttgtattcttacttgccttttagctggaagcagtaagtacagcataactcagctgaatgagaggttcccgtaggtcaagtttggctggtacttgagagcatgacaggatgtaaggggaaattacagcagaaaaaaaaaaggaagaaagaactagttagggagtgcctgctcgtgtacttagattggtttaggcaatagctagagggaaagctattccaaagctctgcctgtccacggtagcttggtaatgtcctgggtcacccttgtcggagcttttctgcaatacttccccaagctctcttgctcacatttccccagctctcccaagcttttcctttctaaagacaggggtctcatgtagcccaggctggccctggactaactgtagctcagatgaccttgatctgatcctcctgcctccacctctccagtgccaggataccaggataccaggagacctggtttccactcctacaaatcttcgtgtcgtgtgctgcaggcacagaaagtactttggatttcaggtccccgctctctgttctctcggtgctttcttcctttcatgtagaaagaatgtaaggagacagagcgtttgtgccttccccaattgcttcctcgggcccttctttaacatcttccacccactctgagtcccacccacaaagtcatgtcatgactctgtcatcaaagactggagactctaaagaaaaatcaaaagtgctctggctgcctcttccttcctgtgcatatctgagagtcatgggtgagtgtcctgtgtgaggcagaggctggggaaccttggtggtcacacaaaccttaatgaaatgagcacgccacagggctcttactttcccgtctttctagaaggtcacttgattagccaagacacaagaagaggagattcacagcaaacctagaaacctatggcctcagctatcttttaacagcagccagccatgatatttaaacacagctgtgtttttctttttcactgggtgctggagaggcagctccgtggtttagagcacacacttctcttgctcaggaccccgacccacatttggttccgagcacccagaggaggtaacaatgcctttgaccctttcaacccacaaacagagacagacaaatagacaggcacacacacactcacacacaaacacaaacacacagatgtgcatacacagatacacacacacaaaataaaaagtacaaatgtaattttttttaaagaaacataggttggttccataacttagctaccataaacagagcctcagtaaacactgataggctaattagtacctatgtgatgggttgacatggaatctttttggtaaatattcaggagtggtatagctacagtagttttgttttgttttgttttgttttgttttgttttgttttgttgaggaacctcgatactgatttccatactgggtgaactactttacactgccaccagcatgatataaaacaacccccatttttctcatctgctccctcttctgtgggatgtaccaggggctcactgctccccatcaccactgttaaatcctcttacacctagaagccttggacccttgctctgagacccaccagtaatcttcctctcttcgtcaatcaggatgtgctcacacaccctcagccttgtggctttgcagatttggttgctcatttctctgctcaaattctcgtcttttcaaggaaaccggtaacaacatagagttctgagagtactcaggaggatcggtctcagtggaagactttgtctttctccatggaggtcctggggtctctctcaaggctacggaaatgtctcccatcctctgactaatagagacagagaagagccctagggtcttatcgccacatattgtttgatctgtgtgagccctggacttctcatatattactgagatgtttaaaacaggctttgagcatagttacctgcattttcacatttgcagtgggcttttgcaacatctttttcagcagctctttctcctataatagaaggtgggtcaatcaatattcactaaccctgcctcgcgagacagtgcctcgaagcagcagtaagaacatgaagataaaaacagacaaaggaaaggcagagaggtcaaggtcctaccacagtggctaatggttacgatcattgtttctaggaggatccaggttcggttcccaccatccatcttgagcagcttacagctgcagcagatctgacattcagtcttcttgcttacccagtacacctccacacacatgatagaaacatagaataattttctttcaagatagaggtccaattcaaatagagactttgctgtttttctaagggataacagaatattggtaggttctgggactccgtttctctcttgtctccacaaggatacttgatctcctcatagcatctgaacacacacaaaaaaagggtttgctgcctttcccaggcacacgcacacacacactcaaacacacacacacacacacacacacacacacacacacacacacacacacactgctgtggtgccaggaatctagcacagggccctaggctaaacaagtgttttgaccactgagctatagtctgaaaactccctcccccacttttttaggggagcatgttcttgctgaattacccatggcagccttgaacccaccacccaccatgttgcaatccaggagggttttgaactcccggctctcctatttcagcctctcaggtggctaggatatcagtcatatgtcaccagcctgccttcacaccaagccatatgggtgtagatgtgtgcatatgtgtctacatgttctgtgtatatccatgtatgggagcatgcatgcagatatgtatgcatgggaggccagaggagaggctgatgccaggtatctcttcctaccactcaccttatgtactgaagcaaggagtgtgtgtgtgtgtgtatgatggatggagctgggaaaggcagcaagtccttttttataaagtgttcagatgctataaatagaacaaggattctcatggagataagagggaaaaggagtctcagagcttgccattttggctagtttagccagcctgcttgctccggggatcccctgtcttcagctcccacatgcttggattacaggaagacggcacgtctggcatttacatgggcaccgagatcctcagtgttttgtctttcacattttcctcatgctggcatggcaaatgctttacccacctaggcacctccccactggtctcctgatgagacaaacgacaacgtgaaacccctctaagcctttaggactgggcgtgtatgcctgcctgttgcagtatcatgaattactgccaaataaatgataatttcagatcctgagccctggctcctccatactgtaatgccacttccaagagaaaattataatttgggtatgtgcacagggtggtgacaagggaggctctaaggtgggcaccaaagctcaacattagtatgttcctgaaacatactctagaaagagtgggctttgctcagctgcttaagtggcagcctatgaacaacagccctttaataaaccataggatagaatataaaactacaggccaaatggctcatttgcaaaaaagaaatatagcttggagcagtcctcatctttgtcattttgtttaaatcattcagagcaaacaaaactgccatctggagatcccatgatgagtatggtcactctgaaacacaggagctcagtcctcttccgatcagctatgcgacctctcagtgtgcatgtggcatgcattcatccatccatgtaaatgggtgtggcaccgggggacgatgggaaacacctataaccttggcactccggaggcaacaggaggaagatcaagaattcaaatctagggctggtgagatggctcagtgggtaagagcacccgactgctcttccgaaggtctgaagttcaaatcccagcaaccacatggtggctcacaaccatctgtaacaagatctgacaccctcttctggagtgtctgaagacagctacagtgtacttacatataataaataaataaatcttaaaaaaaaaaaaaagaattcaaatctagcctccgggactacacagtgagcttttgcctcacaagtaaaaataaagggctggagagatggctcagtggttaagaacacttgttgctcttgtagaggatacccagcgcccacatggtggttcctaatcagacccaggaaatctgactgacctctgtgatctgtgggcactgcatgcaaagcatgcatgtggagtttatatatatatatatgtgtgtgtgtatgtatatatatgcatatatatgtatgcaaaaaacacacacatataaaataatgtttaaatgaaaaatgtacatggccagagacaaaaaaaaactaaaacacatataacgtggtaaatgtttctcctctgctccgttaccagaactccccagctcccactgtctctctctcccaaggggacccctatgttgtatctctccaatttctgaatgtatacgtggatatacataaatatgtacatgctaagaacagatctttagttgaggggaagggaaatcactttcatttaaaagggggcgagtttaaattcctcagattctttgagcttttggagagaccatccctccaggcgtggagaaaaacacctagaaacgttgaaggctgaggatgactttgaactcctgacctctgcctccacctctcctgtgcggagaatataggtgtcctccaccgtgcccggcttatgcaatactagggattgaacccgagactcagtacacgttacgtgagcactctaggtccacccctagcctccttactcatcttccagggcttcactcttcgagcttctcctgggcacccatcgtttaatcagcaccgtgctttctttctcgtgacacataaatattcacatatttctgacaagtatttctgacggcacatggcaaatactgttctagatttatttctatcgtattgtcaccgaaaaacctgtcattcccagctcttgggaagcagaggcagaaggtcagaagttcaagggcatccttttttatctctctctgctggaatccccttccggggtgcttggaatccacccaaagcctagcatacgcgtgcgagaccggcaagcactctaccaccgatcgcgatccccagtccagacacagaggattatagtaaactgtatgtcccataaagctcatctccgcagacgtgtgaaccgatggctgcttttaatatagtcgcaggcatatgcgactctgatgttagaatatttccatcgcttcaaaaagaaacccattagtagccactcttcagctttcctttcagacccaagtgcccctaatctgttttaatagattattagtcacccaggacatttcatgtaagtagaattatataaccatacaactacgtggttattaaattaatgattttttctacctgccacggtgttttcaaagcttatttatgatgtagcatttatcagcactttattcctttttatggctaaatattagttcatcgaaatatatatatatataatgtatgtgggcctttttggacagggttttgttgtgtagccctgaaattccttctgtagatcaggttggcctcaagctcaaagagctctgcctgcctctgcctcctgagtgctgaaattagagtccactgccacagtccagctcattgtgtagatactattattgctttaatctattgatgaatgtttggattgtttcaattttttggttatctcaaataatgctgcagctcggtgtggtggtacaagcctgtaatcctagccctagcccctgagagggagatatatgaggatccgaaattcaagggcatccttgtctacacagggaataaagggctaacgtgagctatgtaagttctggtctcaaaaacaaaaaacaaaaaacaaaaacccaaacaaacaaaaaagcaaaataaagccagggctggagagatggctttgtttgtaaagcatttgccgtatagtaagatccagtcctggggaggtgggagtaggcaggttctttgggtttgctgaggctagccaatcatggagttcaggctcagtgaagaacctatctggaaaagcaagccagagggctggagagatgatggctcaatggttaagagcactgactgctcttccagaggtcctgagttcaattcccagcaaccacatggtggctcacaaccatctgtaatgggctccaatgccctcttctggagagcaacagtgtattcatatacctaaaataaataattaaaaaaaaaaaaaaaaggcaagagttgtgattatggaagacaccctacctgtatcttctagtttccacatgcttgtgtattccttcccacataaacaggtacacacacacacacacacacacacacacacacacacacacacaccaagtaatgaggctgtgcacattcctgtataagttcttttatgaacctatgtttcattttcttagaaatatacctaaaagccaggtataccagaacttgggaggcagaggcaggtggatctctgagtttgaggccagcctggtctacaaagtgagttccaggacagtcaggactatacagagaaaccctgtctcaaaaaaccaaaaaaagaaaaaggaaaaaaaaaccctaaaaactaatacatatatacatatacacatacaagcacattatatatacacacattatatatatacacacacacatatttatatatatataattacacaaacacacacatacctctaagaatgaattggctggatcttattgtagctgtttcccaccccccaccccccaccccctttggagacagaatctcactgtgtagccctggctggactgaaactatgtagcccaggctggccttaagcacagccagcctcctgcctctgtctccctactgctgacataaaagatgtgagcctgtcacactcagcttgtttaatcttcttgaggaactgccaggcaactttccaaaacaatcaaccatttaacattgccagcaggaaggttggcgggtctgatctctccgcagcggttaccatcttcctctgatcatagccattcaagagggcacaaaatgcttgttctgaaggttatgagaaagggaacgccaactgtcttgttcactgtatgctagaatttaggagagtctggaacttctcagttttaaatattttattagggaatgggttatagctcactagtagtgtacttgcccagcatatatgaagccctagctttaatctccagcacctgagttgggggataactatatatgcatacatacacacacatacacacatgtgtgtagtgaataagatgaaaacaactttgttaagatggttataacgtatttttcaaaagtagatgtgtcaagaatctaggtttttttttttttctgttttctgattaccatagtctttcttctgagaaaaaaaagatgtttcctttttacagactgatttttatttgtatgtgtatatgtctacatgagtgagtgctacctatgtgcgggtgccaatggaaaccaaaagaggtcatctgatttcttggaaatgatgcttcaaatcagactcaggtcctctgcaagagcaacgtactttcttctgagtcatccctccagcctctagtagtttttaaaattttcttcagatcactcagttcagttttagaagtgcacacattcctgatttagacacagataatattctggatattatctcagtgtgtttgttttattttttttaaagatttatttattacatgtaagtacactgtagctgtcttcagacacaccagaagagagcgtcagatctcgttacagatggttgtgagccaccacgtggttgctaggatttgaactctggatcttcggaagagcaatcgggtgctcttacccactgagccatctcaccaacccttacgtttatttttataaaattttatttactaatttttttttcaagacagggtttctttgtatagccctggctgtcctggaactcactttgtagaccaggctggtctggaactcaaaaatccgcctgcctctggctcccaagtgctgggattaaaggcatgtgccaccatgcccggctactaatttttttttatatatgaatgactgtatgtatgcatgtatcatgcctctggggttatggatggctgtgaatcaccacataggtgcttgggatgaacctggggcctctctaagaacaaacgctcttaacccctgtgccaactctccagcccctagatacacacacgcaatttggttttttgtaacagagtttctgtgtggccttagctgtactggaacttggtttgtagaccaggctggcatggaattcagagattgtcctgcctctacctctcgagtggtgggattaaggtgagcaccacagccatgaaaatttttgcattggcttttctttttcttttcttttcttttcttttttttttcgagacagggtttctctgtatagccttggctgtcctggaactcactctgtagaccaggctggcctcgaactcagaaatcctcctgtctctgcctcccaagtgctgggattaaaggcataggccaccactgcccagcttgttcgaagcttttagctcacccccagcactctgtgcttgcaaacaaccatctttctgtggccttccaggctagtcacactggaagagacaagtctattagcccctttaaatctccctccaattccattttcggaagcacggagcccacttgacagagtgacaagagaaggtcaggttagtgactgggtgatgcttacggtgctcagagctgagcacttgaaaaattatttgctcaaagaataagcaaagtgaaaatatgagaaagactgggactgacctggcaaggtgagtctctgttgcaaaatgcaatttggtcaacaaatatttattgagtactgtgcccttgccttgtggctctatgtcaaaatatggctctatgtcaaaatacatgataaacaaaacagcaatcggccttgggcaaggagtttctaaaacagctttcccgctgcatggttcttactttttttttttttttaatccacctattgattttgaggattatattctagcctaaggaatcgattcagacccaaatagttggttctgatctaacgacagcaaagtctaggcgccactggggcactgttgtatctcctaacagctaatcccaaatgtgtttgggtccaagctgattccctcctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttccagagctccgcctggctgccccaccgccgcgagccctcccgaagcctggaggagtgagggccgccggcgcgggctgaggagtcctgagacgggggacgcgaacggcgcggcgcccggagcctccgccgcttcctgctgcgggcgagcggcctcctccggctcctccctcccttcgctgcggctccttaggctccggagcccgggggcggcctgtggcgcgaggcgccggctctggaccgcgcttcttcggaccttaaggggaacatgcattcggcttggacagtttgaaattcttagtttggggtccccgctcgcttgctttttccaccccgcggattttttttgaggattccccccctcaccttttttcatttttctcccctcggggctcttttgtgactctccccaaccccaaccctccgcctttatgttcgcccagacctccacccgcttctgagtagtgggggagggtttcagcctccacgttcccgccccaccggggccccggcgaacatggggggcaagcagagcacggcggcccgctctcggggccccttcccgggggtctctacggatgacagcgccgtgccgccgccgggaggggcgccccactttgggcactaccggacgggcggcggggcgatggggctgcgcagccgctcggtcagctcggtggcgggcatgggcatggaccccagcacggccggaggggtgccctttagtctctacacccccgcctcccgcgggaccggcgactccgagagggcgccgggcggcggagggtccacgtcggactccacctatgcccacggcaatggttaccaagagaccggcggcggtcaccatagagacgggatgctgtacctgggctcccgagcctcgctggcggatgctctacctctgcacatcgcacccaggtggttcagctcgcacagtggtgagtccgcgggtgacggaggccttgaagggtggagtgcaagggagggcgcgccggggcgcccgaaacctcttaatgtgctaaggtatgggtatgaagctaactcctgcccttcccctggttccttccatgtcagaggatgaataggatcaaataagataactactgcctagggggaaagctgcctactaggcgtgtggagccgggtaccttaggactgcaggcatgtgttcacttgtggatggctgagtgaaacctgcctattgaggtcgcatttattagcgtcatgatcctcaaaggtcttcttgtctgagactcttcatttctgccgctgcagcatggtacctacctttctggttaaggaggtagtgtctcctaaacaaagagtgagaaaagaaataaaactaggggcgagtgattcttggattagggttcttattctcgctaggaaagggaggtggtttgtttttccacccgactggtttgctgtatcaattgtttaaaatggaacaggaggctggcttagacaggtgtggtctgctatgtggaaagcctccgtctttgggtttgcaggaccaggattctggtctgcatgcagtagatttggctcagggattctcacatccctccatcttttttcccctgctccacgataagtgcttgttcttcccgtgattgtgcatctttttttttttttttcttttcatagagcccaggagaggtggggtggtattgccccacagctggcacatgactagggaagaggaagatggaaaggatggagatgaactcattctgtgcacttctggtgacaggccaggaaaaggctggagggggatttcccaggccctggctggtggtagggcagcaaaggcctggcagagacttctacaggaaaacaggtctgtctgcttggctgtcctgagaagccagggcaggcctctagaaaactggtcaaaaggggtgtggggttgctgcttgttaactaccagtctgagtgaagcagttaagtattcagactcttgtgcctgaactgggcaatttttgttgctgtgtaggagaaatcattctcctgtcctcagggtccattatggagggcttacctgtgaggtcactgttgtagctcattgcaaaacaaggtagggtttgttttgtcttgtttggttttgtatctttccttcttttgatcaattccataatttttgaagtaactttggtgggttatagtggctggcttagagcttctttgactttaactaaaatgctggacatcagacacaaggcatgtctgcttttggtaccctctagtcatttggtctgtgttgggcatgttggaattaataatcttccctaaatagttgagtccagaagtctcagctttatttcgagacgattatgagtacacttgtaagtgaactgttattggcatgcttttaaaacaattttgagtgcagcaagcaaatacctttataaaagcttatatggggagggagaaaaggagttatcgttttggtaagatttcttaagtctgtctcttaatagaaacttcattatccttgttctattgtcaggttctctgatagagttatgaacttacaactgagttccaatatctcacactctccagatatgaaggcttagtgttctccccaccatcttactcccacccagtcacgggagtagggagtcccactgagtgatgggaatacaagaaaagttagagtcatcctttgggtgtctttaaagtgtacgtggcaggctcttgttaacattataggtaatatttgtatatatttacttatttttagtatatagaaccacctgtgctttttgcaagactctgggcctattgaatgctcctggcatcctgcagttcacctcatactgcctctgaattcccaaatggcttttattggggtgggtgtaccagtctgactgtgagctgcctgtgctgttcagcagaggtgagcattcatttgtgtcagtgttagaacaggccgtggaattttctggggcatccttttctcttgttcttggctgcaaggagagacgctgctgtttcgctgctgtctcggctgtggagccttggagttaggtctgagcagcttttgctcttgtgtaagattccaaaggtggggctttcagtgtttgactgactgcgggcctggaaactggtacagtgttagtacttgggttttcaaggtgctttggtgactcctcacaagcagagagctgtcattaaagaaataagtcaaagctgtgggcttgtgctgtgttccaaagtagaatactgagggcttccagttttaggtcctctgctgagtaactttgaccttggacaagacacagcacttttctctaggctcatctttgttattttaaaaatagatgtggtaatcctccgcggtggcagcttgtaacggttgttctctaaaccccaggagaggatattctgcaattgcgcttggcttccgtgcttctgtgtccctgtgccttcctcatggctgtgaccctcgaatactgagctccttaggacagaaatgctagctcttactttcttcacatagatagctcctttgaaccctttaggactcaacagagatttttttcctcagtgggcactcttaacatctgacttttttttttttttttttttttttataagcatgttttataagcatttatctgctgacttatttttcttcttgtagtgtgactaagttttcatttctggaaggccaggaccagctcttgagtgctgctgtaacgcttacactgctcaagtatttgctggatgaaagaacttgaatggcttatgtgcatcgtcttattcattactgtaactctactcctagtttacaggggaggtgaggagcccaggcagctggctgtagttagcagaggtgagactggagtgcaggcccaacagtgccagaacactggctctttttatcgattactttgttttgtttatgtgattatttattgtttgttttgagacagtgtcttagtatgtaatctcagttggcctcaaacttatttaatacaggttggctttgaacttttaatccttagttttcatcttctgcaatgtttcagttataggtatatgttgcttatgttcaactgtgctctaagacaccactctggctccctttttttttgtctgtttccaggaaatagtaccctggaaacgtaactagccactaagtgggaagaagggtaggctcatgataaagggcctgactcttaaccttgagcagatagatgtgtagttccaggctttagtacatcttcatctgtagatgtctgtcctcggagtcctgcggtcattggtgagggtcttttgtgacagtatacaccaaagcaaaaggcaaagggaatccaagtggaacactgatggccttgtggggacaaggctattgttcctgccttctctgtctccttagaactcatagacagagctccacacgagaataagaacataggccccagctggaggccctgctgtctggagtctctgccttgtatcctgttctcctatcattgccaggggagaaatcctttgagaagcatgtgcagccctttccttccaccggacaggtgctgggcttgtcctgaggtgattctgtctgtggcttttggttttctgatgctaaaggcctggctggccattcttttttgtagtagtcctgttaaccttggagacggggtttccaaatgtggagaggaaacatgaagtatccaatccacctgtgaggtgagcttgctgtgttctactgtaaaatggggtgtggctggctactggggtgcggctggctacaggggtggtgtttgtttggtctggcttcttagtcatgtttgtgtatacatatgtatattcaaaaaaatccaaatttgttttgtattttaaccaactcaccgactagggctaagatggagtgacttaaaaaagggtctgaatatgctagcagcatgtctcctgggttctagtttgctgtcacactaggatttccaaacttttttctagtcttaaatagtgaggaacagttgtcaaatctatttgagtggctcaggaagtctttgtgtctcactgtaggtatgctagaggtaatgggcctttttgagtcttctgaaaaaggaaaagcattctgtggtctctaaaaagcgagatccattccctgcccagctctgcaaaaaagttccagccttaatgaagacttgatttttaatgtagaatttttagttttctattaccacaaggggcttattttccatgcctccttcaggcaaagataatttcctaagggtcgtagttaactattccccatgagatctgaaaggcattgcaagcaacagtggttaaattgttaacatggttgttttatggatgtgtatattttaatattaaacaaagactcctctccaactatgtcacaaggaatgctgtaagccaggccacccttaaccaaagaaagagcactcctccattcttgaaggaccatgccacatattttacaactgtgatgatattccacccaggctcaatgggcactgaactcagaatacccagttatagccagcagcgtggctcagcagagaagggcactggccccctagcttgatgagttgagttcagtccccaggacccacttggtgggaggagagaaccaactcccccaattctcctctggcctccacacgcccatagacagggcgcacacacacacacaataaaaataaaaacttgtcatagtttcaaatttggcagaaaaaaacatcatagggaaccagtgttgccctaagagggatgttggtcccactcttattgaaccttaagctaggttaatgatagcaggcctgaggttgaggtactggacactttttttttttttttttttttttggtttttcgagacagggtttctctgtgttgccctggctgtcctggaactcactctttacaccaggctggcctcaaactcagaaatccacctgcctctgcctccccagtgctgggattaaaggcgtgcgccaccacgcccggctggtactggattcttgaagcaagctccaaacctgactcctaaacttagtctttagaataatagatgagtttagatttttagtcatttttccccctaagctttgctgtgccccagtctaaatcaaatggttggttcttagcatctgaacattataataggcttaggtactgaaaggggcttctcagacgtagcttctgtccttctcaatcttctgttcataagcaccgggcttatcactgggtgggtgcgatggcactcgggaagcagaggcaggcagatctcagaattaatgggccagcctggttcacaaagtgagttccaggacagccagggctacacagagaaaccctgtcttgaaaaaccaaagtggcgggagtgggggtgggggtgggggggagggaggaaaaaaccaggtttatctttgtatcctgtctcggaagtgctgattggatagcagtgaagaccagtgggcaggtggaggtttataaggacccaagtttcatcctgaatcagctgctcggatggcttctaaacggatgcggcagttcaccttgctgtctccctgtcttcgttagccttgggaggcaagctaaagggtgaagtcacagtatctcgctatttctataactcaaagttaggggggacatgataaggatttacagtgcactttttggacaacagaaatgaaacagacacaatcaggagcctctgatgagtgagggctcccgagtagccttgctgactgcctggtggtttttagggagcctcatagcaatgctgatgacaggaccctactcccagaattcagtggtgctgaggagactaaacagatcccgagagtacagttagaacatctacatttggaattcagcttgtcatgaattccctttcttccttctgaaacagaaagaacttggtgggtagtttgtttgtttgtttgttttggtgcatccattgtttttgatactgttaagctagttgggtattttctagaggatccatacaagtgtctttcatcagcaagagcattcttcactggtgtttttgtttttgttttgttttgttttgtttttccacatggaattaagcatttgtctcctacataaaggcctaagccagtgtgccatggtcttgacaactgagtggctcagaacagcctgacagtaattgaagcaatggccctttctgtgctgttccccctgattttcatgaggccccgctgcctctggcggtcattacctctgaagggcactgatgtcacacaggcccggcccagcagcgaggacatagagctggggatctgggacagctcctgacactgaagcgggtgtattatgagtttccctttccctctttatctcagagcagagtttcctgcctgtgtagacactgactgcaccaagacagtacacacaggcgccaggaactagtgtaggtgctgggaatgaattatcatgaagatgattagcgctctcaagagtctttgcttttttttttaacatatttttaaaattatttattttatgtatgtgagtgctctatctgcatgcacacctgcgtgccagcagagggcatcagatcttactatagatggttgtgaaccaccatgtggttgctgggaattgaactctggacctctggaagagcagccaatgagtgctcttaaccactgagccgtctctccagcccactttcttcctttttaagagtgttcctgtggctttagagtttgtcttctttatcaggtctgtgttgcatgaacactcagtgtgtgtgaggctgctgtaaggtgtttcttctgaactctgcagtgactgttcattttttccctaacccctatttctggtctgggcaggtcatctttgtgtttctaacagactaagaaatgtcttgtgtgacccagcataagggggccagccctctgtcttctcaatggtgtctcgtttacccttgggctttgaagtacctttgttgtacccagagttgcttttctttctggtcactgtgtttcataggaaacatgagtcaccactttttaaacctgtctgtaaaagagccccttggtctggtacgcgtaggtttcagaatcccatggtattgatactttagtgccctgtaccctggttgctttttattttgataaaatacatgtaataagccgggcgtggcggcgcacgcctttaatcccagcactcaggaggcagaggtaggcgggtttctgagttcgaggccagcctggtctacaaagtgagttccaggacagccagggctatacagagaaaccttgtctcaaaaaccatttaaacaaacaaacaaacaaaaaaacatgtaatgaaacctaccatcttcaccatttttcagtaatcgtaaagtgtttgtcttgtgactcttttcacggagcataatgaatacccgtaagtttcatccccgtggttgcatctccagtcaggattttcttctctcttagggttgaacatgtaccactaatgtgtatttgagtgtacaatagacagtatatatacacctttgcttctccatgcatctgtctcggacgcacggattgcttccatgttgtggataatactgctgtggatgtgcaaatgctctttgagaccatttttacaccaccaccacctctctagcgatggggatgttctaggctctaccactgggccatatcccctagttttccatatatacctcggagtaaaatggttgagtagtgttttttgttgatgttttgttttggaggtaggagacagcccctcctctctgattttgattcaggttgggttttgttttgttttgttatagtccaagctgacaaactcactgtgtagccgaggataagcttgaacatctcctgcctccacccctcagtgctagaattacctgcccagtttgttcatgctggtgactgaattggtttcatacactgaaggcaaacactacttgagctgtctccagattctgtttcagaacttccgctttccactctttctcaggtcttgccctattgctgtcctgttctatctggaattcactgtgtagacgctgctgggttaaattcagagatctgcctgcctctgcctctccagtgctgggattacaggctcagcatagtcaccatatctggctttttaatttaatattttaaatagtgaatgaaaatgggcgcagtaaagaaacaaaatagccgtccctagatgaaaaggcaaaaacttcattctgaactgctaggctgtcagggagagcaaggagaaagccgagagaggaagattttcagagttaaaggggaaggagagaaaatggggcttgtgagctagggtggggcttgtgggctgggactttggagcctagaggctagcactgaccttgacaaacttgttaggtaccaccttgttattggaagttcctcttgctagagataaggaaaacgactcccttcttacaagctggaactttctgtaagccccctagacaatggggtccttcggccttgggaaaaaagactttcttgggaaccagacagatagtagctaacctagtgagagagatgttatgtcttgtaagttatatttctgtcacggtgattggtaaatatgattttgttttttcctagccatttatgtatctttgaagaaatacatattcaggtcatttgcctgtttaacaggtttttctgggtttttgttgttgttgttgttttctttttaaatttcatttaaatttaaaacagccttggcagtttggaatgaacttccttgtttctagtgcccttctctctataaaatatgattaaaatatgattaaaacatacttcacaaacagctcttccaaattactcacttccatattgtgtgttgtacaatatctcataaggtcaaaggaggtctcttagaatgtgggggaaacagagctactcagtttgggacagagctagaaagtccccagacctcaagcctgtatggtcattttgctcacatttctgagcaatttggagacatttttgattctcccatctcggtagcctttttcctgtagagaagagctggctaggactcttatcctaagtctccactaaggactctggaaattctacagtaatttaaaggagccattgggattccatactaacaaattagttttgtgaaatattgcttattcttttatttagactctcaaagatataataccgtttaagatagataggaagctttctaaaataccatttaccagtgtaacaactgtccccagtacccacgtaagccatcagttagttactcatgcttggtcagatgtagttgaagcatctattgtaaccagatgccctggagaggttctaagacctgtgatgagtgctggcttgcaagctagtggccttctatcgactacctgacaagcccagttatattatatctagctgggtttagtcaattcgtttcctacgcttctcttaacctaaaggccaaatgctacacaaaaggctaagcggatatacgtgtctcctgcgtttgggtctaggaacctccagtgaagtggcagacctatgaaaaatactatcatgagctgttctattttgctgtggctttggaaaacctttggatttctttactgaaaatttgtttgggaaaaaaaaatctttttaatgaaacagtgtgagtcacaaagcagccaccccttcttataatagcatttctcaccaggggaatttttggtagctattgggggagggctgtgagtaggttgtagatgatccatcccttggtagaacacagccagaggcatgacaactctggtgtttccttgctgacaccaggatctgaattcaaaatgcaggacggcagaacggaagagagaagcctggttagtgagtggatgctgcagcatccagcagtgagattggagccttgacagtgtcaatccgttcaaatcccattgcagtatagaaggatcatgaaacaggcccaggtcagacaccgggagccacagaggcgctctgggttctgagatggcaactgacctaaggatgcccatccgtggatcacaagcaccttctttcagtgtctgtgtttcctaggtcgagcaccatccttcaaagagtggatttgtagaactgtactttacttgttacacttttggttcaaattgggtttgggaggactggaaagatggctctgtgattaacagcagtttgttcttccagagaacccaggttcaattcccagcacccacatggcagatcacagctctctgtaactacagttccaagagatccaacaccctcttacaggcaaaaactcataaaataaagattttatgcacataaaataaagatttttaaaatggggtcttgttacattaaaatgcttctttaatgtaaattttaatttacattaaaatgttacattaaaatgcattaaatttgaaaggaagggattaccagcccagcctggtctacagagcatgttccagcatagccaggactacacagagaaaccctgtgtcaaacacaaacaccacgaccaccgccagctcacagaatgggggaaaatctgctagttgttgatcctccagcaagagattaatgaccagaatatgtaaagtcataaaagataatccaataaaaagcaaaggaatccaacagtcagttctccagaggaggactagtacctttctgtaaataccagagaaatgcagatcacagctcctttgagattccattatccagcaaagaaaagcaacaagtgtatacagcgcctgatgcagtgcttaccccaggagcaaagccccgcccggtgcattcttggcacctccaagcagatgctttgaggaaggagtggggaatacaccctgggaaacgggaattagtttagccacagactcagtacagaggttccctcagaaaactaaaaggataaccactatatgacttaagctgcccctcgggaaatgtacccaaaggaacctaagtgcacgctagacacacttgcattcgctatgccttcgtcagcacctttcacagccctggagatacaataagctaagtgccatgtgcacacagtggagcgtcattcaaccactaaaggaggtgaagtcaccacactggtggcacaccaatttcagcatttggggagcagaggcaggagcatctctgagttcaaggctagccctgtttacatagttccaggagtcttgctatggagtaataataataatagtagtactagtaataatagtaataataataatctcatttggatcatctggaaaatgatgaaatacaaatgctgcacgttttctctcatgtggaatttagatttaaacaaaaaagaagggaaagtaggagagtggatgggttgagcacaggagacgaggtcggtatgctctgactgctgctgtccctgtgtagaatgcctagtgaagcctgttacttttttttttttttttttttttttttttttttggctttttcgagacagggtttctctatagccctggctgtcctggaactcactttgtagaccaggctggcctcgaactcagaaatccacctgcctctgcctcccgagtgctgggattaaaggtgtgcgccaccacgcccggctaagcctgttactttaacaacaaatgtacactaataaaattatagaaattagatctagccaggtagcggtggcgggtgccttaaatcccagcactcagcaggcagatctctgtgaattcaagtccaccctgttctacagagtgagttccagggcagccaaagctacacaaagcaagcctgtctcaaaaaaaaacaaaacagaacaacaataataaaaccccaattaggtctaaagcatgcagagtggcacacaaaggcatcactttacccttagcctctgcataggacggtgaaaaggaaaggcctttctagagataccaaagttttagaacagggccggagaggtgtcaagaggatttgctgctcttctaggggaccagggctcagttcccaggacccacgtgtcttacagctgcttgtaactgtggctccatgaagttttagtgacctcttctggccttgtgagtgctccatgcacatgctgcacagacatacctatggcaaaactcacatgaagaagaaaattaattttgaataagccagcataccagtattcaaaagctcttgccccaaacccaaggttaagtttggaggttcttgggtcttgggggttgtgcttatcttgagacaaggtctcctgttagcctcctctcgctgtggagctgaagctgactttgaccttctgatcctccagcctctctctgcctccctgctgctggcctggcaggcacggatgaccaggtctggctgatgtggtgctgaggattgaacttaaggcttcccgcacgctggcgagctttctgtcaactgagccaccccgtcactatttagagacagttttgcttactataattttgtagcaggtctcaaacatggaatcctcctgcttcaccctcttggtgttgggtttgtaggtgtgagcccccaaggccatcttctgagactgtgttaactgctgtcagcttcaaagttcctcaggactcgttcagagccactgcttcatgtaagatggagaccggaaagtctacaagtgttacagctgttaatgttctaaacggcagggctgtctcctttttgtgttttcctggctttgttcttcttttttttttttttttttgtttttttttgttttcccaaagcttcataccagttccaagtctccagggctcaaagaggggaaacaggaagtccatatttgatgcatcagcgccagcaactactaataaagaaaagggcaccagtgttggaggggagttctgggccctgggggtgaccaatagcagctcctatgaaagggaaaggcctgcctgcttgttgtaaagcagaaaatagtgtcttttgtctgaggaacaaaacactcaaggaaaaggtgtattttacttagcagtaggagtcagtctcctatttctcttacttggagacttgctggatgcttatctttggatcccagctgtagcctgaagcctttcctctttctttcccattaagagcgaactctgaagatttatttggtcttgtggttggtgaatgggtaggtcaggtggttggtgctgtttcatttgttgttacaggtgtacatgttaggaaatcggataatgctgtgactctgaataggggatctttggtgccttaacattttctcaaactatgaactttttcaggaattcaaaaaagatgatgtatttaactcaataagcagataacaataaaacattatagaaataattgtgtatatcctttccattctcgtttccctatccttcctcaagaatacccactgcagccgggcagtgttggcgcacacctttaatcccagcagttgtgaggcagaggcaggtggatttcagagttcgagaccagcctggtctacagagtgagttccaggacagccagggctatacagagaaaccctgtctcgaaaaaccaaaaaaaacaaaaaaccaaaaccaaaaccaaaaatggattcccactgccctgaccctgaccctgctgtttatatatatatatgtgtgtgtgtgtgtgtgtgtgcgcgctgcgtgtgtgtgtgtgtgtgtgtgtgtgtgtgtgtgtgtgtgtgtgtgtgcgtgtacatatactatttttgctgcttgcatttgtccaaaactgttgttagttttttatactttgcataggactgcatcctaatgtccaagtacataacaggtacgtataggtacatataggagagcagattgacgaggtgtgaatggtttacctgttagctcagcagatcactttcactgccatactgtaggatgacttcacaccaccatctattgtttcctttttaataaatacgcattaaattattttcacttgcttcaagaaagttttcatgtttccttatacgctttttgttgatgctgttttgtttttagccatagctgttttagaactagtttggtggaccaggctggccttgaacacacagagatccttctgcctctgtcgccagtgctgggattaaagacatgtgccaccacaccaagctaattactgtagtaattagctctgtgggaagggcaaaccgtttgacctcacggaatccttttttagaactgttgcctaagtggaactttctagggtttcaaataaaggatccagatgggaccaacaaaaagaagtacagcgttccaacagctgctgtttatagtggggattcttaatgccaggatgggtctcggtgcccctgacctaatgggcactttcacacttccccctctactatattgcataagtaacaacatttcctgatgtctttgtatcacaaagagcagtttttagtgtttcagacaacaataaaaacacaaactgcctatcttgggcaacttttgcttccagacaaattttaggttctgttttgttgatatctgttgggggggggggggcgagaactgcagggatttttatcctgatcacagattcatctgccatacttttgttgtaaatttttcactagcttgtttttctatttttagaggtaggtttgctgagacatatgttaatccttttgcctttgtctcccaggtgctgagattatagataggtgtctcatacccacctcacttctgtctttataagtagataggactagagttacagatggaagaattgggttttttaaagatttatttatttatgtgtatgagtgtcttatctgcttatatgtctgtgtaccacatgtgtgcctggtgcccttgggggccaaaagagagggtgtcagatcccttggaactggagttacaattgttagctgccatgtgggtgttaggaatggaacccaggtcgtctgaaagaacagccagtgttcttaactgctgagctatctctccagccccaagaatatagttttttaaatatatttttacatatttttaatttctgaaattattttcagaactcttttgtgttgctgggatcaaagctgtaagtgaccactgcctgtcttattttccgaacttttacgaatagatattatacccctgcaactttaaaatcctcagtgttaccagaaatacaaataattgacaggcattaagttcttggctctgtaaagccccttaaggtctcaacaagtaaaatgttgcaagtctgaaaagtccatgttggctgccctgggaataggagtggcatgtggtcttgaagatgacgtgggtcggaaggggtgctaggcctaacaccgagacctactttaatcagggttgatctgtatccttacatgaaccaaaatagatacagcctctgttctgtgtgttggtgctttgagctagtctattaaaagaagggctttaaaaaggcctttgtaggagaatggagatggctcagtagttaagagtgcttggctgctcttgcagaagacttgggggttcaattcccaacaccgacatggtaggtactgtttgtaactctagttacagagaatccagtgtttgcttctggcctctgagggtaccaggtattacatgtggtgcatagacatacacacaggcaaaacacctatacacataaaataattttaaaacttctcccttcccttcccttcccttcccttcccttcccttcccttcccttcccttcccttcccttcccttcccttcccttccctcctcttcctcttcctcttcctcttcctcttcctcttcctccttcttctcccccccccccctctctcattggatatcctggaactctctttataggctaggctggcttcaaactcatggagatctgcctgtttctgcctcctgagtgcttggaccaaaggtatgtaccaccatgcccagttttaaaaacttgttttaaagacaacttttttaatactttttttttgagagagagagagagagagagagagagagagagagagaatgagaatgagaatatgaatgaatctcattttgtagttctggctatcttggcacttactatatatatatatatatatggctggccttgaactcagagatccatctgcttctgcctgttgagtacagggattataagtgcctaccaccaagcccagcctgccagtgtgttttgcttcctgtcttccattggatatgctttagttgtccttattctatacttttatccatacctttctccattccctactatctggaagctttcagctcttttagttgcttctcttaaagttttggcctgcatgcttcaactaaatataaagttaaatcatttctactctattcctaagtaagagccacagtttctgttactcactgctctggttccgtattctaatccactttgttttcataccctagaattagttattgctattcttatttgataacgtctgctcacttggagtcacccacctccttacccttcctctgcctcctgtttcttctcccatcttcatgcttctgagatatacttacttctgctaccaaaggtgggctatacagttgggttttctctgtctgctactgtgaaacttttttttgcttgcctaaatctctttttatttgtcatgaccattggataattcaactggatatgtgtgtatgtgtctgagtttgtgggtttatttatttttctcagtatttagacagttttactgctgtgttttgctccgtttgtagagttgcaatggtgaggttggcttctggcctcttagagctaatctattgtgtgctgctctgtcttctttgttcctggtcttctgaaggttactgtgttgtgatcctcacttgaattactctgtgtgtcctgcttgttatttgtacttgaatataagatctaatgcccttcaaagcacttaaacaatttttacttttcattgattttttttttccagttcttggagttctgctttgagtagtgatgggtgtgatgggttcgtggccctgtagtttgtgctcctggacttccatcctttagaatctactcctgtgccacctcagctgttttcagtcctgctactttttcctccctccctctctctctctctctttctctctttcttccagatttatctagttttatatttgtgagtacactgtcttcagacacaccggaagagggcaccaaatcctattacaaatggctgagccactgtgtggttgctgggattttaactcaggacctctggctgagccatctctccagtgctatgcttcagttgtttccagttctgtacctcagtttcttcttttttttttttaaacatttttaaaaatatttatttatttattatatgtaagtatactgtagtgtgtcttcagacactctagaagagagcattggatttcattatggatggttgtgagccaccatgtggttgctgggatttgcactcaggacctttggaagagcagtcagcactcttaaccactgagccatctcaccagcccgtacctcagtttcttatgtctgcctttcagtgcacagttatttcttcacccacttttaatttacagctttatatttcattgaactacatggtaggttcctcttggtaataaagtgggttgtttatttcttccactgtataaaaacaaacagaaatgaacaaatcaccttacttagacttttcttgttgcccttgttgggaaaggcgctggggaatagctagctgctttcttatagtctcttcctgctcagaaattccgtgaagcctcatcactctggaatcatgctgttgagcaaacaagcactctgcgtggggacaggcaggaagctagagcccagcatggctttgtgctgcactcccagaggaagagcagctcctgagtcacgtggggatccccgcattgtacctctggggctcacagctgtggcggcaggaatctgtttctatagcaacagaaggcttaactcttcctctgctctcagaatatgcagagaagagacatgataaacttggagagcattctgtgctctagatagtctagatttgttttctcccttctggaccatagtgtctagcatgtagccacaaggtagaggtggttatttaaattatagtcaattaaatttaaaaatctgtttctgggctggtgagatggctcagtgggtaagagcacccgactgctcttccgaaggtccggagttcaaatcccagcaaccacatggtggctcacaaccatccgtaaggagatctgactctctcttactggagggtactgaagacagctacagtgtacttacatataatcaataaataaatactttaaaaaaacaaaaaacaaaaaaaaaacaattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaagtatacagagagatctgctgagtgtaaagtaattctgatacggaggctatgatgttatcactcattggctttcctcacacaagtcacactatgagtggaaaccatgcttccccaggttcaggtgctcctccagctctgccccgccgctctctgatgagctgaccaaccatcctcagtgagagcattgtttatccgggacacctctgggactgtaggtgatcattcaaacctgtaacaaggatctcttgtccaagattggcttattctgactatacaataaattgcttttcttgctggttttgtctcccctatgtacatttgctgctagtgtggtagaaagatagtggtgagctttgtgtctcctgaggaggcctttgtacataggtagcggtaggagagtggagcatgtttaagcataacctttaaagttggtgttggagtatatatagacatcattcactttaaatgtaggattttaggcagatgagatggctcattggataatgttgtttgccaccaagcctgacaacctgacttctaaacacacacatcacacacatacacacacattgaaagaagcatttcaaatatattaatataatatggcaaaaacatatatacttttaaccaagatgaaatatctacatatttcttatgtaactttatgccatttggatatttatttatttattttagaggcaaggattcactccatagcctaggctaacctggtagcttaaaattacctcaaactcaaggcaattcttctgccttagcttcttaacatactgagattatagatgagaggcagcacaaccagcctggatgtctctgtccttataccattccagtgaggccccatagttttgtgtgttaatatgaataataaggctagggatataggttcagtccccagtaaagaagaaaagaagaagaaaaaaaaatacccacagggtttgcttatttgaagtttgcttttaacattgagtactatattatgcttttgagctgttccatgcatatccagtgtgtagctctccttattaggacatatgcttatctccttttgtatctgcttgtttctaaccattagcatggaagggcctgtgctgtgcattttgtatgtacagctctcttacctttccctgtgcaggtagattgtcctgttatagttgtgtttcttaccccgggtcctttatgtttctctcatgcctaggactgctagaaggaagggcacagactgagtgctttgctcccaggcttgtagtccatcatcagggtgtcagcgtgatgttttcctcggaggcttctgtccttgcctggcagatggccacctctccatgtgtctccacatggtcttccttttgtgtctaggttctaatctcttataagggtatgagtcttaccttttagggcctaccctaaaacctcattttaatatggggacttgacttctaatccatcattggattagagcaaataaaggggactctgttcctttttacaaggagaatgctcttggagtcttgtcagtcagggtaacagttaccgtggggttagtgtggatattgtttgttagtcagagatgcttcttgtgccttgtttgttctcaagaatggagaacatgaggcctacctcaagttagagctcagaaagcttggacagcttcttcagaagtgcaccctcaggggtgcagaaagataacaccagctgtctctaaggctgatttggaagacagcttcagtcagagcagttaacagcagaacgtgggaggagtacttgggaggccagtggcagacatgagggtctctgtcagcccagtgtgccacgccctgtgtcgctctgctgtctctcagggcttctgtgagaaacccagtggctttaagctggctcctttctgccttctcactgctgtgctgttcctttggtcactgttaggagccctctttggcttagctatctgcttttctctttggtatactcggggcctctccctctggccctgagttcccactgttgttacttccaagcatatgcgttttccatagcatggtcacacatggtcgcatggtcacagtggcgtgtgcagccatcacagctcctgggtcagtttaaggacattatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcacgcatcagttttctctgctgttttggtctcagaattgaactccagagcctttacctgctgagccaacactttaaagatattgtcagagaggggttctttgagacaggattttgtccttagcccagattgactttgaactcactgtgtagcccccgctggccttgaacttgtagcccttctgcctcaagcatcctgagttcccacgtgtaccactgttcagctctgaggccccgtagacatgtttcctttaattcctgtgctccattgcagtctgtataaatttatagtttttcttttttttagaatatactttaatttttttctgggttctcctttaaatgtatcccaaaagctttttttgttgttttgagacaggtcttgtatagcctgggataccctcaaacttagtccagagctgagtataatttgaactctcatatacctggaactacaaatatcaggcctagcttcccacagtctgtttaatcatagatttttagggagtagggtggaggcaggagcgaggtaacacaatgtagcctaggctggactagaatttactatgaagccagcagatctcaagctcaaaataatctccttgcctcgtcttccctggggctagaattacaagccaccaggattagctggaggatcaatcctctcctgtttgtgttgtttctttctaagaatcactttgatattaacataagaagccttatggcaatttagtattcaggattcatagttagagaatatatagtgaaattattcttagatcttttgatgaagttggcaattacatttccttaaatgatccaatacaaatgcatactatttgctgttttaggagttacagaatccagattgtatgagttaaactaattcttagatgaactccccagggcttccttatatatctgtctataagtttcttggatggaaaccacattaaatcactgatccagatatagtggtatagagaataatctcagattagccttggctacgtgggaaggttggaaccagcctctgctagatggacctgctcagacgatgacaatgaacataaggcaaagcaaaaatggacaaaaaggttcaatcaaggatcatggtttatatgtcatcgtcatgtctccatagttccatttttttttctagaacattctcttctctcttcataggattgacatttctgaagaacaaagtattttgggtttgtcatattgtttcctttagatctagattcaggttagatttccttggcagacaagagctgtgcagatgctgctgctcttctgtgtcagtgtcactttatcccatgacttaattagtgcctgctaggtagaggagatctgtggtttcataactccaaaatggcgtgactgtctcatagcctagtgatcttggtgccaaggatgttatgatcgttagtaatcatctccgctactgacctgcatgcctggctcaccccttttcaagcgtatttattacttactaccaataacttttttttccctttttgagacaggctctccttagcagcctggaactaagtagaccaaagcgtcctcaagctcacagagattcacctgccgctggctcctcagtgctgggattaaatatgtgacaccaccctggctttcagtggcatctctagaattctagtctatcatttctgttgtcagccgtgagtgtacttacttgagtctatcagattgtgatgtctcctgccttgcccttgttggatggctttgcagctgacttaaacagaagacgcaaaactggccagtgacagcaaattgtagggaagcttttttctgtgtgacacaggcagaaatcctcccctcccccacttcagttctttcttggtttctggcacctggggatttccagttctttctttgttcttagtcagtgtagggcatttagaacacaggattttctggttatataggcatttgttttgctgtaactggaagttcccaggattttcattctcagtattgagactagatacttcaaagggtttttgttgttgttgttgttttgttttttttagtttttgttttgttttgttttgtttagtttttgatttttcaagacagggtttctactgtgtagccctggctgtccctggaattcactttgtagaccaggctggcnnnnnnnnnnnnnnnnnnnncacctgcctctgcctcccgagtgctgggaattaaaggcgtacaccaccacacccggctttcaaaggggttttaggacttgaatttattcttctctgtgagctttcagaggtaactatagttgatatctttctcattatttagaaagccatagaatcttgactctcaaattattattaactctgattacagaggcattacaaattattttttaatggctggagattggtgaagggatggaatggtggcaagtagtgaggagagtgagaccgaaaggtgtagctcagaatatctttctctgcttactctttagttctttttttttttttaagatttatttatttattatatgtaagtacaccatagctgtcttcagactccccagaagagattcagttatcattacagatggttgtgagccaccatgtggttgctgggatttgaactcagggccttcggaagagcagtaggtgctcttaaccactgagccatctctccagccctcttcagttcttaagggcatcagcgtatcagtgtttaaaacgtgagaagcatggttttgttttgttttgttttgtttcagtgcgattaaacctgagaaaattattacattttgaaatgaaagacctcatggtttattcctttgaagctgtagtctctagggtttatgatcttttagtatatattttaaaggccagtgttgtatttccagcaacaaatggaaagaactgtgtgcgttcctttagctacataaaaaagtccacataaaaagaagtttgcttttgccttaagtttcagagcttttagtccatagtcattttgccccattccctttgggcctatggcaaggcagtgactaatcggagatgtgtgcagtagagaaaggtattcctattacagcatccagaaagcaaagaaagggcaagaggatgggccaggaaaccaataaaccagtgttccttccttaaaaggtttattacgtgtgtgtgtgtgtgtgtgtgtgtgtgtgtgtgtgtgtgtgtgcgcgcgcgcgcgcctgcctttaccagtgcactgaaacatttctctggcccccaaatccttttcaagggcatgcatgccctcatatttgcacggagaatttgcaactcagccccacccctgtacagccttcttattagtacccaagacgggggaccatggcttttgctttttttgttgttgttgttttgttttgttttgttttgttttttatagcacatgggcctttaaaggacatttatccaagccatggcagttggatgtgaaaggtgtgaaatattcagttaaaaaaataaacaaaaataagctggtggagcaatgagtccctatccagtgctctacagagtgaatcacaagccagtcaggttacaaagtgaaacctacaaaacaaacaaaaatgtatctttgctttagagttcaaattgcagctgccccaattaaatacaggaaatggctgtatttttcttttggcattcaactgtcttgaccatcaccacctgcttggctggtcacattcattaccaggctttctgtctgaaaggagataatattcacaaatggctcagaaatagcaatgagcatttctggtcatttattaacatttttagtgttaggttttagaattagataaacttttgtggtcaaggtgcctttggacttctgcagtaaccaattaggtgtgtgcgcatgtgggttgtttgtgttttgagacacttctccctgtgtaaaccattctagcctcaaactgacagccagccagctgcctctacttcccaagtgctgggattaaaggtgtgtgtcatcatgtctgtctaaattggtagtttatataactatggtctctcaaaaatgagaaacggaccttggagccattggtacaatccacaagccttatttggattcctggttttacacgacgttgtgtttggtgtgtgtgtgtgtgggtacactcgtgttatcatttgtatgggttcatgtgttcaacatcacagagatacagaattggtccataccagagagcactttccaggttagagataaagctcagtgctgtaatccttgtccatcagtcagaagccctttgttcaatcctcatcacctaaaaaaacaaataaaaccccacctgtcttggttcagccacattactgcctccacagctacccagcaccttgcatctttttattacacgtattatcaagtattatctttattgtccatccattaatctatcttgattcatttccaaataaactgtatatttgtctcagtgttttaatgtagtgttcagtggtatttttctctgtgtaaagtttacatataataaaatacactaagcgtatgttcactgcgttttgctcttagcccaacccaaatctctctctagaaagagttcacatcctccacccacattatagacccacagtgaaccttagcatgcattgtctatcaaagctctctgatttccatgccttctctcctgtcaggagtgcttgctgcttttttcttagatgtgagtgctgaccttgctcctgcagagcgccttccattctgtagcagacaggcctgctaaagagtaaagtggagaagcagccgccccccgccccgccccgccccgcccgcctgtttccccaaggttgctttatctcagacggctcatctgtgcgtcccttctgtcctccatcttattgtttcgagtttgccagacgttatctgtatgcactgtcctggggattctgttgctgcggaggagcagaactggtggcccctgtgaaaaggagattctgaggctgcagactggagaagctttctcattggctgccacaggatgacgtgtgtacacattctctgacttagcctgtgaggtgcctcgattggacctgagggtggaacctcctgaggtggaagtcctgcctaaggtgggctcattccttcccggggctctatttataagctgcagagggaatctaagggattttatatcacctcccaccctaccttataaaattagttcaggtgggtggctagaaccatgaagttaaacaccaattatctaaatatacataggaggtaggaacagagggtcagaaaagaacccatgttctctaacttgaggattccaactgcaaagataaaaatggcagcagcctcctcgagtctgcagctgtcaggggctacctgagccctgacagctttcctagggggatccgccactctctttataagtgcttggtgctggagaagccactcccatattactttgtgggtttggttttggttttgagacaaagtgttactatgtgtcacaggctgcctctaactcatgctctcctgcctcagcatcccctggggagtgctgggattacaggtgtatacccctgactctggctatatataatccatgtattaaataagcaaatttgactctttcaactttcctcacaacctaccatcatgccgtctcagtacttgggcacaccctgctgcatttggagggaaacattagcatatttctaggtgttcctgggctcctattcaggctgtcccttctgtggcacgataggcttattctaaccatcctgtcatggcaactcaaggtcttccagcctgtgtccctttgctgatcggtcttccaggccaggcagagtcagaactttgttttttgttgactccataaacttcagctaatggtagtgttccattttcagttatttgtcccctcctggttggcagttggcctcatgctttccgttcctccagcaaggccccttagttctctgtgatttttgtggttctcttgggaaaggcagaatccttgtggagatcattaagctagtggtgtcaccaatgcacttggtcttcaggagtgtaaagaacctctagcatttgattcagatatgtagtttctgactttagcagtttgagtttgaagaaggagaccaggatccagcaactgctctgtgggctggaccattcttagattctagttgtggaaatcagagtgagaagagggatagctctatgaaagaaattgatgagctcggcttagctagaactctgttcttgtcttattgatctctgactctggcaagctaggccccagctcgttttctttgtctgagatcttgagtatatttccccatcaggtccgtggaggatgaggtggaaaaaaaggtaatatggaagaaattgttgtgtaagattattgggcctcttgctgggattccagccttgactctggtctctgagtaagctatttctaattaaaagtgtaaggaaacatttattcagggctggagaaatggctcggcggttaagagtacttattgctcttccagaggtcctgagttcaattcccagcaaccacatggtagctcatagccatctgtaatggggtctgatgccctcttttggtgtgtctgaagacagctacagtgtactcacataaaataaaaaaatgttaaaggaaacatttattcatttagcaattagatagcatagtagtttctccttgtcttcaagggataatttccaagatcctcagtgggtccctgggatcacagactctaaatttaaagtgtttctctgactaccctgcagctaatcagaattaatctgtctttccatgtcttttgttctggtatctgcttttctttgctgcatttgacacttgaagccatcaagtaaagcagtcattttcttaacaccgttgatctgataactgacacttaacagctgcgtagtagatgcagcatgactgtactggacagagtgattcctctctcaagcaggatggagcgagatttcatcgtactgctcagaaagttatgcagtttaacatgtatgatttgggccctggtgagatgctctagaggttaagagagcccttgctgctcttgcagagaaccaaacatcagttcccagcacccatatcaagcctgtaaccccagcttcaagtgacccagcacactctgctggcctctgcaggcacatcttaagactgtcccttcttcccatctctgaagaaaccattctagcgtaaatgaagttaatcctggcttagtggaatttagagcttttagtacatatctcttgtctcaggatttctattgctgtgataaaaacaccaggatcaaaagcaacctggaagaaaaggagctgtaaattccacaccacactccatcactaaggaaagtctgggcaggaacctgatggcaggagctgatggccaaggccttgaagtaatgctgctttctggcttatgtctcgtggtttgctcagcctgctttcttataacactcaggaccaccagctgcaggggaggtgtctcccacagtgggctggggcctcctacatcaattattaatcaagacagtacagacttgcctgactagtcttgtggaggcatttctcaagtgtgattccctcttaaataactctagcttgtgtcaagttgacttaaacctagccagtatatatccattctattttcctacctgtgcctccatcactaacttatatgacttaggtgatatcgtcttggggtagaacagggccctgtctcttctgaagaacttggtatcctttttaggctgctgttctgtgcatagggcaagtcctgtcctcagactgtaaggtcttctctgatagactctgggcttgatgacagacactgatttctccctctgtgagagaggcttctctttgttctgtaggaacccagaaaacattcttaagtacagtgctcccccagccacccactcacacttcaaactcaaaagctcagaaagcaacaagctgaaggaggaactctgtctggagctccctgtctgactaaaggatgttcacccagtagacaggagattaccagaggctcctttcttggggtctgagtgattaactcacagggaaaggaccccaaagtctgacaccttgccctaagaggtttgcggccagcatggcctgttcttctgagtggttctctaactgcacagcatggcaaccattgttcacacccagcgtttgtcccaccgccctcctgggggtctcctgcactcaggtggcccaggaccggaatcttcttgtcattccatccctagactccagactcctgctttgtctgtagcttagaatgctcgctccataagctcaaccacgtggcctttttactttgattcagtgtacttttatgttcataatttactactttcagtttattcctcagaatcagataccatccctctatatggctcacaaaacagaggcattatggtcatgccagctgcccacctggatgaagacattccctccaggccctccagtgagactacagagactcagttctgtaattttgctgtctcttgatctcaggacccaagtttcagctctccaaatgagctaactcacaaaacaacttcgattggatagactgaaaacatatgcacgcaggcttatggactaactattggttttctgactttaaaaacagccttccatctttgaagaactaagagtcttccctcggaccattagcttcaaagaaaaccagtgtggtcttgctctgctggttcttgtctggtgcctgaaggcatccataggacactcagaatttatagtgagtttcttcgctgaacacgggttatagttatacatattggagtagattcaggggctcgtcctcattttagttatgtataggcaagagttagttcttccgtctctctctctttccccatgtctctttggacctcctttttgtgtctcttttgaagttggaagtgccataaagatacattgagaacctcctttagaagcaaggctttgaggcagttgaccttgtaaaagaattccccttatcccctagagcccaacctgcaagccaagtggctttatgtctgttatactttgatcagactgctctttccagaggctctgaaagggctcaggttggaacaagaggccatcgttttctgtgacagccctctcataaagctttgtggttagagcaagtctgtgaaagttaaatatagaattctgtctgttggtgtttacctttcttcgttaaagaatacatctgctatctttaatctttgatcaggattgaaagacataaaggatatgagcgttcacaggtctgtagtgtctgtggcctggcctcataagaaagacttctgatgccactgagttccctggtgctcccagcactcttgagttccagctcaagtaagaaagtatcaggagctccacacttaagacagcatcctcttcatcctccgcccattttcttttcaaattttcttataggtgctttgtcggcgtgtgtctgcaccacgtcatccccagtgcccatggagaccagaggagggctttggatctcctcgaactggagtaacagacggttgtgagccaccatatgggtgctggcaattgaacctgggacttctagaagagccagtgcccttaactgctgagccatctctccaccctgttttcttacagagaattgctactgcattttctttcagatattttcagaatctcctgtgatttcctcattcagagtccagcaactccagccttgcctgccctcctcgtccttcaccttgctttcatgattctagactaattcaaatgcatgttttctgctattgatgccaagcagatttctgacctaaatggcatctagtgaggttgctccaatacatagatggcagcaaatgttttcttgtttgttctttgagaactaaaggtttgataactatacggaggcattttaaatgaatgagttggttctgggttgagagatgcatgataaagtcctaagtttcagggtaaagagcctttccatagcaggacagcagatggtctggttctgtctctttcgtgtccttagtcttaatctccttcttttttaaaccttatggttctagttccaaagacagagatggactgaaagcttcacaagaggacctgaagcaacgtgaacaggtgaagggtgaccctcccctggcctcagaattgtccctagcagctgcttagagaaaaatggttctggttgctttagaagtggctctttatcccttgatgggctgtgtatgaagaagggtatcagtgccattgtaaagcccctcaagaaaacagggccccttcttggcctataatcagtccactgagacccctgggtgttccctttatcctgtctataggaacatataatctgatggtcgccgagggctgccccttggcaggctgttctcatcctttacacggatggtgttggctttcagctgctttgcttgcaggaatcactctgacactaacactaatgacactgaagtctaaggattatttcccctatcagattgttcagcaccaagaaaggcaatgggaattaaagggatacagtgagaatgggtgaaagggaaattgcaaactcccctaagcagcagtaggaagcgaacagcacatctcagcacagtgctttgggcagaatgacctgtgttggatttggtactccattgcaaatgagaccaaaagtctgggtgaccagaggctgcagtgcttgcacctgctgtgccatctgctcaggagaggtatttcatattcagtggttgctttcactgtctcttttaaatacaccaggccacattgatcagggtatgaacttaccctctttggggcttagttgatagtgtttggccatgttggttttcctgaactagaccaagttttgctgtaagaggctgtacctcctaggcttttcatattgaaaggggaaagaccagattcaggccttaatcttgccactctaggagcaggaaacattcagagtgacccagagctggggctagagagctggcttggcggttaagagccctggatactcttctaggggtcctgcatgacggcaacagttgtgactctagttccaggggacccaaacaccctcttctgacttcagtgactaatacatgcatgtggttgcacagacatacacacaggcaaaacatctaatacataaaataaaaataaatcatttttaaaaagtattacagatttgtaagttacagtaagagtcataagaacagcctactgttgcaggatatttgatcacactatgaccctcaagattgtcatttactctaaaaacctgtatctagttgtggtgtggctcagcccttagcacacaccgttcatctcaaacaatgaaggtaaagttggtttgcagaaggaagcacccatgtttgaaagtgatgtctagttgagtggcaaaatgatgaatctgagaaagatgtgacagaataggagaagagagcagagagggaagctacctgaggggcagtgcagagaaagaccaggcagttttccaaggacagttaaagagagagacaagttagacacaggtaaagacagaacgagccagagaatgagcaggatcccaaagactaaaacatactgccaaagttagtctgaggtcaagcagcgcaattcagcgagaggcccagagagaagccagattcagtcaaggcagcttggagaggggtttgaggcagaacaactgccagagaaccagctagccagagctcagaaagaactagaaagggtgggtttattcagcagcaagtctcagaggctgaaaacattctaagcctagattagactgtacagaagctagaaacttccaggactgagcctaggttagcagactgaggcagtaagcctcagaggtgacaattacttcaggagaatcaaagttacatttgcagcctactgtctgagctgagtcagagtaggcattgaactccttatagataatgcagctacccttccctgttgtaaccttagcaccaagtgtctactaaatttcaaaaaggacagcctaataaaatctcagatgctgtggtatcagagaaggcagccgttttactttagtttgtgatgagatggctcacgtctcctgggaatcagttttctgccatcaaaagacactactctcttgaagtttgttttcaggtcttatttgatcttttcatttctagattgtaagaaatgttttgagccagaagtttgaggattttcttttactcaaagtaatagttggaaattgcataaatcaacttcaaactggacatagattttaagtggatagatttgtctcctccccgttctccaggctgactttgtttcctttatctctggaagtcacattgtgttccttcatgacatttctcctctgtgattgcagtttggataggattatgtgactaggtatcctgctttgattatttggttccatacagcaatatgagatgcctcttatcaatcaaaacagaacaagcagaacaccaggtgcacttgccatgaaacaacccaaaaagaaatggcagttctcagaatagtatcccaagtggggagttagagcagcaggactaggaactccaccctcctgtgctggacacaggacatcttcaaccgagaatgagagttcaagattttaaaagccaggcggggcgtggtggcgcacgcctttaatctcagcactcaggaggcagaggcaggcggatttctgagttcgaggccaaaaaaaaacgaaaataaataaataaacaaataaataaagattttaaaagatctctttattctctgtgctatctgaggttactagaatccttcaccatataaggaggaggttgctaaggaaagaagtggaaatctcattgtgatatcatcatccaagggatgctgatgatgtcagagcctgcactggagaactgacattcttttttttttttttttttttttctttcccttgagacagtgtttctctgtatagctcgggctgtcctggaactcactttgtagaccaggctggccttggactcagaaatctgcctgcctctgcctccggagtgctgggattaaaggcgtgcgccaccatgcctggctgagagctgacattcttgccagcattgttgtgacttgatattttgtatggactagatagatggcttgaaaaccttagaggtatgaggctgtaccccaatagaacaactcctccacaatttctttttctttttctttttcttttttttagatttatttattatatgtaagtacattgtagctgtcctcagacactccagaagagggcatcagatttcgttatggatggttgtgagccaccatatggttgctgggatttgaactcaggaccttcggaagagcattcggcgctcttaaccactgagctgtcttgccagccccacaatttctttttcatccacctttttttttttcccccacagaattaatctacttgccctcagcttgtttaaagagtttatctagttgggcatgatggcacataccagaaacaaagacaggtgggtcttgtgcgtttaaggccaaccagaacatatttgagaccttgttttgttttgtttagctgtgttagcttctgacctggctgagcttgctgctgagatgtgaggaattgatggcttctgttgtattttttttcaaatgaatctgtaagagaaattcagttacacccttgacaaaatgtaagcaagaaatggctttgttcttgctatgacgacgctacagcacagacaccctgcacacacggctgttcagtgacttcaaaagacttgaaacagtttaaagagctggctttgacagactgttccagctcatttgtaataacaagcttagaaccttatgtgtttaaaggcattttagaagggcaatgccttgaagtgtctcactggaacaacattaagcctagttggttagggtgtcagagttgatgctgtatacagcacagatttctcaaggcgtcttgaagaggtcccactgtctgtggttcatggtcaatactctgaccttttgctaaagttgagaattgctgaagggagatgaattatttataagagtcaattaaaagggaaaagtgaaacagtgcaaacacagtccatagcagcctgaactcattttgtcatctcttcgtatagcagtggtatacagccagagtcacaggggaagctcttgtacctgtggcagtatgctacttagtcaccgttgtcatcctcagagcatccctgtgagaatatctgtgctccaggagactgtagatggtaggcctgcaaggcacgagatgagaactcattcagtaagcatcctgggagaaaagtcccagggccctgactgtacccagtacagaggaggagagagcagcaatctccaagttagtagtccccatattcacgaaaagaagaattctgtattgtcgtaaaagtgatcacaaagtccagagaggagtgtgagaagggaagtcagtcagctaagcttaggtgtgggaactttgagttgaaacccaggacgggacctttagttccagcactgcagaggcagaggctcaaggccaaccttatctagagagagaattccagggcacatagaaatcttgtctcaaaaaaacaacacctcagaaccggtcaatggccctggttagcactgcatcatttttacatataactctccacagtgttcacctcacctgggtcggaagcagcaggtgcttgtccatcagtactgcccttcacatcctaagctttctgtgtcccctgcccccttatccacagctcggacagtttgatgtaaaacctactaagctttcttccccgcagtcaaggtgtactcttgactcgatatttcaaactcttctctggccttgctgctggtagttgcaaaactttatgtcaagacccagttagtggcgctggaaagatggctcaattgttaaaaacatgggctgttcttccagaggatcaaggttcaaatcccagtatccacatgaaagctagcagctatctgtaactccagttcagaggatccagcaccatcttctggcctctgcaggcaccaggcacccacatggaacacagagtcctaaaattggaagaaagtttagagggataaactggtatcctcagctcactctaggtgaggaaaatagaacctggtgcacagagcgaagcccaggccagccaatggaacagagtcataggatctgccccaagaagcgggagacaggtgggattggtaagagagggagagataggacagacagacagacaccaagatttgcccagacagtagttggggacattttctaaaagagtttgtatgctgtctattccctgcccatgctatgtgaaaatattggctcagtccccaactcttcagtcaggaggagggcggaagatgtgcgtgtgctgggtgagccagtttgtgtagacactgccaattttacccaattcccttcatttctgaccccacgtctacagtgtttgctttaggtgagtgtgatgttagagggctttaaaaagtacatggtgatggggctggagagatggctcagcagttaagagcactgtctgctcccagagaactggggttcagttcccagcaccccatatggcagctcacaaccatccttaacgtcagttccaggaaatctggtgcctgtttggacttgttcggcaccaggcctgcaggcagagcactcatacacataaactaaaaataagagatttgtaaaagatgctttgttagacttttgtgggctttttggctttgtttttcaagacagggtttcactgtagcctttgctctccaggacctcactctgtagaccaggctggccttaaactcagaaatccacctgcctctgcctcccgagtgctgggattaaaggtgtgtgccacagccacccaactgaatttaattttttaaaaaatataaagtataaagtctttcactttgatgtttcatactttagtccagttgtctagtaaccacaggcagggcaagagagtcaaacgttcaaagcctgtggagttcaaggccattctgtgtaagcctagtaactcggtgagaccctgcccacgggtttagagtgcagagctagctcggtaatagagcacattcctagtgtaggcaaggccttagttatgcccagcctccctcatgcatcctcagagctgtgcagaataattagccccaagactgagatcgtccattcaacacttggctttagtaggtgaaggtagagagcgtgctggtggttttgaaagtgaaagattcatcttatgaaatcattctggatactttgtgaaccccatgcatctggtttcacttggcaccatgtgtgtccactgatgtcaggagaaatgaacacttgtgagcacattgcaaaactgctctgcttcttggtccagggaaggacccactcctgttagccttctcctgataagggagaaaaatccagtagagaaggagagtgaggcgccctttaaccaaagggtttatgtctgctgggtggtacatgcctgtactctcagcatttgggaagtagagagaggcagaaggatcagtttatggtcatcattgctacatgagactaagtttgaggttggcctggactacaaaagaccccgtctcagaaaacaaagctcctccgccagtcggtggtggtggccagcagcctctgaggacgagcttacctttttgtttccctgtgaaagtacaagtttgctaaaggaggcacaatcttcatgtgctgcaattttaaaaaatttattttgtgactaagttgtgaatagaagttttcaccaaacctttgctgatgtttctgtagctctgaatttatgtcagttaagattaccatctttataatgtcagatcttatgcaagaatatataatgtccctttgtttagtggatgtctcaagagtgctgcaccttcctttttaagttacttactactagaaacatggtttcttctattatttttgtttctagctaatttattgctgacatagaagatgcaatttgataaatagatcttgtggtttacatgatataaaaaagcaattattatctcttcctttctaatgtctatattaaggtttcccctccttgacctgcagatcagtgcctccacagttatgttcaacaatggtttttccattgaatataaatttgctgtagggctggtgagatggctcagtgggtaagagtacccgactgctcttccgaaggtccggagttcaaatcccagcaaccacatggtggctcacaaccatctgtaacaagatctgatcccctctctggagtgtctgaagacagctacagtatacttacatataataaataaataaataaataaataaatctttaaaaaaaataaatttgctgtaatttttggtaaagatactcatattttttcaattaggtattcctcttcctattttattgagaattgtaaacataaaatagtaatgaattctactttgttttctgtatcaactgaaatcatcattttcccttccttggactgttggaaatataaggttttcttgtgtgctggctagtttcatgtcaatttgacacacactaagtcatcagagaggagggagcctcaggtgagaaaatgtctcataagatatggctataagcaattgtcttaattagaattagtgattgatggggggagagcccagtacattgtgggcggtgccatccctaggctggtggtccagggttctataagacatcaggctgagcaagcaccaatggcatctacatcagctcctgcctccaggttcctgccctgcttgagttcctgtcctgtcttcctttgatgatgaacagtgatatggaagccagataacctttctccccaactttctttttggtcatggtattttatcacagcaatagaagacaccttgtgtttggaggaaaactgcactttctgtgacttgtatgtcctcagtactgccattggggagcttttccatttgtgactagatggtaatattcacaaggccgtgattaccttcaaagaaagagaatccaacttctagtctccacccaagacagcagagagagatgctcatgtggccatcctgcctctagttttacactcccaccttcccctcctataatcagctgagtctatagagttggttctccctggataagccccccacacaagataaagaacagtgtcactaataatttgtatcatacctattctataacaaaatacctaaaacttaaaagtttaagccagtaacaatcactgtctcccaccagtatttaaaatcaggaaatgagcagctcagaggcctggggctttacagcttctatgaagcagttagatgtgactatcttcaaggcttcttcaggcacatgcctggtatcctctggggagactcatgaatggccagagttccttagcatctctgcttttgtgtaaggtttttttgttttttttgttttgttttgctttgtttttgttttttttgagacagagtttctctgtgtagccctggctgtcctggagctcactttgtagaccaggctggcctcgaactcagaaatccgcctgcctctgcctctgcgtctgcctcccaagtgctaggattaaaggtgtgcgccaccacgcccagcttgtgtaaattttttatgtgacttgttctgcctcaggggtgggtgtgggcacatatacacacacacacacacacacacacacaaacttggctagggttacaaaagaaccagggagctacagcaatttttaactatttattttgagacaagatttttatttatctatttttagagatacatacctgtcctcttaggatactgaggcaggaggatcacaaatttgagataaggctgagcaacttagcaaaaccctgtttgaagataaaattaaggccacagatgtggctcagtggcagagcccttatctgtcatgtgcaaggtttgggtttagtctccattactgtaaaaaacaaaactaaaggggataggaaatagataaatcagtaatagagaattttcatatcatgtaaaaggccctgggttcagtcctctacagcaccggaaagggagacttttcagtggtgtcttggagtttataagctgttaaaccatggtacaaaaagcaggatggtgtctccaagaacaggcaatgaaaaggggaaccagcagcatcagttgatttctagagcagccttcattctagactttcttattgtttcctcagggtattattcagcctgttcctctatacctcttatttacttatttttatacactgaatattaggttaggtgtaaatacttcattagtttcagtttgagtactttgggcagaagtaaaagtgctattgccatgcatatcatattgatcaggtgacggatgaagcacatgacaaacgccggggttccattattggttcctgtaaattgatcatttgattaagtgctgattgccagatcttgtaagggttcctttctcccattgcagtgagtcagccacttttacagacttaattggtggcttgcagatgacctgttctacaataatcaagtgactgatgatgatgatctaatgataaaacttgatgattggggtagtttgaatgaaaatggccctgttggctccaaaggactggcactattaagaggtgtgggcttgttggagtaggtgtggtctcggaaggtctggggataggctttgaggtttccattgttcaagccagacccagtgtctctctctcttcctgctgcctgccgatccagatgtagaactctcagctacctactctagcaccatgtcttcctgaatgccaccatggttcccaccatgatgataatggactaaacctctgaaactgtaagccagccccaattaaatgttttcttttataaaagttgctgtggttgtggtgtctcttcacagcaataaaacactaagatactggtcctctgagccagtgatttcttttttttttctttttcttttttctcttttggcttttcaagacagggtttctccatgtaacagcccaggtctcctgtactcactttgtagactaggctggcctggaactcacagagatctgcctgtctgtgcctcctaaaagccaccactgcccagctaaggcagtgatttctttactggttcatgtcagcagtcagtgtggtgctgtcctaggttttgcaaagatctgagtcctaaagcattgctgttcccaggtttgtgaataagagaccacaggaagaagaaacgctaaggtaactatgttaggtaagcgatgaaaagcttgtaaaagcacatactgggcattaacacagatgggcaaactctagacactcagaaggcacagagcgcagggaaaacgtcatggaaggactgaaccttgaggctctgaccagttttaggaggttaggagcagggaatgctgctcagtggcagagggccctaatgtgtccatttcttaacttagcttcattttactttataaaatgtatctaaggaatgaaacagaacaagtgcccaaggtactaagtgagatattgtttctattgctaaaaacctggggacagcttcatctgtatgtagcaaattaaactaaataactttcatgtcatagaatactatacagctgtttcttaagagatgaggtgggtcaggttgtagttgagttgatatcacgcttcctagcacatacagcgctgcataagtcagctgtagtggcccaaaaccgtgcaggtagaagaggggaatcaaaagttgccggtgattcttggctcatggcaagtttgacagcggtctgggctgaggtcctgtgaggaaggagagcagtagagaaaattcttttgcaggaggctaaggtgagttctggtccctgctaccattcctattcctgttgacgaattgatatgttttacccattgcagccaagcacagacctgtatggtcttactatattgtgacttgggtatatttgaggcccctgtcaccagctgccaattgggctgggattggggctggcatctgttctagaaactatcccattgcttctgtagctatagcctaccttcttgcaaaataataatacaaattataatactccagtgcagcgtgcaggcttggtctcctggacagccagtggacgagctttccttttcatgctgtagtctcctcctcccttggcatctttggggaaaatgtgctgcctatagatgcttcacccgtgtattatcttctgtgttttcttagtgtactgagagagatggggcttttccctggccctcttccccttagcttcattcagcagatgggtggaaacaagctaatatctgaagaaagccagtgggctctgagctgtctagaacaatgatttccactgctctcttgacagaggtgtgagcagttaattgattcaccttctccaagatttaacttgcattgaacaatgctaaggatggaaggctgaggaaaggagaaagagcaaacacccagtgtgtgtgagctatgtggatgtttagaacatgtggatgtgtggaccgtgtggttagctcagctcagaggttctcagttggtgagtcatgacctttggaaaacactgagacacagcttcagcaggaaaactacgtttatggaatagcaacgaaaataatttaaatttttatttattttgttttatgtgcattggtgttttgcctgaatggttgtctgtgtgaagtgtcagagcccctggaattggagttacagacatttgtgaactgccatgtgggtgctggaaattaacccgggtcctctgaaagatcagccagtgttcttaactgctgagccatttctcaggccttgcaatgaaaatagttgtgtggttggaggtcaccacagcatgaggaactgtattaaaggatcggtcgcagtgttaggaaggttgagaatcactgcctgctcaaaccaggcttctctgctctaccctgttcctgatcatcactctcactctgctccagccacacacacttgtgttgtttcactatttagcctgatccatgactgcagtccatgtcttcccttctggtttctacctctgaccacaaaccagctagctatttttccttttgtcagagtccccaaatttagtatgtctacaaccgcaccatcattgtcttccctgtccttccagcagcctgttcctctctgattccatcttcatgaaaaccaccaacaggtcttgtctgtcttaaaccataaagaggaatgcatctgctgaccctgtctgcgctcccaattcctcgaacttgagttgagacacagtctgtcgatatagaccttgctagcctcaaacttgtgaccctcagtcttccaagtgagtactgctgctacaggccaccacacctgccatcatctgtctatgctaacctatgtactttgctgctgcacaaagttattagtagatgccaaaaagcacagtaagcaggataaataattgttcagtcaagtcaaccagatgtcccttctggattctgagtctaccagatggcccactgggcaccaacccatggccccaatagcataggagaccttcatgtttacagggggtttcagggcagtgaagcctggttctttccatttataccaaacaacaacctgaatagtaacaactccttaactgctctacaagctttcagggtctgccagagtgattggtctgctgtgtgtgtgtgtgtgtgtgtgtgtgtgtgtgtgtgtgtgtgtaaaagagtttaatgttgggtgtttttctcaattgctcttcattttaatttttcagacctgtgtcccttctgaacctggagttaatattgattcttccaggcttgatggacatggaccagccatgtatgttagtacactgtagctgtcttcagatctcattatgggtggttgtgagccacaatgtggtttctgggatttgaactcaggaccttaggaagagcagtcagtgctcttacccactgagctatctctccagccccgtggttgtacatctttaatcccagcagagacaagtagacctctgtaggttcaaggctagcctaatctacatagtaagttttatgccagccagggctagagaatatctgtgtatcaaaacaaacaaaaaaactaagtccttagagtgcatcagaagtgtgcatctttgcatgtgtagtgtgggtgtgagcatgttactgtgtgcacattagggcagagatgaatatcgtgtgtctttcctaactactccccacctgatttctgagacaaggtttctccctggatctggagctcctcaagtcagctggttcaggctggctcgacagtgagtttcaggagcttcctgtgtgcttctggctccactcgatggactgagccatctctccagcctgcacacatggatcttgatgagtccctgaatcctgggacctcccgcatgccttttccctgtcaccaccccatcagataattgcggtcctgccttggaatagatctgcctgacttattcttgtacttaaaatgaggaaagccagtttgtgcttgtaagtctgcctccttgtttgtggagccagcgagcatattgcagtgtggtgctgacctttagttagtcctgcagtaatagtctgcactatgtgaatgaactatatacgttatccatttgctcttacactgcagctgcatagcctgaaactgcattgtataacagccgttcattctgtgggcatgtgaggaacagcttgcctctgtttcatgaagagaccagaaatcagctgagagtctaaaggcggcatcttgggatggtgtgaggtttgaatgagaatgtcccaccctccatgtatttgaataactggccccagctggtgggattgtttgtaaggatcaggaggagtggccttgttggaggtgtgtctcgggggtgactctgaggtttcaaaagcccacggattcccatttagctccctctgcctcttgcttatgggccaagatctaagctctgagctactcctccatccccatgcctgcctgctgccgtgttctctgccatgttccctgccatgatggtcatgagctctagctctgaaaccgggagctccaaatagactcttctgtaagttgccttggtcacgatgtcttatcacagcagtagaagagtaactgagacaggtggttcattcactcacatgcccggctctcagtagagacttctgcaaggcttgtcaacccatggtctctgtgtggtctagcttccttccagtgtgatggctagtggtgaaggcaaggttctaaagagctgagtagcagccatatcctttgtttgtctctgccctgtacagcatgactggtatattcttcatccgaatagttccaaggccactcaagcccaagggaagggacatagactccagcactaaatgaggggtgtcaggagttctggaagtgtgcgagagtaaaaacagtactgaggacattttgggacacattacactttgcagctgttggtaggtatagtattgtatgatgatgtcattcctttctgaggagccacattaaagaactcaactggccacctcaaggccttagttgctttttttttagactgcccttctttttaatgatgtctttcctatattaccacgatcctagccccaaagttcagtgtagccccactccttgtgctagcaccttgtcctggccctattataattcaggcagtgaggcgtgctttgccttttaattgttttcttgtgccctatcaagagctggagctccataaagcagctctttcctcccctgtgtgctgttcagtgtctttccttccctgagtctggcatgtagtaagctacagtggagtggagaaaatggacctagattttggtgtctgcatgctagagacagtgatctgtgtaccaaacacataggaactcctgtagccagtgaagtgttaaaacaggatgcaactttggattgtcttttctcttctataggttagaaatgtaaacataacagagtcctttaactggaagtagatggaagtagatggcccagtgcgcagcagtcctaggccctcgttgtgatgggaggaattgcagtgaagagggctgaaggggctccatctgagtccctctgcttttacactgagatgcagaagctatgttaagtccagtgattgccacataagccactagtcacaccattcccgtgtgtgaactgcaagaagaccaccttgctgtgacttacaggaagaagtgaggcatcttttttcagtgctcctgaccctacccctcagatcctatcttgttgggtaaaagaaagtatttttttaaattgagggagctgtgaaggtggcttaagggcccacagacaccagaagagggtgtcagaggccctggaactagagctagagatggctgtgagctgccattcgggtgctgggtatcaaacccagatcctctgtaagagcagtgatcttagccactgtgtcatctctccagcccccaagacttaaaatagttgtgtatagatgcatttttatttccttcctgcctgccttccttcctccctccctctccccccccctgtgtgtgtgtgtgtgtgtgtgtgtgtgtgtgtgtgtgtgtgtgagagagagagagagagagagagagagagagagagagagagagagttcttgttccttggcctttgtttttagatctgccactgtatgtgtattgagtccattgtttgtgtctgcttgcttgggaactcttgtactgtctcagtgtgcatgttctctgttgcaccaaccatggtctcccatggtgctgttctgggatgtcctacagtgtgctgtgacaaacatccactgtgtctgagaaataacccagaagtgacgttgctaggtcatatagacctttgtgggacctcttctaaggactcagatgtcactgtgtcccatttccccctggtttcctgtatggttacttcagatgtcccaactttaccctagatctggaattttgcagtgatagcaagaaaggctgggattttattctcttgtaggttttactgttttgacctactttgaactgttcaaatgcccgctgttccttctgttaattgtagagattcactctcctgtcctgagtttgtaacttgtttctgagtcctgtatggaggcagtaggtacagtggccaaatatagagtgaacatgctgatctgggcacacacttggcttctgtctgcgtgtgccagtctcgtccataagctggaaacaggcagacaggccacaggatgggtatcaagagtctacatgccagcatacaccaaatctgcccattctttccttcctgctgggagacaagaacagcacagcatgactatctagaagaaagagcacaatgctctaagtttaatggaacatttatggtggactcatgtctaggatttacttcaaaataatctggggcagggaaagtagctatggtgaacagtgtaaaatttgccatccagatttagacacatctaagactaaaggagagaactattcattgcactaggatagcaatccataaccagattgtcctagcaaaccaagatatgtatacctcaggcaagcatgagatgggcctgtcccggagttggtcattgttgaggctaggcggctagtacttggaagctcattctattttttgtttgaagatttccataatagaagagatttctaagatattttttagactgccacagtggctgtagtccccccaaaggagctatggagattgtgaagctggggatttagcccaatgggagagcattttctatacacaaggctctgggtttgatacctatatcttctctcaccacccccactccgttcccctttcaacctccaaaaatagtcccttttgctctgaaagtggttgttgggacccttgccagcccattaagagtagtaagcttaggtcatctctgctggctgcaccctgggcacctctagaagggcccctccacctgctcttgttgacaggaagaatgagaggctgcaggttgctctagcctaatgggattggttcagcctgcccggggaccaaccgcaacagttcccttcacaaacacaccactgtctggtagagatctgtacacaggcacatgcgattgttatctgtggcaggcaggaagcagtctgcagacagcgggctcttaaccgacattctgcggcgcgcgcacttccctgtcctacttacccctcgccctggtttcagcagttgctggaactgagaagttgaaggcagcctctgccggggtaaactccagcagtgggtgcacatacctgtagttggttagctctgtgcagtagtacacggttggtcctccttcatacggttccatgagaacttggcgtagtgcttctggaaacggatggatcctgagcccatcccaagagtcccaagaatctatgtataaggtctattcaccagataagcctaatccactgtggacatttctgttcagttccctaaggacacccattgattcaccaagagtagaaattatatttaattctctgctgtgtatcctactgttcaatatagagtaaatgtgaatggacagactgactgatttaatgcccatcctgagtttggccagcagttatgttttcattggtacctagagaatagaatgtactctgtgggtgtaaagattatactccaagtcctctctggaatcccgtcatctggtgtggtgtaagcggtggggtctgtgggaggtgcttggctttagataaggttgttacaatggagtcttgatcatggagttgtgcttttagacgagacagagtcaccagcactctctaccatgttaggacacaacaagaaggctgttgcctacaggccaggagtaaaacactacatctgctagcaccttgtatctttggcttgaaagtcaatagaactgtgagaaataaatatttgctctttaagctactggtggtccacagtatttagtcatagcaacccaaatggactgcgagagcccagataattttcagcaggaccaaagaatcccaattattccgctttgccttcttttctgagacagggtctcactctgtaaccctgtctgacctggaacttgccttagcctcaagtactgggattaaaggcgtacagcctcgagtcgggaggtgatgtgcctgatgctggcttcatttctcttgaacagagagaaagcatctgagcactggtgctgagtcgagatctgtctgtctgtctgggatgggtgctttttaattcttgccacatatttcaataagcagtatnnnnnnnnnnnnnnnnnnnnnnnnnnnnnnnnntacagattgcttgctttcagtaggagggccttggctttcttaaccttggctctgttgtcacaggaaagatttatgaggtatcctcatgttcccactaacatgttggagtcttttccaccagtctccttattcccaccctcaacttcctcattcttatctcccagagtcaagtaatctgagccagaggagaaacaatgaatactatgccttgcacaccctggtagagatcatgtgctattttagggatcttagaattggaggctctttttgtttgtgctatacccagggactctctaggaaatttcttttgaccctttagtcaatacctcaaaaaacactaggatatttccatgtagctgtgggtgacaggaaagcaataaggctgtgaggctggcactccctccctcttccatcctgtgtttttctctttaggtgccatttcaaaacccagtgtggccttgggaactatatcctgagtgtctgcctccatgtactccagggtgtaagtgcagccgagcggaggatgtgctgatgagaaggggccagggctaaagtcacgcaggaatccaaatgttcattgtttcttatgtgctagggcccaagcttcagctagtactttctgagaaatgaacagaggagtatgtgtttttataatctgggattatagggagcacctaggaagaaccttctagttgacttccagtgatgtgaaggccagggctggtgatatttacagatgttaagttgcacaatgcaggctagaaaagacggctcagtggttaagagcactgactgctcttccagaggttctgagttcagttcccagcaaccacatggtggctcacaaccatctgtaatgggatgcaatgcatttttctggtgtgtctgaagacagctacagtgtactcatataaataaaaataaatgaatctttttaaaaaaatgttgcacagtgcaaacaaatagttttattctatatgaatgatcatttgtgtttaagtattatggccatttgccaataagtccaatactaatcaagcattttctctcttgtcattgaaaaattctaatcatctaatggtgtggatcatgcctttagaaacccagaaatcagtccagtatgaattcttggtattattttttccctttcttgtctctttcttaactgaccttttttctccaaacacattcatgctctttctctcccgtccttcctccctccctctctttgtcccccctttcccatctcttactctctccccctccatcttcctttcccttattaaaaaaaggaaagctgggagctagaagatggcttagaggttaagagtactgactgctctccccagttcccaggactcacatggcagctcacaactgtgtaacacatacatatactacacacacacacacacacacacacacacacacacacacacacacacaccccacacacatatagggcaaaatgccaatacacatgtaataagtgaatttagaaaaaataaagaaacaaaacttggcatcccttggggagggggagctagttgaatattgggatcttgagctatatgaataaagaacactgggacttcatctctatccacagtgtggttccaagaccagtcagttttctttgggaagtttgctgaggatggttgctgtaaatggggctcagtttacatagccagtgtcttgctccaacactgccccctgaagctgcagaaagaaatgctctttccccttgtaatatagagacaacccgcaaatcatttggggctgataattgcacatttacatagacactagctttttccccccatgtttggttttgatttgtttgtttgttgttttctttctctctctctttttaagatttatttatttatttttatgtatatgagcacactgtagctgtcttctgacacaccagaagagagcatcagatctcattacagatggttgtgagccaccatgtggttgctgggatttgaactcagggcctctggaagagcagtcagtgctcttaaccactgagccatctctccagccctgtttctttttttcaagagctgtgtgtagctctggctgtcccagaactcactctctgcagagcagactgacctcaaactcagagatccacctgctgctgtctcctgagtgctagaactaaaggctgccacttctcccggttctggttcgggtttttaagaggcagtggtattggacttgcttcccatgacttatatttatcttgaacagtattctttggcattgcccagacactggaaagcccacacaagcagtggtgaggattgttgggtaccaggaacatggctgtgtggtgtgtggaggctgacatgggtatgacgagtgaggagggagaaggtagtgctcaggtcagtaagcatgtcagggctggatttatccatcgtaattgccttgcttgcttgtaggtaatccttggtgtctgggaactagaagaactcctggcttgatcctctggatactggacaatgtccctctttcaacagatggcccatcctttaaataagacatctccaaaatgcaagccaaatgctccccctggagaccttacacccacattttatgtgtaatggttgggattcctgtaaacttgtccaagcatgatgaccaggttatgagaaacgataaggcagtgttcatctttgccagtcattggaaacctgatctcacactcaggctaaggtttcattgtcttgtactgatcaggcgtgaatcaccacgttcttgtcccagctaccatcctttcctgctaagtagcccttcttcctccttgaagaaatgggttatttccaggaaagagccattagacagtggccagcctgagctcctgctgctggccagtgcttttcttggtcttcctgtgtctgcagtgctgccgtgacaaccaggatatacctctgtgtacactcttccccttgcttccgcgtgtagctatctgcaccgaacctgttctggtttgcagcaagtgaacaagaataactttactgggtataagattgagcatgtaacttaatactcattttcacatgtttgttgtatatacgtctcaaattttagcaactcaaaaaattaatgtatggtctggtgtggtggtttgtgcctttaatctcagcactcaggaggcagaggcaggcgatctctgagttccaggacagccagggctacataataataaagagaccctatttaaagaaaattttgttgttgttgttgtatgccacatagtcctttcctccactctgaggaaggctggtaatattgccttctgcaagtgatgaaatcagcccataatatactatagataaaattaattttaaaaataaataatttttctctacatgtacactgatgccatggcacatgtatggaagtcagggttacctcttaggagtaagttttctcttcctccgtgggatttgggactagaactcaggccattaggcctgcacagcaaaagcttttacccctcaaaccatctctccagcttcattttccttttttctttcttttctttttgtttgtttttgtttgtttagtttttcaagacaggatttctctgtgtatccctgactgtcctagaactagcttggtagacaaggctagcctcaaactcagagatctacctgcctctgccttctgaatgttgggattaaaggcgtgcaccactgcttcatatatgcactgcatcagtttcatatacccatgttcacatgaagaacttgtaagttttatcaaacaggtggatttaccagcgagtccccgccccagccggcatagtaagcagtaccagatacagccagaagggcagtggtcccgagggcactttgccttgccttcaggggctggtcacaagcttctatttggacccatacctgtgggcatcgtgcacagactgctcaacaaacattactgcgtggccacctgcaaagtacctgccagaagctgttttaggggttcatttgtttgtttgttttcctggctattggtcaggctctcttcccaagactagtatagaatccagaatagcaaaaaattatgtcagagagctgggcgtggtggcgcacgcctttaatcccagcactcgggaggcagaggcaggcggatttctgagtttgaggccagcctggtctacagagtgagttccaggacagccagggctatacagagaaaccctgtcttgaaaaaccaaaaaaaaaaaaaaaaaaaaaaaaaaatgtcagagaagtgtataatagataaaaattgggaatcttaacagaaaataactacacataatatgtcaacatctgaaagaggcgtggaaaatggcagggatgtagatattactggtttgggtgttaaagcaaggtatgctgtagcccaggctggctttgaacttgaagcaatccttcaactgcagccttctaagtgatgagattataggagtgagcctccgtattctgctaaatatgcatgtacctaaggaagaataggatgcctgaggagtctgtgatctatcttacctccttgacttccagtgccatctacttacttacttacttactggagccaagcaagaagcatgtaggcagggcccagaggacagtagaatgcagtgagggtggtgggctaaaagaggctatagaggaagagatagtgaccatacaagcaatgggaatgctaaaaggagacgctgtataagtcagagtaggctaggactaggtaatacggcaaactgtcctgtaagctcaggagctaggttgagcgcgtttactgtcttctggttagtagtatgcagtgccagtcaagagctgggactctgcccactcttggcaattgttactcagggacccaagctgacagaagctgcatctccctgttgattgcctgccatattataagtagcttggtgaatcatacattgactgactcttggagtctgcttgaatgtgagagtggactcaacaattcattgcctaatgaggatttcaaacctactcttaatttcaagaggaatacacaagttcagtactgctctgtactagaaaaccaggaataactgagtgatagcactcaggacttaccactagggaaatagtgaaagaaaagatagaaaatccatctaaaaaagacttgtgcctgcatactgaaagaaaggaaaaactgatgggaacacacacctatgcacatcctgatacacttctgaacccttaatggtgaaaagaaaagcctttcaaggttcaagcaagatgaacaaattatttacaaagaaaaaaaaataattaaatggaccccagattgcctgtttgcaatacctggaaggtagcagatggtgggatttcttctgtacatcactaagggttaaaggaattttttttttttttaatcttgtattcagaggaaggggctttgagctggtgtgaggattcggtgtgtgctttacccttccccgctggctttgtcttcccagtgcccagatgctttgctcttgcacttgaggtgcgtgtgcgtctgtgtgcaggggggcgtacgtgcggggtacatgtgtgtgtgggtacatgtggtagccagaggttgatgccagataatttcttcactcacttccccacctcatttctgagacaggcgctaactggccttggaactcactagttggctagactggttgactacgaagccccaagagaccttctgtctctacttccctggagatgagactgctggtgtgcacccttgcctggcttttcacatggatgctaaggacttgaatgcaggttctcatgcttgcacaacatgtgttttaccatttccctaacccttcctgattttctgaaacaacagcatctctctcactgtcttctctttcctgaaagtcttctacattgaagtccacatcatagtccactcctgacactttgtcccgcctgcatcaaagcagagggatgctgagcctgtgcacctcacttcatcctgatgtggccctccaggtgtcagcagcatgccagcactgcagttatgcttttgtttggttgtttgttttggttttgattttttttgggacagggtttctcttaaaattttgatcttcctgcctccacttcctaagtgccaagaatatagcattcgccaccacacctggtacaagatttttaattcaggtaaaatttagaaacaaaatcttgaatctgaagtgttaaatttgctacaatttgacagacacatattcatgtacagccttaaccctcctcttaatgcagagcgtcatcatcaccctggaaaactctcacatcaccttctccgtcaagctcggtcctacctcatccccgagagacgaccactgttgtgattcttctcataatctgttagtgtgttaagtcgctggcgagctttagtatgcagtcgtgttgcatgtgtcaggagttattagctgccactgctgagtgacttctcccattgcttgttgttaataaagctgtggcgtgtaatcttatgtatatctacttacggacaaatgctttcatttggtggccatgggcagaggaattgctttgatcataggctaggaatgtgttttataagaaatgtacctaccttttcccaaatggctgtcattccagcgtttgtttgtttgtttatttgtttttgttttttgagacagggtttctctctggctgtcctggaactcactgaagaccaggctggcctcgaactcagaaatctgcctgctctgcctcccaagtgctgagattaaaggcgtgcgccaccaccgcccagcattccagccttttatgttacagctgttccttattctcaccagcatttggtgatgtcagttttattatttggcatcttaatggacacatatattaccattctccaaagaatggaaactatgcacacatatgcatgcatacgtgcacatgtaaagggatataggaattaattgatataattatcgaggctgagaaatctcactgtcttatgtctgcaaactggaaatcagaacagccagtggggtttccagtaagcaccgtagcttccatctaaagcagaagtccagtcgtgccagcacatggagaacggaagccttacatttttcctctttgtgttgtattcaggcccttagctgacagaatgagacccactaactggagagggcagtctgctctgtagaccctacccagccttccagaatcacccaagataatatttagctaaatatctggggatcccatcagccacttacgttggcactcagtattcatatgcgcacacacgcaaacatacatgagggggttactcgtgagttctagaagtgtggagactaagtgcaaaagagacttgatgaaagaaaagagaattagaaggctgggtctttctatgcccagaatgttctttaggaggcatacctcagacttcagttcatcgattgatacactgtgcattgggtttttgagagggagaaggtgtggagagaaaatacatgtgtcttttgaaggaagtggaaactatatagaaatgtttggagcatccctcatggcacctttgccctgtttgtggtaaatcccacttagttggttcatggagctaagtcctgttttattgccaataagcatcacaggatgaggcaggaactggctagcagaggagaattagggtggtgccctgggcgctcccagctgagaggtgccacattattactcatgctacagacaggaggccctgcagggcatgcagctcccttcacctgggctgcctttgattcctccacccttaggtgatcccagagacaggcagaactggggcagccattaaaatagcgcatcagcatcaggagggtggggagagaaactggagcaacaagaagccagctcttggtcctgcccaggaaatcaggtcttaaaggagaaggtttcagtttgggaaaatgagaagtatatctgtgcccagagtgtggagactcttaacttagattgtagagtatatgggaggaggattcctgggagcactctaaaccagtcatccccatctttactctggtgctatcatcagactgaaaagcctgcttaccttgccccatgaagatgcttgcttgcttccttgcttgtttgcttgtttgtttgtttgtttgtttgtgtgtttgttttgagacaggctgtcttgtatgaaggcagacttgatttgtatgaagatgctttttaattcacatgacttagtaagctttcttgaggtcattcccccccccctttgttttgttttgttttgagacagggtttctctgtgtagccctggctgtcctcctggaactcactctgtagaccaggctggcctcgaactcagaaatcctcctgcctctgcctcccaagtgctaggattaaaggcatgcgccaccactgcccagcttcttgaagtcattcttggttcgcctgccagggatcctaacctaacattgtaagtgggctcccttgaccagcccagagcagacctcctgcatgtcaaaggattcccacttaaacagtgcacttgtacaaaggaggctgctgggctctggaggagcagtgctctctgtttttctggcttagaaagatagagattggggtttttattctctgttgactagtcgtcgtcccccttttttttgtacatgagtacagtgtacagtgtacatgagtacactgtcagtctctccaaacataccagaagagggcatctgatcccattacagatggttgtaagccacatgtaggtgctgaaatgaactgagaacctgtaaagagcagtcagtcatcttgctgagccatctctccagcccctttggttactcttgattgaatcttgtagcagtatttgtatgatagagccaccaaacacaaaatcaggccaaagcacattaatgcactccgtcctcatttgagacattaacagaagaggtcaagagactggctctgtaagccaccacctctgcctcagtgtgctgacaggagacaggctgcttagccagcaggttataactagtggcagtcacaagtgttgaggacaggagtgggagaagttctgtgagcacaggctgcccccacctccagaatcaaggagcatcttgaagagaccacctgggaaaataaagctgccactggaacagtgctgaggacagtgctgaggctctgaggaggcctgagaaagtcatggcctggccacctctgcagacttctggtgtgcaaggccgagttccattcagtacagacttccttccaaaatgggataaagattttcaacaagttttaacctttagatagttcataaatatcagtatttgtcattccatagggctgttggtgctgaatcaagactggaaagatacaagaaaagattggggcggtaaagaggtagagtccgtcttgctcatcggatgacctttcgggaaagaaggtggggacattagcctttcccctttagctctccagtttttctgtccctctcactgtgcctttacttccgtttgaaaggtaataagccagcatcgtatagcagtgctgtgggccccatgccaagaggactgtgctgattctggattcagatcttctatagtaacaaattcctagaaaaagtgtcatccatgtttagggattatctggaaccgtgggtgtgggcagggcagaaagtcggaagtgacttgaagacctgtgtctgtgttgtgcttgccgctgaccccttctcctgcgcttgtcagccagaggccacagcagcagctggctcgaggtcaagctggctgggggtcagctctgtctctttccggcgcagtgcatgttgaacaagttacttgggcttttcactgtttctgtgaagtagagtcagtgtactgcctgcctcttgatagtccttacaccgtgttataaagaagcagccatggaagacagcagctgtctatagaaatgactccgtaggtgtaaaataccgtttacctgttaccattgcaagtagagacctgtttccacattggcagtgtggaaagtacccgtgccctccttggtctgcgagttcgtctccttagttctcatccttcctcctcaatcgctgctgtagacctcgtgatgatgtcgtctcattcagtctttgcaagcatgcagtgaattcctcctccctttttttccagtaataaaactgaggagggcggggtatattattagccaaggtctcaagtctagaaaaccccattatgttgtccttctctgctcacaactgcatgttgaaatgtttggccttttatctctttctttaaaacaatgttgcaggataggcagaggcaggtagatctgtaagttcaaggccagcctagtctacatagcaaggactacacagtgagactctgcctcaaaaagggcagagggtggagagtaggctgagtagagagatggctcaatcagtggcttaatagcactagctgctctgacagaggatccaggtatgattcccaggggccatatggtagctcacagccatctgtaactccagttccagggaatctgctgcccccttctgacctccatgacaaccaagcatatatgtgccacacatacatatatgcaagtgacacctatgtaaatttaaaaatatatatattgtagatattcattaccaacatcaaactatgaaaattctaactgaaaacaaatagaagcgtgaaatctctacaccggtagttaatgctttatgttatggcagtgtatccaggccaggtaggtaagagtcattgtcaccaaagaaagagactgtgataaacaagaatggatgcagacaagtcaataacttttcaaagttgttggatctgtgatagaatttgcagggaaagaattgatctctttgaaactggtcaataatataaaatggaaaagatggaaatattaattcaactgtcttatcactgggcatgttcctcagtacattagcctgctagggcagggagaactctgtgtgtgtgtgtgtgtgtgtgagagagagagagagagagagagagagagagagagagaagttagctttccaccaggcagtagtgaccctagtctttaattctagcactcagtagacagaggcaagtagatctctgtgagttcaaggccagcctggtctataaattgagttccaggacagccagggctgttatacagaaaaaccttgtcttgaaaaacacaaaaacaaaagaagttagcttttcttaattagagttcaactcagaagatcctcaaccagagtttaccagtactgttgctatgctgaggaaaccctttgacgtataacaggccagattgtcctggaactaaggtagcagattgtggtggcctgtgttcgcccagcattggaaacggctgctttacttagcagcatttaggagccctctgaaaatcccccaccccaccttgcccctgctcactatatacttcttaaaggatatagctggcttagtttcaggacacaaaggatgcttgggtgaaggatgaagtagctgggtgaggaggtgagggatggaggtgcaatgtcagtaatgactccttcccttgggaggaaacaaaaggtgttaagctgagacttaaatattactcagctgccttggcttgctgcttccctagtgttgtctactagactccattgaaaatcaagtcagcaactctgttaaatggcgtggggcagagcgccctcttgaaagatgacagctgtggaaaaaggtaaaatctcaacgagtgaaggacagattgatctctgctctgtctacattgtccctgtcccgagcgctgactccatgtagcgtcctggttgatgagattgtcgacgcatcgatggctgggggaaggtagctcatgctgtgtcctctctcctaggtttcaagtgccccatttgttccaagtctgtggcttccgatgagatggaaatgcactttataatgtgtctgagcaagcctcgcctgtcctacaatggtaagggctatctgtcatgtctgcttcctggtgtcgagatgggttggacagctgggggcatagcctttggtgagggggctctgttgttttcttttagcagcactgtgcatgtgcatgtgaggaaccttctgttcttgagagccttggtaattattagttgggtggggtagctgaggagaagccaagaaggcaagtcctaggccagggctactgtggtgagaaggctctcggctgctctatgccttcagtggcctttggtggggagacatagccattctttcccctgttcatggtaggttccaagacaaatgaactcactctacaaagccatcaagaggggcctagacagaatatcatctcagtgggcaaggaaaaccatggtgctggtggtacccgcagggaactgggggcctggccctttcctgtttaccttgcagctcaggtggacacacctggttaagcagtaaagcacccatgtgacagcagttggaaggaatacattcaatctgtacattgctttggagattagtgctagagggtctccatgttccaccatgggatggggaggggagaaaggcagacttgtgtatgaatctagcacaaatgtgatcatagcatctgggggaccccgtgacactgttactctagcatgtttctggggataaagttgagtggcagatctatttgctgtaggtaagtgtctggagttgagatgatcagaggtcagtcttcctctgctgttcactgtagcttagacaggtggtttagctagtccagccttagttttctggcccatacaataaggatagccatctttgcacacaaaacccactagcacagagctttgcacatggtggtatttaggaaattacagctgccgtggaaaacacaaggctcccagaggatagtccgtccgacttgatggtgtgcagactctgctgccagtcctctgctttccactcgctcatgtctgtctgtctgtctgtcggctctcctgacagtgattgctagggaactgtgttctctgcaaggtcagcagtgtccagaaggatgccctcaacgccagtaagccagccaccttctcgggttaaaggtgaagcaggcctaggaaagtgtgcttgttctgaaagtctgaggatgctctcttgccaccagaggtgtcctagatcacagcatcagcctagggagggctcatgactcccagacaacctgaaaaataaatcagacatgtctaacctgcttgattctcttaaaaaacatcctatcagtggtggcacatccctttaatcccagcacttgggaggcagaggcagaggcaggtgaatttctgagttcgaggccagcctggtctacagagtgagttccaggacagccagagctacacagagaaaccctgtctcggaaaaaaaaaaaaacaaaaaacccatatcacaggttgagtagatccgacattaaaatctcatggccagagatgttttagattttagagtttttcaaatctttgaacatttgtataggtataaacggttagacatctctaatgtgaaaaatataaacttttttaatatcatgtccctagttggaaatgtcaagggctagaggtgcggctcattggtggaatgcttgcttagcatgcacaaggccctgggttccattccagcacctcctaccccgtgttttagacttgagatcctaaaatagaatccagggccttgtaaaatatactttaaaataaaatagattttatagattttagatctttgcaacaagatttgtgttcttacatcccttgcctggccagaggatcccagttgcaggagggcatgtgtctatcgtggtctgtgtggcctgcagacctctgcatgtgccagagggcagggcaggctatggctctgtctttcctcttagtgatcccctttcttccccagcagtctttgctttttccctgtgactgccatcctcctgggtccgttgtccctgcttcagctagcctgtccttgctcaagctcagctttgtccctgtctctgcctgggactgaagggagaggtcctgtgtctcatagtttacggcagtcatggcttcaaatactgcatttacttctgtcccacatgtgttgagaccttatgaagactgttttgtcctgtgggttgctggttgagctctctgcagacactgcctttgctgttgtagcacaaagaagcttcagagggggcttggcctgagagaacttggctttcagagtctctggggagaactttgcagtaatgtctatggcagacaaagtgctgtcaggaccacccgaaacaaagtcacttcgtaagctaagttagggtttctgttgctgtcaggagacatcatgaccacagcagttcctataacagaaatcatttaattggggctggctaacagttttagaggcttagtccattatcatcatagtgggaaacatggtggaatacaagcaaacatgctgatggaggagaagctaagagttctacatgtggattagtagacagttggaagagaatgaatcacacttcttccaacaaggccatatgtcctcatggtgccattccctatggacctataggggccatttttattcaaaacaccacacttgtatccataaagcataaagtccaacttcaaaagttcccaaagtctatcacaatatcagcacaatatcagtccaaaatttaaagtctcttctgagactcatgtaatctcttttaactgtaatctcttataaagtgaaaatcaaaatacagatcatttattttcaacataaaatggcacattaccattccaaaagggtgaagactgctggacaaagacagaagccagctaggcagactccaaaccctacatctccatgtctgatgttagagcgctcttcagatctccaactctcttcatctttgttgacagcagcacactccttctcctgggctagttccaccctgttagcggctttgctcagcaggtatcccacagctctgacatctgcaacatttggggatttccaaggcaatccaggcttcatcttcatagcttcacactgtggcctctctgggccttcatgtatggacaccccggcacatgtctggcctcagtggctttctttaatcacagagggagatgctgtaacctcctccttctgtccttgactctaacgccagaaccacgtgactgaagttgccaggttctgctgctggctgtgactggaacaattacatcttcatgagctttctgttttccatagttttctaaactacttaagcctggctgaccagggtggccttgaatttagagatcggcaagcctctgccttctgccttctgggattaaaggtgtgtaccaccaccactcctagacctaaaccactctttagttgggtgaggtcttgctctgaggtcaccacttctcttattccatttaatatcaggctttcctttaatggattcatctccttgaacacaggatttagctccattctatttcctggtgcccctttctccttgaactgtgtatattgtattttttttccttgctcagtttgtctcttttcattatagatcttcttcataacagtgaacgctaataaccacacaacagtcgataccaggctgtattggactttcctctgccaagcaactaatccaaaacttccatttactcaggcagactttttagacaagggcagaaagcagccacattcttagccaaaatagcactagaatggcctcgagcccacatgctaacattcttctcctctgaaactcttgagccagacccccatagtccaaatcctcctagcaccactgtcttctaggcttctactcggataacccactaagctccacttaaagcattcaactgtgtttctaatccaaagttgtaaagtccatgcgcctgcaaacttaagttcaccggaggagactgaatcacttcctccacacctcctgatagtgccactccctgtggtcctatggtgaccattgttattcatagaagcacccatgctgatgtaggaaatggacatcaaggatctctagcccctccctttcccagagaacccggtcttccttcatattctctctctcaccagcaacctggaaaaggtcccctagagcagcggttctcatccttcctaatgctgagaccttttaacacagcccatgttgtggtgaccccagtcttaaattatctctgttactacttcatagctcctaatttgctcactattaattataatgtaaatactgggtatgcaagatggttttagacaacccctgtgaaagggccatttgaccccaagtgggtctggatccatagggtagaggaagagcagggtggccatctcagcagagccactgtggctctccctctgctccttactctttcttcatcctttacgtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcctcctcctcctcctcctcttcctcctcctcctcttcctcctcctccctttcctctcctttttttttctgaagacactagaggtaagaggacattgtggcctgagtccttaggacatgtcttgaattcaaatagaatgtgaattcttggatccttacgtatttagaaaaaaaaaatgtgagcctaaaaagatgggtcaagtttggatgctcttcaggggccctggattagctccctagcacccacatgccagctcacagtcatctctaagtccagtttcaagggatctaatgctttctcccttccatagtaccagaaacacctgtggtacagacatacatatgtaaaataagtacacacataaataaatttttaaaataaaaattgtaaaagaaaaatgtgaggagatacctggcaataagccatcagctcttggagtctttctaggaaggagcaacaggaggctttcttcagtgctggtgaagttctgtttcttccagggtctggaaggttgactcaggagtgtttgttctttgccaaggccctggtttaattctcagcactcacaagaagggttgccacctcctcgaagagcaggcacacatgaagtgcacaggcatgcgggcaaaacactcatacacacaaaataataaaatgaatgtaaaacaatgttttgaagtgactggagggcagagcggcttgaggtagcgtgcatgcccatctgtgagggtctgtgtgagcatgcccatctgtgagggcctgtgtgagcatgcccatctgtgagggcctgtgtgagcatgcccatctgtgagggtctgtgtgagcatgcccatctgtgagggtctgtgtgagcatgcccatctgtgagggtctgtgtgagcatgcccatctgtgagggtctgtgtgagcatgcccatctgtgagggtctgtgtgagcatgcccatctgtgtaagggtctgtgtgagcatgcccatctgtgtgagggcctgctccctttctagtggggagagcgcatgatggggagctcgggggacatgtgcgctctggaacctcctggtctctgccctgcacacacacattcacatgctcaccgtctatgcttgctggcaccagggaaaatatggataaaatttatgatggttatgtaagatgaaatttagttaaattagaaagaaaaaagtagaaagctccaagtgaggcagatagaaagcagtatttttcttagtctgagggttggtctgagggaagggctggacaaggcctccagtatttgcctaccagattatttttaaaatttagggaaagcaagaccagttttactggtccaaccagtgttcagaaacaaagagaacagactcctggtgcatcaagggcttggccagggaggtcagtgaccagcagagcaccagccattagctctcagccttctcagccttccttggccaccttgaactaaggcctaccagaagctgagggagggcgctacagagaagagaggaggaggaaggagctctctgtgtaaatgtggttggctttatcacttctctctctgtaaaatctgtggccatcgtattgcccaacctcctgaggtggagggaggtatgactgacttttttagcaaaagaactctgtggccaggtggtggtggcacacacttttagtcccagccccctggaggggcaggtaggtctctaggttcaaggacagccagggctccacagagaaaccctgtctcagatagatagatagatagatagatagatagatagatagatagatagatagatagatagatagatagatagatagataaaatttaaaaaacaaaacaaacaacaacaacaaaagcagaaaagaagagcgctctgaagccatagagtggactggaagctcaggggtgttgttccaggcatgttctggtgaggcaggagtttccctgtggcatccaggacattgagtagatttccccgagttctgttctggggtgcagggcttttgctttatgatgttttccctcctctaccaaggggcattcattactctttcttcagagccctggaagtgcactgtgtgagctcctgcatgcctgcctgcctccctccctcctttcttcccttcctccttttatttattatgagtgcctgtgcttgggtctgctccttcatgtgtgtgtgcatacacatgctcaagggcatgctcacactggaggcgggggggagcattgtacataagtggaagccagaagacaacgtagtgcggattaggtggatttcagagattggctctgaagcaagttatacactatgccatcttggcaacccaacgtgctttcttgaatggggtggcacatgtgtgtacgtgtgggcacatgtagaggccagaattcagcatcacttttctcctttaatctttttttagcctttgtgtgtgtgtgtgtgtgtgtgtgtgtgtgtgtgtgtgtgtgtgtgtgtgtgtgtgtttgtgtgtgtgtgtgtgtttatggtgtatggtctgcctgtgtgtgtatacgtgctggtttggaatctaggaaacaacaatgaagggctatagtctgaaagttcatgtcaccggtgagatgtcccagagaatggagaagaaatggccaaggatgtctccaggataactctatctgtagactaagcaagttttcttcccatccctgttgagggttttatcctctgatgtgttatgtgaagagcatcaggcatatcaaagttgaaagcctgttccctaactgtgagccccgtcccctgggccctgcattgtacattatgcagtatatctcctttctctagtcacatccattttacccttcgaatacattctcaagtaaaatgcaaattcctgctgtcttagtcagtggtctcgtgctgtgaagagaaaccatgaccatagcaactcttgtgaagggaaacatttaattggggatggtttttagtttcagaaaccatttagtccaggaggcattgtgtgtcatagacatacagacaaggtactagagaggtagctgagagttctacatctgaatggtcagcagcaggaaaagagagacattgggcctcgcttgtttgacacccccagtgacacttcctccaataaggctgtatcgtccttaatacctgtcaaggacaccactccctaatgattaaacatctaaatatatgagcctatcagaggcgtattcaaaccaccacatcggtgcacttctttcttgtttatttattaggtttttttgaaacagggtcttactttgtagcccaggttgtcttggaactcactctgtaaaccagactggcctgactcacagagatcctcctacctcctcctgggttctgggattggaggcttgcattgccgtgcctggcttgtataaagtagtatgtgctcaaacatttacaagacaaaagagcacaaatgtgctttgcttctaatcctccttcctttcactttagaggtatacttttatagattttttttccttgcatgcacaaacaggtatgtatggtgtgtcgtgctttaaagggatgggactggccactttagggtgttcctccgcttcttatgttcatgctgccctttttactgtacccttggcctagctaagtgttcaaggagaaagtgatgaccacaagttgtcctaatgtcctgtaaaccaagtgacttctcttacaactcctacaaacaggaacttcaatatcaatatcagattttatgtgttttattccatttccctgggattctttttgttttgctttgttttttgtttttgtttttttccgagacagggtttctctggctgtcctgaaactcactttgtagaccgggctggcctcaaacttccctgggattcttagcagggaaatttgagtcactaggccctcctagcctattaataatccatattttatgagtacttaagagttttaccaccaaataatcaggacacaaagaagcaacagtgggaagtgaggtcaccagaacaaaggtcccgtctttcacaacccttctcaagccccctgacagggcaagccacgtgacttctctgggtttccctttcgtcattcacacatgataccatgtgccctgctagcttgtaagctctttcagctcaaagaaaaccatatacacagaatcccattatgctcactggatggatgttctgctatggtcagggaacttcgtggtgattctgtgtgagggcattaccgtgcctgcctgtgactttattggagtttaatctaaactttgtccttgaacagtctctttattctactgtctgtacatgtccctacatctagactaaagtgagattccccacatctggaagtttccattggtatgtccctatggagaaacctaatagacacctctgggatttatcgctctctagccttgccttttcctgtggagtgtcatatgatataaccatgctaatgccctacccttgttggcacgcgtgccgttgctacatggtcagggttggcctctaagtgagctcttcaatctacctctagtgcctcttaactaagcaaaggagactgaggttctgtgacagcaacagcataaagcagctcctggggacttggtttcacccctgcctgtgtgactccttgagtctctgcaacctgtcttagcagacttcctgaagttcccaggtgtctggggttgtttccattgtctagattgtcatccctcctacccgagcctatggctcgtgtcattgtgaagttctccaaagtgttctttctctctctctctctctctctctctctctctcatacataaaataaataactcttgtaaaaaatgttagtgggtttactgtcgctgtcttcagacacaccagacaagggcattagatcctattacagatggttaggagccaccatgtggttgctgggaattgaactcagggcctgtggaagagcagtcagtgctcttaaccactgagccatctctccagccccccaaagcctctcttgaacagtctaaataagcacttttctccatgcccctcattccaggcttctaagtcagtcagaaggctcttctaattattgcacatttctcccattgctgttccacgtgtactatgtgttccaaacacactgtggtttaggtctgcaagtagctcataggtagtagacctatgtgtgctctgtgccgctcagctgctggtgattaaccttattggtatccctgtctctcttgcagatgatgtgctgactaaagatgcgggtgagtgtgtgatctgcctggaggagctgcttcagggggacacgatagccaggctgccttgcctgtgcatctatcacaaaaggtacaagggcctggcaggaacaactctgccaaatcccatatataatgaatagatccccttcaccagtcatccagtcctcttgggttatggtatggcctgtattgtatactctttgcactctgttagggggcgggcatctactatgctgactggaaggctcagtcatagcaagggtagagcagaagtcaattgttcaaggttcaactctgagtcggcagttcagatgatgggagccggtggctagacctggcttggaggtctattagatcccacctggagcttgactccctcctccctgaaccctgtcatgcagagagaggtatcgagggtagagctggtgtccttgctggcctgtgtggcaccctcctcttccaagggctaggggggctgggcgtggtggcgcacgcctttaatcccagcacttgggagacagaggcaggtggatttctgagttcgaggccagcctggtctacagagtgagttccaggacagccagggctatacagagaaaccctgtctgaaaaaaaccaaaagaaaaaacaaaacaaaacaaaacaagggctaggaggcaggaaaagccgctacctctaagtaccaagagctgctataattagccaggccaagatctgtcctctgcctccagtggtacccttcaactttttcctacctggaaagaagacacctccttgttcaggtcaggagtgtgccctgtgtgtctctttctccagcccacactgtttcctggcacaaggactttcctaagcccaaccccaggactactggtcttcagtgtcagagctgtgcctggagtgtgattggccttgggagaactgtggttcttggtctggcacagatccctgcaacatctcaggaagccactaaccaaagccaggaaaggaaagccccggccctggggagacctaagcagattatgtttagttactctttgaaaatacccagatgtggctttacagtgtcttaggttgcctgctgtttattctttgttacagacactcctatgaacactggagattatggtcttactataccctcaccctggttcatgctcacttatttagcaatgtcaaagagcccaagggtgcagctccccttcctactgttatatctaggctaggtagacttgtggctcctgagaagggtaccctcatcatccaagatctagccaccctcatcactggccagcctcttgtatctagtcctgcttcctgcctctcagaccttacagacagttaacctgctgccctatgtagtccacctgccacctccttagtattatctgttgctgtcctgtgctccctgtgccccagctttgagcttcacaaggccagttttgccctttctgcaaggcccagcctcccagagcctgtacctactgctcctgtctcctgctgaaccaggatcgatgttttagttttccttttcatttatttttattttattaatttttatagttattcattatttagtttattaggtatttttgtttgtttttttgagacagggtttctctgtgtagccctggctgtcctggaactcactttgtagaccaggctggcctggaactcactctgtagaccaggctggcctcgaactcagaaatccacctgcctctgcctcccaagcactgggattaaaagcgtgcgccaccattgcctggcccagcttatttttaaattttatgtgcatgggtattttgcccgctgagaccagaacagagcattgaatccccaggaccaggagttaaagatgtttgtgagccactgtttgggtgctaagaactgaacctggctcttgtataaaaacagctaggactctcaactactgagccctggggttattaatcccaaacctgagctcaggattattcttttttattaattttaagttatgggtatgtgtgtgcatctatgtatatgtgcatcagaatgcaggagcctacaaaggccagaggggtgagatctctggatttatgggatggctgtgaagcagcagacaggtggtgtgaaccagacttgggtcctctgggaagcagcatctctctcaaaccactgactcaagctcccgtctgccctcccacccttaggatatcgttgttgatcatcttcctttttctgcttcaatgaattgggggcataatcatgtttccctggggtcgtttcaggagagatttagaaagcctttcctgagaaccccttgaaaggctcccttggcaggaacagtgttgttagcagctaatgtgtttccccttgatgccccactccagctgcatagactcatggtttgaagtgaacagatcttgtccagagcaccctgctgactgaccctgctgggcctgcttgccgactcctctcaaaggtgagcccatacttggcgggagactctgggctaagagtcaagtttctgggagctgggggagaggagctggcctgcctgatacacaccccaccaaggagaaagcagaagcagaaagacagaagccatctcctcagagagcagtccccaggaagtagggggatgttcctgggagttgggggagcatgaaagagcgatagtaacctagtcatgagaactccatgcaaagatagaaccaggctccttcccctcaggagaggcagaaggtcccctgcagggtgcatgggctggagcagaggcgcccccagccaggctctacagcagcctcacctccctcacctctcagagactcggttctgaaagggaagaatcactaagtagtggcctgtggaacagacattgtccactgcaaagacatggcctgaggtctttccactcctggttcttccaccggcctgagaggtccaggccacactcagtccttgtgtcccaggcacagtgtcacagcagcaggctactccctcccacacacgcacttctggtgctgtgtaaccattggatctgaccttcatttcttccccagggtaccttgtttaactgcccctatcccgcccccaccctgcctgtgcctttgaggactgtgttgggtgttctctctcttttgttttgtttagtttgtttttgtcccatccaactgaaaaccatcagccccttcccacttgatcccacatccaaaggcttggggatcccttttcttctctctcttctttgttgttttttcttttgttaggtttattttatttattccaagtaaatgcccagaacagctgctggtgtcaggcaaatcagggacattggctctttctaccctcacctcaaaacctgatgccaagcgagggagagtgaggcagagggactggatcccagctccagagtgcaggtccagaatgccgccgccggcatgatgtttggcttccaatgggcctgcctggactgaaccagatgccccagccaaccagcctggtctcagggggacacaagctgctgccaccgtgcgatggagcggcaactctcagcaagatgaagcgggactgacttcttccgacccacacagggacagccagcccctgttcctgggaggaggctcctcggacactggacagagctgagcttgggacaccagagagaacagggcacccttctgcactgacttccagaaaatggtcctccctgaggacacccagtggatgagagaagaatgaattgacctctatccttcccctcaccctcgacccaggagggaaagggcattttctttttcacctttgaaaggcgttgtgggtctgtctttaaaaagtgtttacaaacaacaaaaaattctataaaaaagtcttgtgtcgactggtgttttcccttgtgatgtttacagcctgctgtttgctgcccagctaaaaaccactcatgacagaagcaagcatagccatgtcctgaccctagcgctctgatggcaggtgggcaggcgggcacacgttagtccctctgcccagcgccccagttggctctctgcatcactaacctttctacctttggggattcgttttttttgttttcttgttcttctgtcccatttttctggcttggttttgcacttttctccccttaaatttccttgatttcccatttccccttgatttccttgccaaaaaagaggaagatgaagagcccatcgtggacacttgccctcccccagccccgagtctcccctgcctttcctcctggatctgatcccatcagaggatttaataatcacaaatacactgaaaaaaaaaaaatgcctggacatttttccaaggcccctgtgatttttttttccccctgaggaaatttagacttagctaaaggactgtgtgctgcaacccccattttcaggcgcacggaaatattttagccattcacacatgacatcagcccatgcaggataggtttctgtatttatatattaaaatccaaaaaaaaaaaaaaattacaaaaatgttttaaaactgttcaaagcttaggagaaaagcttatcagtcaaggtgttttgatatggtattaaaatagtgtgtaacaaaagatgcaccgtgtgatttattttaatgaagtgttgttacacaatcaaggtggaaggcaaatgccagttccctctgtccacctctcagcccacaccccctccctcagcacctgtaatggcttagccactcctgggcagaggctctacatagtggctcggctgtgtctttgaagtttataaattcttaagcatcatggagtgattgtcagtcttctgtcatctctggttgtgataggatgctactggaatgatattcaggggcaaagctcttacagccaccagaggatacaggcacctggagatgccagcccagtccgtttgcttttcagagcctctgcccccctccctaccctctgcttgcctgttgctccgtgcagagccaagtgctgactcatgggcatgcttctctgaggccccggaaaaggccctgctctgggcttcttccagctcacagtccttgaaccagaaccagccactcagcctcatacaagttagcaaattgcaggctgggcaggaaacctcggggcagagcagcagtgcatacctgcctgtcttctagccaggctccaggagctgcatttcagggcctcctgcagagccagctaagggaagctctggagggagatggcaccacctctctaccatgaccatttccagacctgccccttgtactgctgtgtcagggcccagtcccagcaggcccacaagtttggactatgctaccacccttgccctcagatgcgtcctgaagcaattgctctgtgcaaggacatgtgttggaggccagtgggcatgtgggcaccaaggcagggaggcaagttcagagaactaagagtgctttatttagagcctgagtgtcagacgcctcaggacctgaactgtaagcactgtcaatggccagaaactgggctcttgtctgtactggggcactttacttcttggtggaaccgtgaactcgatcccttgcatgtgaagtggggacagggtcatgcggctcggttcagtttgtgtcggggatctgccccaaaggcctggcacatgcgcagcaggcttccttgtagctatgtcactgcaaagggcactgttctattcccagcacctccagcttctgcctggcacctgtgtctccccgttctatatataatcctaccagcagagctggcgggccagggcccagcccgcaaagagatctccttgtctgacccccgggcctggagacaggctttgtgtgcccaccttggctgtgtgagctcggctgccctggcagtgctgtggctgagtcccgtggttgagttggttggggcggcgctgagccccacaccgggtgctattctaggctctctaggctggtgctcatcccatccccagtgacttccgcccccacctggcacaccaaagccctctgttggctgtcatgtcctctgaatttggacccagattgccagtgcctggtgtgaggggtgggtgggactgggcttgtctgggcttcccaaggtggcacttgtgtgtgtcaccttttatccagacagccctccagaatcctgtgttgttcgttcctactctgcctttctgagaaggaagaaaatccggaagagccaagggatgggttcttccccttagctctgaggagcccagaaagccttctgagagctccaggagccccttttgaaaaccacccatctaagccatttaatagtattgaaactcataggagaatgtcctccttaggagacagtggctgaaatatatagttgaatgatttcaagaaatgtataatctaatcccatatggtctcccctcccccaaaatatacaaagcaaataaggcaaaaatgtccattgttgaatcttcaacgactgatatttcagtgaatatagtgtatttgttctttcaactttttctgtatgtttgggattttctttaataaaagaaattgtggggaaatggctgtgtattgagtttcccattattggagggtgtatgtaggagccctgcccagtggaactcaacttgggaggacttgaggtgaacagactgtctgggggtgaggggggttcactggcgatatttctcaatggtgaattcgggactggtgtttgggtttcttcatcctgaagtagtttgggagcaagccaaagaatcatgagacagacctgaagttggactaagaaagtgtcagggtggggggcaggaggctgcttcttccttttttttttccaacccaagtacctagcagtagagaagatggtactacagttgactgggacccacaagggtaaaatgcctagagactggccaccctaaaagtgtctgctaggtttctggtgttgcgcgccctctcgtggacttctggggaacaactgcaagtacctccagaccagggctctgaccagggagtctcaaaactgccaggccccaaagtaggcaagaccctgactttgaaagtaagcgctggtggatagagctttataccatggatagggatgggacacagtaggttagttcatctgtatttctattgtccaccataacagcttgaagaaggtgcttcagtttcctggtggggaagctgtcaggtgacctccaccactggcaggtctcctgcctcaggtatgcaaaagcagaggggctgggactgactttcttccaaaacttgaactccatcccctccccaggctacagttagtctggggatgggcccaaaacaaatgctttttagcccaaggtcaagagacctagagggggaaaggatgcagctgcaaacggggctcacgtgaccaaagagccggcccaacagtgccggatggaacggtcctccctccctctgcaaggaaaggaacgctcctgtcatcatatatacagggtgagtcatgatgcagggcaccagcagaggagaggcccccacagacggatctgggatctgatcttagcttggagtagatccacaccacctctgccagccaggaagacaccccactgggaaacaccctgggttttctaccggagtaaaaggctcctaagaacaagggtagcagctttctgtgagagagtccagctccctcaccttcatcttgagccccagctacagaggctacctggcaggcatagatagatagatagatagatagatagatagatagatagcatcagcccttccatttcgtgctcgatcgttggcatgaaggaaaagaccagaacaggggcgggctttgtgttctggagattgccagccaagggttacacattcctcatagcactttgcctgggttcatgagaccacggggatccagtgtgtttttgagctgccgcatggtctccacgcccacggggcccacttcctcttggagcagctgtcgcttgcccagtccgatgccatgttctccagtgcatgtcccaccgagtgccagggcccgcctaggaagccaattgaaggaacccccagcactcctccctcagcctccgccctccccagcccccaaccctccccggtacagtcctcacctgcccagattttctgcaaaggccttgaccctcctctgctcctctgcatcatctgggtcgaccaggaggatgcagtgaaagttgccatcacccacatgcccaacgatggctcctaggggcccagagaacagtaagtgtcgcctctagtctccttgcccaggccttggctaaccccagcgcctcccagacggcagtgaagtagaacaaaacctgtgagttttgaagctttaatctcctccttggtctctaccaagatctctggcagccgggagatgggtacacacacgtccgtggaataggcctgaatcggaaggcaagcctgtgtgattccccccatcacccactgcctacccaaagttaagggatcactgtggtcaagcctaggaccaatccaaggggtcttgatgtcgcggagtgacacatctgacccactggtcttcttcgctagcccaggtcttcactactcccctggatctaagcctggaccccatgcagggtcccagcagccccacccttctgaacttctgcataatctgcccagccgtcccatctagctagactgcctccttcctctccatttcttccccaggaggcccttccaatgtttagaattcctaagtgctcaacactatacctgaggctgacttgtgaactcctaagtttggagcaaattaacagttctttctctctagactctggaatagctgggtgcagtggtctatagccccttgtcctcacacccactcagccagcccttggtgggcctcagtcttctctatgtgagtgggtagatcccacctccagccccagcttcagctcaccttacttcctggactcagggccaaggctgcataccaagcattgtgccgcgctgcccaaagttcattgcgcttttcggcctccttggcccaggagaagtgagagccaccattatcctgagtgattgcctctgtagtaggcacagaaaggctgatggttagacccctacactgggacagcctcagacctcacagcgccgtgtccccggcgcacctgtgcgctgcagctgttccgccagtgtctgctgggaaccgtggaactccaggaaaagcgtgggtgccacggggcagttaagtttgctgtgtctgttgcaggcatccatcatgacatcatctaggaactctggaaccagggagagggctgatcaggtgaggcctggccttctaagggggccttttcggtggaacccacccccctggctcaccaatgcgagccacgggcactgcagcctggaggatctgaactgtgctgtccacagccgcttgaacactggggaacgcacaggtggcagccaccgttgcttccggcgcagggtgcaggcgcagggtggttgatgtaatgatgcccagggtcccctcagagcccacaaagagtcctgtgagattgtagccagctgcactcttcctgggcccaggaacatacaaggtaggtgagcgcccaggccgtgtgagcgactacaactacagaagtcaccatagctagaagacaggtttggtctgatctcctgcagccccagattgtcatcacagagtttgtggtttaatgacccagagaggccttgcacagggagagccaactccagctgagcctccagagttgcagggtgctcctgagtgtcacttaccgatccaatccaggaggccctgcaactgggtcaggcagtgctcacctgtaatggcggccccggcctgcggtgtgaagcagcctgccgtcaggcagcactacctccaggttaatcacgttgtcccgcatggttccatagcgcacagcattggtgcccgaggccccggtggctgccatgccacacagagaagcatctgcgcctgggtctagagaatgaaatgctggagagggcaactgcagaggccctttccctcttgtgggaaagatggggccctgtgaaatccctcagaccacgcccccaagccctcggtcaggtactctgtggttagtccaaggcctaccaacaggaaaccaaaggccactgtcacgcaggtgggtattgagagctttacgggtgactccaggctccaccaccacggagaagtcttctgtattcagctccgtgatctggtccatatgggtcaggttgatgcacactccaccctggtagcaagggagtcaaaaacagctgcccaacctaggtctctaggcccgaggcagcccgctagagccccattttatggctgaggcctgcagcaaccataccaaagctctgggatggcaggtgaagagagctgtaaatgtgtcctgtataatgggaccagacccagggcacccccactatacctgcacagcacagactcccccctcaacaccggtgcctgtgccaaatgggatgatgggaacaccttgattgtagcacaggcttgccactcggctgacctggtccacattctgaggccaaaccacagcatcaggaggttgacacctagaagcaggcaggcccagaggtttgaaaaggatggaagcttctcaccctctcttatccaggaacctgcaatggtttaaggacccaaggacagggacctcagcagatcagggcagagagcacctctccgtgtaaggatgccagaactccaaacaggtgaccagagagacagggaccctcagtcccttctgatacctgtgcatcgattcatcatgcccgtgttgctctctgactgcagaagcagtggacacgtgggggctccctacaactgccttcagagcctccacaaagtcctggctgagtccaccctgcaggggagaaaagtgcgagggggtcatcggaaagacagtcggagggagccacagacctgccctgtggccgggtgggaagaatgaggggctggtcaacctgcaaggtgacgtcactgagccccgaggacattacgtcgggctctccaccctctgggaccccatccacaagtagacttatacctgcgaccccctggagcagaaactcctccagggagacagcctctgggtggccacccgaaggagcatggccatagccagaccgcagctaaggggagaataactaggcggagaggaagccttgccagcctgcctctcgctgtgcccaatagctgccctgggtggagcctgcttaaggtggagccggtttaaggtggcctctgcagatctggaaaagaaggacaacagctacttcacgtgttacaagtcaactaactgctgctccccgaagagccctccaaacaaacatcgtgtacggaggctttcaagtcccaccgggcactcggactttgtcttctacacttccagcctcttctttgatctctaagctgcagttttcctttccattccagagctcaggccggcctgcaaccttggcacatacactgtgccctactccctgaatcatctcctgactccctgtcaggcagagccttcctcaccttgcaagcctcaacagcatgccacagagtagacttgccaccatgaccacgaagagggaaactccagaggtcattctgggacagagtgggtagcatagtgcagtgcccagaaaggccgccttgcagaggagtgctaaggaaaagcagggaaggagattaattccaagaccatcctgttggttccaaacaactcccacagcaattccagaagagcctttgctaccaccactgagctaaactacctcccaatgactctcttccttccggtcaggaatacaaactcctaatttatttagtttttttatccagctttattgtgtctgtgtgcatgatggaggaacatacgcgccacagtgcatgcgtagagatcagaaaacaacttcgtggagttggtggttctctcttaattcacccaaccacatttggatgaatatgtaaaaagagaaaatcatgccagccaggccttatggtatgcacctgtaaacccacacagagagtctgagttaggaggaggatgagatgaagccagcctgagccataacaaaagaaaacaaaacaagacaaaatgacaaatttagttatagggaatggggtggtggagagatagcatcagagttaagggcactgattgctcttgcagaggacccgggttcaattcctagcacccacatgggatgactcacaaccatctgtaactcaaatcccaagcagggaatcaaacaccctcttctggcctctgtgggccaaatacacaggcaaaacactcatacctataaactaaaaagaaatccttaaaatagcaaatttagttatagatctaattgcttttatttgctctttttggattggggcaccctccaagactacagaattgaacgaaaccccccagcggacagtgggttctctaaaacagggacaacaggaggggagctgatgggttgaagtcaatctggccttcctggtaaggttaaagcagatgggacactctgtcgatgtcgtggtacacacagctccagtgtcacggactgagcactgttacgttttgttcttatgaaacatcccacacacttcccactaccaccctccttctcagggattctctccttacaatgactcagactggaatttatagtttctgggaaccttagcctgatgggatcctacatgtttccttacagttttgttcggattgtgtggcattgagcgcaagtgactccattttgacttgtgtatgagtttcttttctcatactgtgacagaaagaagaaaagaaaagaaaagaaaagaaaagaaaagaaaagaaaagaaaagaaaagaaaagggaggggcttgcattgagaccaagccatctgacgatcagtgatgtcttctgagaaacactgctcagagacgaggaaggaaaagtcaaaactgaaatgaggtcaccccgggcacagtagttacttgcctgggatcccagtgcttgggagcctgaggcaaggaggattgtgattttttgaggcctgcctgggttttgtaacaaagatgctgtcaaagccaacaacaacaacaaaaaaaatggaatcactgtgcccacccttgtagagtaacgaaagccaagagaggagcgatggctcatatcctcagctacctgacattgagtaattgtctgtctnnnnnnnnnnnnnnnnnnnnagaagagaaaagagaaaagagaaaagagaaaagagaaaagagaaaagagaagctctgccgggcgtggtggcgcacgcctttgatcccagcacttgggagacagaggcaggtggatttctgagttcaaggccagcctggtctacaaagtgagttccaggacagccagggctatacagagaaaccctgtctcgaaaaaacaaacaaacaaacaaaaaaagctccccacctgactgatagcaggcttttccttttcccattatgagatttccagggaaatttcagtttcttgtggtccatcatcagggacgtgtggagatccagaggtcatgaggagggaaactggaagaggttcttccagggcaccgcacactgtaacaacccagcctactcgaattctctgataggcagaggtagaggcacagatctccctttaggacatcttcatccctgccaggatggctccattctcactgtgctggctagttttgtgtcaacttgacacagctggagttatcacagagaaaggagctttagttgaggaaatgcctccatgagatccaactgtaaggcattttctcaattagtgatcaagggggagggccccttatgggtgggaccatctctgggctggtagtcttgggttctataagacagcaagttgagcaagccagaggaagcaagccagtaaagaacatccctccatggcctctgcatcagctcctgctttctgacctgcttgagttccagtcctgacttcctttggtgatgaacagcagtgtggaagtataagccaaataaaccctttcctccccaacttgcttcttggtcatgatgtttgtgcaggaatagaaaccctgactaagacactcactctttgtttttatacctcagttctgagacatattatgcctgtgcctgaaacaagtgtcacaagtagaatatcaacagagatcaaagtccagagacagacagttactcaatgtcaggtagctgaggatacgagccatcgctcctctcttggctttcgttactctacaagggtgggcacagtgattccatttttgttgttgttgttgttggctttgacaacatctttgttacaaaacccaggcaggcctcaaaaatcacaatcctccttgcctcaggctcccaagcactgggatcccaggcaagtaactactgtgcccggggtgacctcatttcagttttgacttttccttcctcgtctctgagcagtgtttctcagaagacatcactgatcgtcagatggcttggtctca

SEQ ID NO: 1370 - DNA, 1391 bp, Mus musculus
  misc_feature (1)...(1391): n = A,T,C or G
ngcttccagagctccgcctggctgccccaccgccgcgagccctcccgaagcctggaggagtgagggccgccggcgcgggctgaggagtcctgagacgggggacgcgaacggcgcggcgcccggagcctccgccgcttcctgctgcgggcgagcggcctcctccggctcctccctcccttcgctgcggctccttaggctccggagcccgggggcggcctgtggcgcgaggcgccggctctggaccgcgcttcttcggaccttaaggggaacatgcattcggcttggacagtttgaaattcttagtttggggtccccgctcgcttgctttttccaccccgcggattttttttgaggattccccccctcaccttttttcatttttctcccctcggggctcttttgtgactctccccaaccccaaccctccgcctttatgttcgcccagacctccacccgcttctgagtagtgggggagggtttcagcctccacgttcccgccccaccggggccccggcgaacatggggggcaagcagagcacggcggcccgctctcggggccccttcccgggggtctctacggatgacagcgccgtgccgccgccgggaggggcgccccactttgggcactaccggacgggcggcggggcgatggggctgcgcagccgctcggtcagctcggtggcgggcatgggcatggaccccagcacggccggaggggtgccctttagtctctacacccccgcctcccgcgggaccggcgactccgagagggcgccgggcggcggagggtccacgtcggactccacctatgcccacggcaatggttaccaagagaccggcggcggtcaccatagagacgggatgctgtacctgggctcccgagcctcgctggcggatgctctacctctgcacatcgcacccaggtggttcagctcgcacagtggtttcaagtgccccatttgttccaagtctgtggcttccgatgagatggaaatgcactttataatgtgtctgagcaagcctcgcctgtcctacaatgatgatgtgctgactaaagatgcgggtgagtgtgtgatctgcctggaggagctgcttcagggggacacgatagccaggctgccttgcctgtgcatctatcacaaaaggtttattttatttattccaagtaaatgcccagaacagctgctggtgtcaggcaaatcaggaaaaaaaaaatgcctggacatttttccaaggcccctgtgatttttttttccccctgaggaaatttagacttagctaaaggactgtgtgctgcaacccccattttcaggcgcacggaaatattttagccattcacacatgacatcagcccatgcaggataggtttctgtatttatatattaaaatcc

SEQ ID NO: 1371 - protein, 279 aa, Mus musculus
LSPTPTLRLYVRPDLHPLLSSGGGFQPPRSRPTGAPANMGGKQSTAARSRGPFPGVSTDDSAVPPPGGAPHFGHYRTGGGAMGLRSRSVSSVAGMGMDPSTAGGVPFSLYTPASRGTGDSERAPGGGGSTSDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKRFILFIPSKCPEQLLVSGKSGKKKCLDIFPRPL

SEQ ID NO: 1372 - DNA, 130207 bp, Homo sapiens
  misc_feature (1)...(130207): n = A,T,C or G
aagaaaaaaaaaaaaaaaaaaaaaaaagaaaggaaagaaaagaagaaaggaaggaaggaagagaaagaaaggaaggaaggaaggagagagagaaagagtggggactctggagcaacatccagagctctctggctgcttcttcattgctattcacacactgagatccccatgtaagtgttctttccatgttgaccaaaaaatcaaacaaaatcaaaatcaaactttttgtatgtattttggagactttttgtatgtatttggagactatatttccagactcaggctggagtgcagtggcaatggtgccatctcggtttactgcagcctcaacttcccaggcttaagcaatcctcccacctcagcctctcaagtagctgggaccacaggtgcataccaccacacctggctaatttttgtattttttatagagatggggtttggccgtgttgcccaggctggtctcaaactactgagctcaagtgatccactcaccttagcctcccaaattactgctctgtaaaatatttaaagaggtttattctgagcccatatgcgtgccatatgagtgaccatggcctgggggacagtctcaagagatcctgagaaagtgtgcccaaggcggtcagggtatacattggttttgtacattttagggagacaggaattttaggtaaaatcataagtcaatacatggaaggtatacattgattcagcctaaagaagcaagataccttggagggggtggttacaggtcttaggtggagtctaagattttctgattggcaattggttaaaagagttcaactgtgtctaaagacttgaagtcaatagaaagaaatgtttcagttaatatgagggacgctatagagaccaaggttcttgttatgaagacaaagtttcacaggcatcagccttcagagagaataggcagtaaatttctcagggccttaaaaggtgtcaatatcagtttatctctttaaaaaaaaaaaattaaggccaggcaaggtggctcacgcctgtaatctcagcactttgggaggccaaggcaggtggatcatttgaggtcaggagttccagaccacatggtgaagccacatctctaataaaaatacaaaaaaaatttagccgggcgtggtggcacatgcctgctgtcccagctactccagaggctgaggcaggagaattgcttgaacccgggaggcagagcagtgagccaagatggcgctgctgcattccagcttgggtgacagagcaagaccttgtctcaaaaaaaaaattaggatggggtttcactatgttgcctaggctgatctctaactcttgggctcaagcgatcctcccgccccgctggcctcccaaagtactgggattgcaggtgtgagccaccacgctcggcctcttaatctctcttaaatgcaggaaagtctcagctgcgttctctacgatgcaaaatttcccccacaacagagtgctttgaagagccatttcaaactacgccaaagaaatatattttggggtaaaatacttttatttccttcagggtctgctgtctgttatatgatgctataccagagtcaggttggaattcggtatcttattgccacaaagcgtctgttctgtcagtcttatgatctctatttcaaccttaacgctggtcagttatgcctaaactcgaaaaggtggggggtataatgaccttctttcccacgatggccagaaattcagtttttcaggtttctctggagtccccttggcctgggggagggtggtccattctgtaacttgggggacttaggattttgcatctgaatcagaggctggggaccactgagggtcctttgtcaagtagatcccactttgccacagaggatttatcatgaaactgtgttttttcaggtcacttgctagccaagcggcaggaaagcagggtacacagcaaacccagaaatccagggcctgggctgggctcttatcagcaactagccatgcaatttgaacatgatcctttatctttctagtcttctgtttgctcttctgcagaatttggagctagctgactactcagttcatttacatctgggaaccttggaccctggccctgagtcccagtaataatttccctctcttcatcaatcaacaaatatttatgaacatggtcctgtgctcagcctcccggccatgtgtatttggttactcattatcctgatttctctaagctgtctcctttcaagcaaaacaataaaatttaaagagctccgagagggcctgggaggaagtttctcactaaaaggcatttgtccacccccagtggggtgataggggtgctggggatgccctccaaagccatgggaaaccctcgccttcctctggctcacagaaacagggaggtggatgggagttccccactgcttctcaggagtaggccctcacaagccctttcccctattttctgaatagtgaaagtcccaggctttctataatagaatagatatgcactcgcatttccaaagggctttggcagcaaaaattttatcagctcttcctcctgactgttgtggtaagtggatcagtggtttattgttagtacaaaacaagataacaggacattttcttttcttttttttttttgagacagagtcgccctttgttgcccaggctggggtgcagtagcgcgatctccgctcacggcaacctctgcctcccgggttcaagcgattctcccgcctcagcctcccgagtagctgggattacaggcaactgacaccatgcctggctaatttttgtatttttactagagacagggtttcaccatgttggtcaggcatgagccgctgtgcccagccataacaggacattttctgagataggctaccattcggggtcccacagggcacctaagctgagtgcaatcacattgcacagagcaggggcttcacctttgcagtacaagatctcagctgttcagtggtgccagctatgagagaggtgacttataataatcagcacactggaatgtaaatcttaaggccaaataattaattcacaaaaagaaatacagctgttaagtagatctagtctttttcacccctttggaaagtatacagagaaaacaaaattgtcattggaagaattcctcggctgggtgcagtggctcacacctgtaatcccaacactttgagaggctgagacgggaggattgctcgagcccaggagttcaagaccagtctgggcaacatggtgaaaccctgtctctaaaaaaatacaaaacttagccaggcacagtggcacgcacgtgtggtcccagctactcaggagggtgaggtggtagtatccctttagcctgggaggcagaggttgcagtaagcccagattgcaccactgcacttcgagctgggtgacagagttaagaccctgttctcaagaaaaaaaaaaaattccttgatgagcatgttcaccgtaaaacttaagagcccagctctggcccagcgtcgtggctcacgcctgtaatcccagcactttgggaggccgaggcgggcggatcacgaggtcaggagatcgagaccatcctggctaacacgtgaaaccccatctctactaaaaatacaaaaaattagctgggcatggtggcgggtgcctgtactcctagctactctggaggctgaggtaggagaatggtgtgaacccggcagggggagtttgcagtgagctgagatggtgcccctgcactccagcctgggcgacagagcgaaactccatctcaaaaaaataaaataaaaagcccagctctgctcttactagctgcatgaccattaatgtgcatgtagtatgttttgtctatcatctatcaaaatttattttttccttttttttatttttgagataacggctttctgcagcctcaatctccctaggtttgggcgatcctcccacctcagcctcccaagtagctgggaccacaggcacgtgccaacacacctggctaattttcgtattgtttatagaacagggtcttgctgttgcccaagctggtcttgaactcttgggctcaagtaatctgtctgcctcgacctcccaaagtgctgggaggccattcctattggtgctgatgatagcaccaatgatgctggtgctagatagacagcatctcatgatgctgataaaggctttccagctccccatgcccttgggatggggaccacgctccttgccatggctcacaggaccctcttgcctgcccctgaggaacagattcatctttggctctcacccccttgcattgcagcactatagcctctttcagttccttgaatatgccatgttctctcacatctgggctgttccctttgcctggaacagtattctcttcctgaaacacagtttttttccctgccctgcctccttgcctggctgatctccaactcacctttcaggcatcagcttggaatggtctattcctgtctcttgcctttctttcagcaccatactctttctccctcataccatttagtcattcattcattcattaattcaacaatatttattgagtgcctagtacatgtcaggcaccattctaggcttacctgtcatactgtattgtcactgcctgcttcagtacttttttttttttttttaagacagagtttcactctgctgcccaggcaggagtgcagtggtgtgctcttggctcactgcaacctctgcctctctggttcaagcgattctcttgcctccgcctcctgagtagctgagattacatgcctgcacaaccaaacctggctaatttttgtatttttagtagagagggggtttcaccatgttggccaggctggtctcgaactcctgacctcaagtgatccacccgcccagcctacctaagtgctgggattacaggcttaagccaccacgccccaccaatacttattgatctatatggtatgctagtgtaattcagatgccataaaattcacccttctaagtgtataattcagcagttcttagtatatccacaagtctgtgcaagcatcaccattacccaattcccaaacattttcatcacttcaaaaagaaatccattcaattaccaaaaaatgtgatttaaaaaaacaaggccaggtgtggtggctcatggctgtaatcccagcactttgagaggccaaggcgggtggatcgcttgaggccaggagttcaagaccagcctggccaacatagtgaaacctcatctctacaaaaaagaaaaaaaaaaattagctaggcatggtggcacatacctgtaatcccagctactcaggaggctgaggcgtgagaattgtttgaacccggaggcagaggttgcagtgagctgagatcataccactgcactccagcctgggtgacagagtgagactctgtctctaaataagtaaatgcataaaacagaaagacaccactttgtaaccacacaattaaaaaataataaataacaaataaatacataacagaaagaggctaggtgcagtggctcaagcctgtaatcccagccactctgggaggctgaggcaggtggatcatctgaggtcaggagttcaagaccagcctggccaacatggtgaaaccccgtctctactaaaaatacaaaaattagctggttatgatgccacgtgcctgttatccgagctactagggaggctgaggcaggagaatcacttgaacccatgaggtagaggttgcagtgagccaagttcatgccaatgcactccagcctgggcgacagagcaagacttgtctcaaaaaataattagtggccaggcacagtggctcatgcctgtaatcccagcactttgggaggccaaggcggatgaatcacgaggtcaggaatttgatacaagcctgaccaaacatggtgaaaccccatctctactaaaaatacaaaaattagccgggtgtggtggcgcgcgcctgtaatcccaactactcaggaggctgaggctggagaatcgcttgaacccgggaggcggaggttgcagtgaagattgcaccactgcactccagcctgggtgagaacagatcaagacaccgtcttaaaaaaaaaaaaaatttagcgtggcatggtggcgcatgcctgtaatcccagctacttgggaggctgaggcagaagaatcacttgaacctgggaggtggaggtaggggttgcagtgagccgagatcatgccactgtgccccagcttgggtaacagagcaagactccgtctcaaaaaaaaaaaaaaggaaaaaaagaaaaaatagaaagagacctattattagtcattttccattctcccctccccccaggccatggcaaccactaatcaatctgtctcaatggatttgcctattctggacatttcatataagtgaaatcatacaatacatagtcttttatggctggcttcttttagttaatatgcttttacaagattcatccatgttgtaatatgaatcagtactttattccttttcatggctgaataatatttcattgtatagatacaccacatttggtttacctcttcatcagttgatgagcatttgggttgtttccactttttagctcttttgaataatgctgctatgaacatttacgtacacatttttctgcagacatatgttttgctttctcttggaactctacctaggtaggagcagaattgctgggtcatgtaactccacatttaatctttttgaggaactgtcaggctgttttccaaagcagctgcaccattttacatttccaccagcaaggtacaagggttccaatttctccacctctcatcaatacttactattgcccttctctttgatcatagccattcaagtgggtgggaagtgtttcttctgatgttctatgagaacagggactccatctgtctggttctggttcagtactgtatcccagaacctactacagtgcctggaatttattacatactaaatattgtgttaaatacactaaaaaactgttcagtgaatggataaatcaaaagctgtttggatagttacaatgggtatcatgtatttatctctctaatagggatcttccacggggtctaataccttttttttttttagtatagtactgaaccactcttctgataccatagtctttcttctaggaggaaatgggattaaatttaagctttcttgtttttcctctttaggtatacacatactcatataggcacctacagataatttattagatgttggcacattttgtttcttcctatttttacttctcttgcaaaaattcttacttctacagggctgtttgctcacctccaggtatttcatgcttgcaaataggtttcctcctgtttccaggctggccacaatggaacaatcaatacctgtgacgggctagccttgctctttttggttttcttttaatatttctgaacatcctgttttggtcccccagtttagaagtatctggggtcatttaataggtggaagtcagctaagccagggactgtgtgatactcacagccagcacctagcacttgataaatagttgttcagcagtcacagtggctcatgatgtaatcccagcactttgtgaagccgaagtgggaggactgcttgaggccaggagtaccggcctggacaacatggggaaactcccatctctactatatatgtatgtatatacacatatatatatatcatatgtatattttgagacagtctcgttctgttgcccagtctggagtgcagtgacgcgatctcagcccattgcaacctctgtctcgcgggttcaagccattctcctgcctcagctacccaagtagctgggatcacaggcgtgagctaccacacctggctaatttatttattttttattttcatttttttttagtagaaatgaggtttcaccatgttggtcaggctggttgcaaactcctaacctcaggtgatcccctgccccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtgagtccgcgggtggtggaggcctcggagggagggcgcgccggggcgccccaagccttcgcgtgcgtgccaaggtttgggaatgtagtgcacgaccgggatctgtctgcattccctttggttcccgatgccaagggatgaatgggatacctaccgtctggaaactaggctttctgcgaggctgcggagcctggcgatttagggactcacggcgtgtgttcacttgtggaagggcagagcgaagcctacctattggagttccatttattggcatcaccctcctcagagaagaggtcgtgtctggctgagagcaagtcagcctgggtacttccattctgccactgcagcactgtgcctgcctcaccggtaacggagagatggagccagttggagcaagcagtgtctcctaaacagagtgtgtgaaaatgaaataaaatcaggggcaagtgatgcctggattagggctctcactcttgctgggagagagaggtgcccagttttgccaccctgctggagatctgtttgaaatgtttaaaatggagcagccggcaggcggctggcatagacaggtgtggctgctgtacggagggcccagtcggcgagtctcgcgggggctttgcaggacccgggctgtggtcacccgtactgcatgcagcaggcttggctccgcgactctcgcctccctccatctttttttcttctgctccatgctaagtgcttggtcttcccgtgaatctgcatctttttgtaacagggagcctgtcacggtggggcattattgcctggctgttggcacatgactggggaaaaggaggattcagagaatctggatgaattcattttatgaacttctggtgacaggccagcaaaaggttggagggggatttcccaggctcctagcgggagggcaaaaaaggcctggcaggaggaaaacaggtctgtctgctaggtcaggcatctagaaaattggccaaaagggatgtgggggccgctatttgctaattggcaagttgagtgatgaagttacatcttaagattcttttgggtgagttgggaaaatttagatagtgtaggggaaagattgctcctgcctttagggtactttatggagggtaatatctgttggatcactcttttaactactgtgaaatagggttgacttttggggtatctctttccccccccctgcaaatagcctggggtttgttttcatttggtttggttttttgtcaattctgtaaactttaatttgtgaaatagtgttgggggagaaacgattagtgactaatttagggtaacacttagaagtagcttgtgaattgttaggatgatattttaatctctgacagacctccggatatcattggagcttttctgacctcatggaactctgccctgagtgagaagcaggacatgattgcctttggctctttcaggcatttgatcaaaattaggcattttgaaattaataatttttcctatggaatttagtccagagagttagccatatttttgagatgactagtttggtgtttaaaagaactgtaatgagcatctggttttgaacttaaaagtactgtaagaagtttctctaaaatcacagaattttttgtgttgaaaaacatatgagatatgtagggaggaagaaagggagtgctttttttgctaaaatttcttaagcctcttactaaaaatttatttattatgctactaccaggttccatgctacagttatgagcttgtagttggattccagaatttcactcttaagctgtgaaaccttattttttttcatccgatcatggtgagggtagggagagccactgaactgtggggacaggaaggttggagcatattaatcctttagggaagggtgtcaaaagtgtgtatgggaggctgctattaatattgtaggtaatccattccttactgtgtaggaccatcatgtccttctgcaagacatcgagcatacctactaaatgctgatagcatccagcagttcagtgtgtcaccccaaaatgtccccaagaattcccaaatgccctctggggtgtgggtggtatcactctggttgagaaccactgctttagggatttattcttttattcacataaagtaattggcttttcctgtgcatttcatttgagatgaatcttcgtgtgcagcattggttccatctcacctgaaacagaccatgggatcttccaggacatctgtttcctctgttacacattgctgcaagaagcaaaacttgtttctgctttggagcctttgagtaaggtctaagcagcttttgctcttctgttgcaagattggaagggtaacgattttggtgcacaattaattagatgcctggaagttgatatgatatgtttgcttgtgttttcaaggtgctcttgcaactcttcatgggcacagaaaacagttgtcagtgaaatacatgagggagttcagtgtatacaaggccttctcagagagcgtgggcttaggctgggtctggaggtagaatactgaagggccctggtcccagctactcctctgagcagctgtgaccttgggcaagacatatcccctctcttgagccttatctttgtcgtttttaaaatagttgtggtcaccctcacgagctccagccttgctccgcaaatcccgggagaggaagcgctgtagtcacatttgtcttctctaggttcctgacttccctgtgctgtgacccccacgtataccattccctaatcctagagtgcttttctctccgttcttcacacgaatttctctttctgatcccttagggcttagagaccactcttaaaaattggcccctccggttattctctccagtcactcacctgttaccttaatcattcttttttttgagacagagtttcgctcttgttgcccaggctggagtgcagtggtgcgacctctgctcactgcagtctccgcctcccgggttcaagcaattctcctgcctcagcctcccgagtagctgggattactggcatgcgccaccatgcccaataagcttggggctaattttgttttttgtagagacgggatttctccatgtttatcaggctggtctcaaactcccgacctcaggtgatctgcctgacccggcctcccaaagtgataggattacaggcgtgagccactgcgccctgcaccttaatcattcttaacacactttgtaagtattttatctgtttacttttttctgtgtatggtttgcctaaagtctaagctccgtgagagcaggactgtgttccttgatctctgttgtgggtcctgcactgtgcctgccactcacattttttgagtacatgaatttgagtactttatgttcatcatctcacttaatcatcactctgactctatggagtaagactgttctctcccacccccattgtgcaggtaaggaaacaggtttggggaggttaaggaactcacacaagatcaggtggttagtaggtggtggagatgggattggaatgcaggttggctggtgccagaacctgggctcttaaccagtaccctcttccgcctcttatctgaaaacatcacaaagccgcatggtgtcctggagattgcgctggcctacgagtcagagtgctaggctcatctcctggttaggcagctgattagctgcatgatttgtgaccttgggcaagcgagtcatttaacctcagtcacaatttattcatctgtaaaatgtagaagacgcctgtcctgcttacctctcagagtcatagtgagggtctcatgagataatgtgcacaaaagtcaaaggacattctaaatggagagtggtggagttcctatgggggcactctcttatagttgtctgccttcaatcgcctcagattttttttttttttcttttgagacagggtcttattctgtcacccaggctggagtgcagtggcgagatcatagctcactgcagtctcagactcctgggctcagttgatcctcccagcttggcttcccaaagtgctgggaccacaggcatgagccaccgtgccaggcctaatggtctcagaatttgatgggtggagagaggtttacagctgtgctagctgtagcccccaaatggaatctggttctgtgtcctaaagtctggcctgcattagtgggctgcttttactcataatgccgctgataagggctgctttatagaagcagagtgactccctttccacgttaaaaagttttgctataactcctgatggctgcctcggtgctattctggaggcctggtcattctctttcggtagttctgtttgtctcagagtatggatttctaaatgtggggtacaaaacatgcaccatccaccatgttgaaagaagttgctgttttctaggttctactataaaagggctggccattgagggcttcacttcaccttcttagtcatatgtgtatatatatgtatgcactttcagaaagtctaaactgttctttattgtcatcaagccatcaactgagactgatacaaggtgattgtgttttgtttttgttatttatttatttttgagacagggtcttgctctgttgcccaggctggagtgccatggtgcaatcatggttcactgtagcctcaaactcttgggctcaagccgtcttcccatctcagcttccagagtagctgggactcaggtgcgcaccactacacctggctaaattttatacaatcttttgtagagatgaggtctcactatgttgcctaggctggcctcaaactccgggctttaagcaatcctcccacctcaacctcccaaggtattgggattataggcataagccaccacgcctggcccaacgtggcttttaataagtctttgaacatgctaggaggtatctcttgggctctattttgctgccactgtagggttctcaagtgatttaattttcttttattgttagctaatgggggagaattgccagctcccttggagtgaatcagaaagcctttgtgtcccgccataggtgtgctagaagtaatgggccttcacatggtttctggagaaggaaaagcattctgtggtctccaaagagcatgatgggtctcctgccctgcaaaagttctattgttaatgaaaacttgtattaaaaagcagaatttttagctctttattaccatgagggcttattttcttaaaatacaaaagttaccccgaggcaaagataatttcttgaaggtcatagttaactcttgcttattgaggtttgaatggtgttgtaagaaacagtggcttagctcttaaagcgtttgctttatgggatactacattttgatattaaacaaagacccacctcaatatatcatgtcacaaggaatacttaggccattcttagccaaagaaatgaagcaagctctagttccttttgggaaaaggaacatgctttgtattttacatatgtggtattcaccccaagcttattgggcacagaaatttgagtatagtagttactccctatccaaaggggattcgttccaatacccacagtggatgcctgaaaccgtggatagtacctcacctgaaccctatatctactatgtcttttcctgtatatacatacctttgataaagttttatttataaattaggcacaataaaagctcgacagcagtaactaataatagaacaattataacaatatactgtgataaaagttatgtgaatgtgttctctctctctctctccctgtctcgaaagtacagtcatgcattgcttaatgacagggatactttctgagaaatgggtcattaagggattttgtcactgggcaaacatcatagggtgtacatacacggacctaggtggtatagcctgctacatacctagattatatgttgctcctagtgctcctaggctacaaacctgtgcaacatgtgactgtattgaacactgttggcaattgtaatacagttgtaagtatttgtgtgtctaaacatagaaaaggtacaggatatagtcttacgggaccaccatcatgtatgcagttgcttgttgacccatgcatgtagggtggtgcgtcatggtatcttaatattttagacctccattgaccacgggtaactgaaactatggaaagtgaagccttggacaaggggtactgctgtatacccaattataaaactaagcttcaattttgacagcttcaaaattagaaaaacttcatagggaagtggtggtaacttaaatgggatattgattctgctcctactcatccttaggtaggggtgtttttaatgacagtggatcactaaggttgtggttctagaatcttgaagttagcccaaaacctaaatcttaacctcagtcagttagtttgtttgtttgtttgtttattgagacagagtctcactctgtcacccaggctggagtgcagtggcatgatctgagctcactgcaacgtccacttcccgggttcaagtgattggcctgccccagcctcccaagtagctgggattacaggcatgcaccaccacgcctgactagtttttgtatttttagtagagacagggtttcaccatgttggccaggctggtctcgaactcctgacctcgggtgatccacctgccttggcctcccagagtgctggcattacaggcatgagctaccgtgcctggccacctcagtcttttaggatgatgggtgaatataaatttcagtctgtttcttttccaagctttctcatggcctagtctgaatcagatggttcatagtaattaccatgggttcagtcttgagtgtgagaaggggattcttagagacccagcagttttcacttctgaatcttaggttctcactagaacacaggtttatccttgaatccagcagttgggtttctgtcctttatgtgctgtatggatgaaggatgagttgtgggtatgagtgaataacctgaagaccagccctcaagtgtgaagtgtgaagcaaataaccaagtttaatctttttttttttttttttttaagacagggtctcgctttgttcaggctggagtgcagtggcacgatcatggctcactgcagcctcagcctgtagggctcaagcgatcctccttcctcagcctcctgagtagctgggactacaggcggatgccgctacgcctggctaatttttaattttgtgtagatggggtctccatttgttgcccaggctggtcttaaactcctgggctcaagcgatcctcctgcctcagcctcctaaagtgctgggattacaggtgtcagcgacgatgccagaccccaaatttaatcctaaagcagcagctgaaatagtttctagactgatgagactgtttaccttgagacctccctagagtcgttagtcttgaacacacagctttcctctgttgggagaaaggaggaaggaataattcactggatccctgtgaattccaacttaggggaggcatgataagaatttatagtgacctcttggatctgtaacaagaaagaggcagataaaaacaagagctctcctgatttctgtgaatggttcagaagggttcttaaaggtgctcagtattctctagggaggtagttaacgatgcagatgactggaccccactcacagaattcagtagagctggagacccaagaatctaagtttgtaacaaatgaacctgaaaacaagaagaccttctacatctgaaactaaactccaccaagcatttagtttttctctccccaaacagagaaataaactttgaatccttttttggtgtattcattagctttctttttatttgttttttcttcttatttttctttagagaaaggtttttcttctgttgcccgggctggagtgcaatagcaagatcacgctcactgcagcctggaactcctggtctcaagcaattctcaagccttagcctctggagtatctgggactacagatgctatgctaccatgaccagataatttttttactttttttttcttttttcggtagagaaggggtctcaccatgttgcccaggctggtcttgaactcctggcctcaagtgagccttccacctcagcttcccaaaatactgggattataagtgtgaagccactgtgcctggcctttattttcagtatttctagtcagatatttgctaagcaatctctacagctcgcagaaggtaggttcaaccaggaacaacattgttggctatttgatggttttcttttacatgggactaagcattattgcctacatatagggccaagccaatctgccttggtctgagaattgaagttgctctgaacagaaggtaatggtgtcagtgtcgcctttccttctgcacttgtcttcctcctgacttttcttctttggctctggtgctacagaagggcttcctgagttaccctctttcctacatcttcagccaggcagctagacaagtcaagagcttaggatgaatctaggctttaaagaggttggaagacctgtttttccttttctctgactgacccaaaagtataagacttttttttctttgtgtgtgatgatctgttgaacaaaaacgttcatttattccattgatagcctctggtataccaggacctatggtaggtgctgagaatatatatatttattatagagcaattaacttattctttccaagaatctttgcttcctcactccttaagagtctgaatattttagcttctgggagattttaccttttcatcagctcctctgttgaataaacaaataaatgtaggtgtttgtccataaggctgctgcaaggatatacttctcttcactcatttttttccaaagccctatttctgggttggggcaggtgatcttttctttgtgattccagctaagtacctaccaagaaattcctcgtatgtctcagtatgaggggtcctctgtcctctcagtgagaatatcaaaagaaaaactgattttcagactcttcatgtgcatctttaatttcagtatctttgtcatccctagagccacttttctttctggtcattgaacactattttctagaagcatgattcaccactttttaaatctgtctctgtaaaatttatcccaagccacaaatacccataaggaaatttcatccttggtattataagtctatgtctctgaacttcacaacatctacacttctgtgctggctcccctctcccccacctccccagttttgttttgtttttttaactgtcataaaatatatgtaacaaaatttactatcttaaccgtttttaagtgtacagttcagtggtattctaagtactgcatgtaagtggactcgtacagtatttgtctttttgtggctgtcctatttcacttagcgtagtgtcctcaaggttcatctgcattgtagcatatttcagaatttcctttcttttaaaggttgaatcgtattccattgtctgtctaccacgttttacttttccattcatctgttgctggacgcttgggttgcttccatattttagctattgtaaatagctgtaattcattgttagaaatgtgaatttcttaatatctcttcaagaccctgctttcactccttttgagaatatacccagaagtggaattgctccatcatttggtgattctatttttaattttttgaggaaccaccatactgttttccacagtagctgcaccattttatattcctaccaacagtgcacaggcttccagtttctccacatccttgccaatacttgttattttctgtttttttttttaatagtagccatcttaatggatgtgaggtagtatcccatagtattcatttgcatttctctaatgaattagtgatattgagcatcttttcatgtgtttattggccatttgtatatcttttttagagaaatatctatttatatgtccatgtttgaatcaggttgcctcttttcttttcttttgatacggagttttgccctgttgcccaggctgaagtgcagtggttcagtctcagctcactacaacctctgccccccgggttcaagcgattctcctgcctcagcctccagagtagctgggattataggcgcctaccatcatgccctgctaatttttgtatttttagtagagacaaggtttcaccatattggccaggctggtctcgaactcctggcctcaggtgatccacccgcctcagcctcccaaagtgcagggattacaggtgtgagccaccacacccggcctgggttgcttttttctttcgttgttgattttagtgcagttttaagaaactttttaaagccttgtttatgatagccaacactagtgactgtaatgtattcccctcgggaataagtaataaatctgtgttatatttgagtacattttgctcaaaataaagaatttaacgaattgtctcatgccaagagattttatgagtactttggctgttggtagtgccttactttcagaaggataatttttggagaaatttcacttcgtatttaggtatgtatggtctctcatcttggtcttggtgaatcagacttgtcataggagtgctccaactttcttgttggtagtagcttgagccctctgaaaagtaattaatccatacttcataaagagttgttctgaaattagtcacctctgtactgtactgtttttttttgttttttttttttttttttttgaggagtctcgctctgtcaccaggctggagtgcagtggcatgatctccactcactgcaacctctgcctcctgggctcaagcaattctcttgcttcagcctcccaagtagctggaattacaggcatgtgccaccacagccggctaattttgtacttttagtagagatggggtttcgccagttggccaggctggtcttgaactcctgacctcaagtgatccgcccaccttggcctcccagagtgctgggattgcaggcgtgagccaccatgcccagctgggagaagctttaacctggattcaggaacagaggtaggagaacctaagatcacaggcctcatctgacgtggtcattttgcacatacttcttagctttttggagatcttttcattttgtttccatcttaaataaccttttccctgtggagaaggtgccttttttggagagagccattaagattcttttatcctgctgcctgcctgagtattctgggaatcctacaaggatttgagggagcccttgggattccaacctaacaaattagttttctgtaatattgttctagtccatttagattgtgtaaatgatctaaatggtgtaaccatttaatatcaaaagtataacagcatttaagtcagcttttcgaagaaacttttattttttaactaaaaacaaactttttttcagagacaaggtctcactatgttgcccaggctggacatgaactcctgggcttaagacatcctcctaccctagcctcctgagtagctgggactgtgggcacacgccaccatgcctggccaaagacacttttttatagctctgcctgctgctataacaagtgttcctaaatacccatgtacatcctatattattagatttcctcaactctggttagctatgactgaaacattcatgccattgcagccagtgccctggaaagctataagcaagtcttaagacctgtgataagggctgacttgcaagctagctgccgtccatcttaatatctgacgagcccagtcatgttggctgtgtttaattgatccatttcctacttgcttcctcaacccagaggccaagggcagcacaaaaggatagtgaatctaaatgtctccagttttttgaggtataggaatctcctatgaagtggcagacctttgagaaatagtattatgagctgttctgttttgctgtggctttggaaaacctttggattcctctactgaaaatttgtttgaaaaaaaaatctttttaatgaaacagtgtgagtcataaagcagccaccaccccttctcataatagcatttctcaccaggggaatttttggtagctgttgggggagggatttgagtaggttgtggatgataaatcccttgaggggaacataaccaaaggctgccatatcagaacgctggtgctttccatgctgacaccaagccctgaattcaaagtgcaggacagcagaatagaacagagaagcctgtgctcagtgaattgctgcagtagcatgaccagtgagactggagtttcaattaaaacaccgttgtagtgtaaaaggatcatgagatggaaggaggccttgggttagagagccagaagccatttataggcagaacatcagctttctggattaaaggatggctgtggacctaatgatgagaatctagaggtcatggggaatttccttactgtctgtgccccccttttccatatggtcagcttggtgcttggcactgatcatggcacactttacaaaaagtggattcatataaggtcgtctgtgctcttctaagattttaggtctaaagcatttagagtggcgcccagaggagacgccacccagtcagcctccttgtggcatagtgaaaatgaaacatttagggatactgagagcttagaacaagccagaattatgatatcaaatctcagttgcctgtcttaaacttttctgccaacctagcgtgagttttagctgttttcaacttcattatttacagtttctcgggactcatgtctgaaccactatcttacataagctacagacgggaagggctgaacggttattagaaatgtgttaagatttgctttcctttggagagtcatggcctgtcttctgtgttttcctggctttgtacttttcttcaaagcctgttaccggttccaggtctccagagctcaataaaggggaaacaggaagtgagcatttgatgcataagagccagcaaaacataataaagggcacaggcatggaaccaggagagagaattgtgggagtgagttttcttgaaggcatcagttctgtaggattagagatacatccttcaacaatgacttttaactccttcaaacaaggaaaaagcaattaggaacctctgttcagaaaggaccaatttttcttaggttatatagtagaggttcaacactttcatatgacagcatacaagtaattataaagtatcttttgcctaaggagttcagaacacagagaaaagtgatgatcacctttataaaggagtaagaattacttctctgtctctttacttgagggcccacagggtaagtcttatcatgagttccagcctggagccctgactcttactttttctgtccattcaattttttttttttttccgagatggagtctcactctgtcgccaggctggagtgcagtggcgtgatctcagctcactgcaacctctgcctcccgggttcaagcgattcttctgcctcagcctcccgagtagctgggactgcaggtgcatgccaccatgcctagctaatttttgtatttttaggagagatggggttttaccatgttagccaggatggtctcaatctgttgacctcgtgatccacccgccttggcctcccagagtgctgggattacaggcgtgagccaccgcgccaggcctgtccattcagttttagtaatgaactctgaagttttagtcctgcggttactaaatggaaaagtcagagatttgtgctatttcaatttggttcacttgtacatttcaggaactcaaatagctgtgtgactctgaaaatgggaactctttggtgtcttggaattatttatttatttatttttaatttaattttattttttttttcgagacggagtctcactgtatcgcccaggctagggggcagtggtgtggttttggctcactgcaacctctgcctcccaggttcaagtaattctcctgcctcagcctcccgagtagttgggattacaggcaaacaccaccacacccgactaattttttgtatttttagtagaggccgtgtttcaccgtgttggccaggccggtcttgaactcctgacctcagatgatccacccgccttatcttcccaaagtgctgggattagaggtgtgagctgccgcgcctagcctggaattatttttttaaaaatgaaatattttaggcattcaagaaagataatatgctcacctaccaagcagattataataactaaaacattacaggtataattgtatgtaccctggcttattcccattttctctttccctctccaaagggaacgactgccctcactcgtgtttttcccgccatatatgttcatgcttttgctccctgtagctatccaaaacaccatttgttttctgtaaacttcatgtaaactgtatagacatggaaggagaaagatattatgaggtgtgtgtgtgtatatatgctacctcaaaatggaggtagtatataaattcattttactacttattgctatagcacatttattttcacagctatactctattgatctatttattgatctattgatctattctgttatcagtggatattaaagttatttttagtttttgaaaattttgtttcattacatacgtgaatgagtttttctagggtacatccttagtcatgaaatagtggggttacagggtatgtgtatgtgtgcatgcgtgcatgtgtgtgtatcttcaactcataattaaatattgcccagtaaatccccaatgtgcttataccagtttacactcctgaaataacatatttttgcttgttctgtgtccttgccaaaatttgatattgtcataccttaatttttgccaagctctagtgggtataaatagtataatattgtgattttatttgttatttatatatttgataatatatttatctataattaatgtattaatattgtatgtttaatcattgtgtttcttctgtgaaatacttgttcatgtctttgattcatgtttatattgggtggtttaactgtttcttactggtttgtacgaatttgtttttgttttgtctgtggataataattctttgttgtcatatgtaatgtagatgtgtcttctctcagtttgtggcttatctctttattctctttgtgatttcttatggttacttaattttgaaataactgaatattcaagtattttctcttatggcttatgcattttatgtgttaagaaatattttatttacctgaggtcataaagatgttatgttttcttctaaaagttttaaaaatttgcactttgtatttaaatccttaatccatgggtaattaaaaaaaaggtttattggccgggcgaggtagctcatgcctgtaatcccagcactttgggaggccgaggcggttcgagaccagcttgaccaacatggacaaacctcatctctactaaaaatacaaaatgagctgggcgtggtggcacatgcttgtaatcccagctactcaggaggctgaggcaggagaatcgtttgaacctgggaggtggaggtcgtggtgagccgagattgcaccattgcactccagcctgggcaacaagagtgaaattctgtctttaaaaaaaaatcgtgtatttagtctcaagacaggatctcactctgttgcccaggctggactgtagtggcgccatcaccgcttactgcagcctgaaactcctggagtcagatagtcctcccacctcagtctcctgggtagctgggactacaggtgtgcaccgccatatccgactgattcaaagtactgggataatagacgtgagccacagctcccagcctataattaaattagaatggggcaagatagggatatatatatttttccatatgtgaataaccagctctctcagcagcatttgaggagtagtaaagtcatctatccttgtgctaatacgcttttcttttcttttttttttttttttgagacggagtgttgctctgtccacccaggctggaatgcaatggcgcgatctcctctcactgcaagctccgcctcccgggttcataccattctcctccctcagcctcccgagtagctgggactacaggcgcctgccaccacacccagctaattttttgtatttttagtagagacggggtttcaccgtgttagccaggatggtcttgatctcctgacctcgtgacccgtccaccgcctcggtctcccaaagtgctgggattacaggcatgagccaccgcgcccggccgctaatactcttttatttttatttttttatttttgagacggagtctcactctatcgcccaggctggagtgcagtggcgttatctcggctcactgcaacctccacctcccgggttcaagcaattctcccacctcagcctcccgagtagctgggattacaggcacacgccaccacaccctactaattttctgtagttttagtagagacatggtctcaccatgttggccaggctggtcttgtactcctgacctcaagtgatctgcctgccttggccttccaaagtgctgggattacaggcttgagccactgcacccagcctatttttattttttgagacagagtcttgctctgtcacccaggccggagtgcagtggcctgatctcgactgactgcaacgtctgcctcccgggttcaagcaattctcatgccatagcctccagagtagctgggactacaggcgtctgtcaccatgcctggcttttttttttttttttttttgtatgagtagagatggggtttcaccatgttggtcaggctggtctcgaactcctgacctcaggtgattcacctgcctcggcctcccagagtgctgggattacaggcgtgagccaccgcggcggcctactgttttatttactatcgttttgtaataggtcttgctacatggaagggcaaaactgtgttggctaactgaatctttctaagggacaaataagggaatccagatagaataaacacagtgaagtacagagtaccaggaactgctctgtttaaagctggtattcttttttaatgataggacatctggcaaacccaccctaatgggcagtttcatttttttccctactatattgcacaaacaataacatttcctgatgtctttgtattgcaaacagcagagtaaacagttctgtatgttacagacaacaacagtaaaaacaacaaaaactggttagctatttttggcactttgtgcttccagataaattttagaatcagctttgttaactttctgtgaggagaaaaaactgttaggatatttattagaattaaattgagtttatcaataagccatttttgtaaatttgggcttatccatgaatctgatagaattgatttacagatataaaaataaaaattttaaacattttatttacatttaaaatttttggaaataatttcagacttacagaaaagttgcagaacttatacaaataaatattacatatccatctcccagaattctcaaaggttatcagaaagataaatcattgacatccattatgttcttgagtctggaaagcagcttaagatcttaataaatacaacttttcaagtttaagaaatctatattgatctgctcctgggaattggagagccatgtgatcttaaaagtgacatggtgtcacttagactaggcctaaaactgagatctcctttaatcattgttggtctgtatccttatgtgaacagaaataaatccactgccactctctgctcccaaggtgcttggatccaatctgttgaaagaagggcttcttagacagttgtagggtagataattcaaatcaagttggcatcaggatgacacaagaatggcttctggaagtttggctcagctgagccagagatgcctttattggaggaatgggacaccctctcttgggagagacagtatagggtagtagttaaggtcacaggcttggcaccagactgtctttggtgtgaatcccagtgttgctaatttttggttttggaagcttgggcaagtgacctaacaacctgtgccttaatttctttacctctaaagtgaagctaacaataataacagtgtctatcatataggactcatatgaatcaaatgagtttgtagcatatccacatcactcacaacagtgcccagcaggtagtaagtgatcagtaatgtaagctgttaatatttaatgtcactggataaagctttatgatttttttgaagatcttgaattccttttgttaggataccctatagttttggtccttactgttaatagtagcttttaaaattgtttataattgtttcgggtttcttgttatgctcttgtaggtttcatagttttaatgagaaatatcgacagaaaattcagagaatcacaccctttgcaaataatgactgttttgtttcctcttttgtaatcctcttttgtgttacttttctttcttattttaagattgctggctagttcctccagtaaaaatcgtattagaatctatgatcatgggaatccttatttttctcctgcttttttttaaagggaatgtttcctgcttttggaagcatcacatatgtttttggtatattgcctttattctcttttattcctactttgctaaattatcacaaacagcaattttatcaacagttttccttgtatttattcagatgatcatctgggctttctcctttcagttgtaaatgatttgaattatgttaatagattttctaatgttaaattatccttatattcttgaaattaatcctgcttggttgtgatgtatttttttaatacatttccagatttaatacgttaatattctcctttggatttttgcacatatgtcataaaatttcactcataattttgttatactgtctttttcttctcttactaagattaataaggcaaggcttggtggctcacgcctgtaatcccagcactttgggaggctgaggcaggcggatcatttgaggtcaggagttcaagaccagcctggctaacatgatgaaaccctgtctctactgaaaatataaaagttagccgggcgtggtggcgcgtgactgtaatcccagctactcaggaggttgaggcaggatgactgcttgaacccaggaggcggaggttgcagtgagctgagatggtgtcactgcattccagcctgggagacagagtgagacgtctcaaaaaacaaacaaaaagattaatatagctttttttttggtagagactactatgggttttttttttgtagagactactgtgttgctcaggctggtcgtgaactcccagtctcaagcgatcttctcaccttggcctcccaaagtgctgagagtacaggtatgagtcaccatgcctggacaaaatacagctttttatttattttcttgagacagggtcttcccatgctggagtgcaaagacataactgtagtattttcaaattttttttaagttggcctctaacttaattgcatgataatcacagaacagtctgtatgatactgattgtttcgtttttatttatacttaatttgtggcatactacacagtcagttttcataaatatttcatttgtactttagaagtttgtataacaactgttgggtgagggggttggggaacgcagaaaaataaaaatgttgggtgaagttttattctgtatgtccttacatcaagcttatcagttatgttgtccaaatcttccatattttaccaacttttgatttttgttttgttttgttttgttttgtttgtttgtttgttgagacagggtcttgctttgttgcccaggctggagtgcagtggtgcagtcgcggctcactgcagcctcaaactcttggactcaagcgatcctcctgcctcagcctcccgagtagctagaaccacaggcacacaccaccacaccctgctaatttttgtgttttttatagagatgggggttcgccatgttgcccaggctgggctcaggcgatcctcccaccttggcctcccaaagtgctgggattacaggtgtgagccaccgcgcccagccaggtgttcttgatttaacaattccagagagaactatgttaaagtttttttttaatgactgaatttgtgaacttctcttcataattttgtcaaacgtgtctgcatataatttgaagttctctttagaattgtttcctagagaattgtagagagcatctttatccctaacagtactttttctcatggtctttttttgtctggtattaatgtcagctttctttttgtaaatatttgcctgctacatcttttcttatcccttttctttttctctatgtcctaatgtcttaggtgtatctcctgtgaatgacatatagttggatttttttccagcctattttgagactgtcttttgattggcatgtttaacccatttaaaagtattatgatagcaattgtgtattatcttaatatctcatttgataccttatgtaatttatttaatatcattaaatacattattatttcatatcttactttgtgctattgaccatgttttgtttgcatttttctccttttcagtcttttcttttcttttcttttctttttttttgagatggagtctcgctgtgtcacccaggctggagttcagtggcgcgatcttggctcactgcaggccccgcctcccaggttcacgccattctcttgcttcagcctcccaagtagctgggactacaggcgctcgccaccacacccagctaatttttttgtatttttagtggagacaaggtttcaccgtgttagccaggaaggtctcgatctcctgacctcatgatccgctgccctcggcctcccaaagtgctgggattacaggcgtgagccaccgcgcccggccccttcagtcttttcttagaaagggtttcattattctaccatttggaaactttcagttctgttacaggctactcttaaatttttggcttgcatgcttcattaaaatcttaaatcaatatctctactctcttcccaaatagaaatccacagtttgtcttacacattgctgtggatcggtattacaattctaccttgttttgtttgtttgtttgtttttgagatggagttttgcttttgttgcccaggctggagtgcaatggggcggtctcagctcagtgcaacgtccacctcccgggttcaagtgattctcctgcctcagcctcgcaagtagctgggatcacaagtgtgtgccaccatgccgggctaatttctgtgtttttagtagagactctttcaccacgttggccaggctggtctcaaactcctgacctcaagtgatccatctgcctcggcctcccacgatgctgggattacaggcgtgagccaggcgcctggccttcccctttgcttttataccctggaattagttgttgctattcttatttgatgaagtctgcttatttgaattcactcacctgcttgccaacttttttgccttcccttccttcttttatcatacttcatccttttgagttaaatttccttcttccagaggtaggctttaacactgttttttagtgagagtctgttggtgctaaactctttttgcttacctaaaagtgtttttatttgtcataaccattggataatttagctagttataaaagtctgggttggcatttactgtttctcagcaattagatgatgttattgtgtttcattatcttctagcttttgatattactgcatttgaaaagtcttctcaactcttagagttaatgtttttttctcttggctgctttatcttgtctttactcatggtgctctccaaatttactgtcatatgttccggatttaatttatttttatacatctgtttgctatttgtccttgaatatcaaatatcatgtgtttcacagcacctaagaaattatcatctagttatctcttcaaattttacctttcttttattctttcccatccctccttttgaaaatcctagaaattttatattgggccttctgtctgccttcctgtttcttaaactcttttgtattttccagttctttatatgctttactatgggtaattccttatctctgttttcagtacactaatccttccgtccgtccatccatccgtctcgctctgttgctcacgctggagtgggctggcatggtggtgggcacctgtaatcccagctacttgggaggctgaggcaggagaatcacttggacccaggaggcggaggttgcagtgagatgagatcatgccactgcactccagcctgggtgacagagcgagactctgtctcaaaaatttttttaaaaaataattaattggctgagcgcggtggctcacgcctgtaatcccagcactttgggaggctgtggcgggtggatcacgaggtcaggagatcgagaccatcctggctaacatggtgaaaccccgtctctactaaaaatacaaaaaaaaattagccaggcatggtggcgggcacctgaagtcccagctactcaggaggctgaggcaggagaatggcgtgaacccgggaggcggagcttgcagtgagccgagattgtgccactgcactccagcctgggcgacaaagcgagactccgtctcaaaaaaaaaacaaaacaaaaaacacaaattaattaaaataaataaataaatttaaattagtgaaaattaatgaacaaaatttaaattccatttctgagttactctagccacattttcagtgctcggtaaccacaaatggttagtgactgctgtcattggaacatttccatcattgcagaaagtgctgttggacagtgctgctcaaaactcttccgtagtgctcttatagtacagagagaatcggtaaatgtgtaatttcagaaaatggatcaagtgaacttgcccttgtgctgagagtctaggaggttctctttagcatgataccattctgcatcaactatgtttaggaagaattcagagacggtgttgcattcttaggatgatttatgggatcattggtgatcccaagctgacttttctttcctgtaatttggtaattggaagaggagaaaccaggtaagcaggaacccccaatgttgaatacgctttggggaaaatggagaaaaatttctacattgattttatgcagctctgtttaatctgagactagagaggatgggtttgtgaggtgactggagaaaaacagcttaagttcttatgacttgaaatttgactcaagttggaaattccttgtaattaagtcatcttttctctccacccccttaaattgccatctcattctcctttgagttgctatagaacagttaaagattctcaagaaaagataccttcccctaccttaccccccacattcacatacccacaccttctttaaataaagcatcatttaacagtgactggactccagatacaccaaggttaagaaagtcacaccaggccggacgcagtggctcacgcctgtaaacctggcactttgggaggccaaggtggatggatcacctgacgtcaggagttggagaccagcctggccaacatggccaaaccccgtctctactaaaaatacaaaaattagttgggcgtggtggcaggcacctgtaatcccagctactcgggaggctgaggcaggagaatctcttgaacccgggaggtggaggttgcagtgacctgagatcacgccacttcactccagcctgggtgaaagagcgaaactccatcaaacaaacaaacaaacaaaaaaaacaaaaaaaaaggtcacaccagcctgggccccaacaagctatgtaggagggaagagccactgacccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttagccaggatagtctcgatctccctgaccttgtgatccgcccatctcggcctcccaaagtgctgggattacaggactgagccaccacgcctggcctattttattttgtttttgtttctgttgtaatttctggaaacttgtacctggaagtgaaatctattcacagcacacttctccctgactatccccccaaaattgtgccccaaaatgcttatacctgtttagctctttgttagggaccatatctaccatttggccacaatttctctatgagttgttataagactaccacaggaaagatcgtatagcccctcctataaacttagtttgttcttagggaccaattaaataataagccagcaaagagctcgacccccactgcagaggacatttcgtaagaggggattcataggagccccactttctctttcccagccctctgttctgaagaatctgaatgtgtctaacttgtttcagagttcactgtttctttccatttttctttctgatgggatgattgcttctgccaatggctagactagagcataagaaatttttatcttggatcgacatctgagagctctaaaagaaaacaccaggcagtggggggacggggtgggtgggattttaagtcaggcctgcaagaggcagctagtcatgggtctgcactcagcctggtgcttttgcttccttggggtgctgccaacagaaaccgttaaataggcagcatgctggtgaggcctatacatctgtctgggataggatcccacagaggggtcttgtgtgggattgatccaataaccccatagtttgagtcaggtgacaggtcagcaagggcctgaattttcctccctcttctagtgatctgcagaataatcaaatgaccaataactaagcatcttatttgagttgtaaaagaactctcatctgtgtttaaacgaacatttaaaatattcctaaaaaagaaaaacattctaaggttatttatttttttttttaagctgttgctgttacatgtgactgagcaactgtgtgggcaagagtaaaagtactggcatagaacctggaaacaagagtttagaatgaagttgaacccattacccaacagcaaggtcaatgtttatagcgttcccctgagctcagagcccttttggatgacgtgtcatttccttcatgcctctagaaagtggagaaacaggagcagattaggaaaagtacttggaaaaattctgtaatgatttgagccttagccaggcttaatacttcagtgtttgaactcttccctactgagacttttgctttcatagcagtttttcttggttattaaaaaaatatatacaacaaagtagatcgtaacagtagtatgtaataagaatatttctggccaggcgcagtggctcacccctgtaatcccagcactttgggaggcagaggcaggcagattacttgaggccaggagttcgagaccagcctggccaacgtggtgaaaccccgtctctactaaaaatgcaaaaattagcctggcgtggtggtgcgtgcctttaatcccagctactcaggaggctgaggcacaagaatcacttgaacccagaggcggcactccagcctgggcaacagaatgagactgtctcaaaaaaaaaaagaaagaaagaaaaagaatatcactaataacagacatttatttcatcttattaagtgcccggcacagttctaaatgcttaacattcaattattgaatcctcaccccttgaggtgattcctgttaacattcctatttcacagataaggaaaccaagacccagcggttagggaactcagccagtgttacatagctagaaagtggtgtggctctagccatgtatagtggctccttcctgtaatcccagcactttgggaggctgaggcaggaggattgcatgagcccaggaggtcaaggctgcaatgagctgtgatcacaccactgcactccagcctgggcaacatagcaagaccctgtctcttaaaaaaaaaagaaaataaaagtgctgtggctctaataaatggtatctcatgttgttattaaattgcaatcagtttggccatcaaaaattgaattgtgggaatcctttttagccctatagctgggcctatgacattctttgtagttttgtaaaatggtggagtagattttcttaccttgtcagccataagagttgccccctgtgactccatttatctgctgtttataatatcagtcctttcaaccatctttgactccagcaggaactacagcccattgaacctattttcttctccctttccctcacgccctcatgcctgtacttttctccttaaacaacttaaattccatggtcagtcattataatgactgcctcatgtactacactctcaatcctcttcccctcttttgccttgtcacacttgcttggctaaatcacaactctggttaaatccaaatctctgcctactttgtgggtgtgcccctgggttagaagaaacactgagcacattcgctgtcctcactcttaattcatgattactaaccttaaacaggcccctaatgctgtctgggaatcctgctgtatttccacagttccttcattctccagcctcctagaggactcttccatactttctcctctcttttaaaaacacctttcttagcctttgttgatgaccttcctatttcattgagaaaacaatggcactcgccaccgtatccacccacgtgcttgtatatctgccttttccccctttcctgtaactaggtatgagttgtacatgatccttgcaagggccaatacctccatttgcaaacaaaatttcattcccacttcctgagtccatccagagtgctgctccaaccttcctctgctctctgctaaatattaccgctctagtggtacattcctattggcatactaactgctgctatttcttccatcttgaaaacaggaataacaaattaacttatcatgattctacttcccctacagatactagtccattctggtactttttgttttttgttttttgtttttgagacggagtttcactcgacgcccaggctagagtgcaatggcgtgatgtcggctcactgcaacctctgtctcctgggttcaagtgattctcctgcctcagcctcccaagtagctgggattacaaccatgtgccatcacacctggctaattttttgtgtttttagtagagatggggtttcaccatgttggccaggctagtctcgaacttctgacctcaagtgatccacccaccttgggctcccaaagtgctgggattataggcgtgagcctctgtgcccggcccctgctacttcttttaagacgaaaagttctcaagaattctcttttcttggttttctgatttttcttcttccatcctccttgaatccactccactcaggtgtttgccctcatcactcaattgaaacagctcttatcaaggtcactgaggacctttgtactgctaaatccagtagcctattgtcagttctcagtttgggaaaagtggctgcattttacccagctggtcatttccttccccttgaaacactgtcttcactgcttctagaatacgatgctcacttagttttcttcctatctctctcattggttttatctcctttgcagattcctctttatctctctacctcaaatgttgaaaggcacgaaggcttagtccttgaaccaactctctttttatatatcacaaacttggtgaagtcattaatattagtggttgtaaatacagtgtgtatgctacatgtccagcttgactgcaatcttgacctttttttttttggctacaactccagcttgactgcagtcttgacttttttattatttaatttaattttaattttaattttcattttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaacaaacaaaaaatttattgaggctgggtgtgggctgatcacttgaggtcaggagttcgagaccagcctggccaacattgtgaaaacccatttctactaaaactacaaaaattagccaggtgaagaaaaaaaaattagccaggtgttgtgttgtggtgaatgcttgtaatcccagctactcaagaggccaaggagggaagattgcttgaacccaggaggcagaggttgcagtgacctgagagagcaccactgcattccagccttggtgacagagcaagatgctatctcaaaaaaaaaaaaaaaaaaacctgttattgaaataattcacataccatacaattcactcattcaaagtaaacagttgaatggtttttagtatattctgagaattgtacaaccatcaccacatttaccatactcatgacagtacagaaataaacacatgcatctatggtcaactgattttcaacaagggtgtcaagaccattcaatagagaaagaatagtgttttcaatagatgctactgggacaactgaatatccatatggaaaagaatgtggtttggacccctacctcacaccacatacaaaaattaattccaaatggatcaaagacctaaatataagaactaaaactttgatctgcagtagctggaggaaaaaaaaaagagagaaatatttaaagaaaaagagaaaaaaactataaaactcttagaaggaaatgtagttggaaatcttactgaccttgcattgggcagtagtttcttaaatatgacaccaacagcacaagcaacacaagagaaaaataataaattttagaaccttttttaattagtccaaaaagaaaccccataaccattagcagtagctctgttttcctccattttcccctacccaagacaaccactaatccactttctgcctatgtaaacttgcctattctggacattttatataaatgggataatatataatgcatagcttttagcatctggtttctttaagttaccataatgttttcaaggttcactcacattgtagcatgcagcactttattcctttttttttttttttttttttgttaagacggagcctcgctctgtcacccaggctggagtgcggtggcgtgatttcggttcactgcaacctccgcctcccgggttcaagcaattcttcctcagcctcctaaatagctgggactagaggtgtgcaccaccacgcctagctaatgtttgtatttttagtagagatggggtttcaccacattaaccaggctcgtcttgaacgcctgacctcatgatccgcccacctcagcctcccaaagtgctaggattacaggcgtgagccactgcgccccacctgtttttttttttttagacagagtcttgctctgttgcccaggctggagtgaactggcgcgatcttggctctctgcaatctccgcctcctgggttcaagtcattctcctgcctcagcctcccaggtagctaggattacaggcgtgcaccaccaaacccaactaatttttgtatttttagtagagagagggtttcaccatgttggtcaggatggtctctatctcccgacctcgtgatctgcctgcctcagcctcccaaagtgctgggattacaggggagccaccgtgcccggccatgtccaaatttttgtgtagacattttcttgttttacttaaaaaaaatttttttttctaaggttttttgtttgtttgtttgtttgttttgtttgttttgagaaagggtctcactttgtcccccaggctggagagcagtggtgtgatctcagctcactgcagcctgacctccaaagctcgagtgatcctcccacctcagcttcccaagtaactgggactacaggcgcttgccaccatgcctggctaattttttgtattttccatagagacagggcatgttgcccaggctgttctcgaactcctgaactcaagcattctgcccatctcggcttctcaaagtgttggaattacaggcgtgagccaccacacccggctatatatacctacgagtagaattgctcggtcagttctactgtgtcgagtcaattctgccggatctacccggtagaaatgctgggtaactttaattgaatctttttgaggaattgccagcctgttttccaaaggaattgcacaattttatactcccaccaacagtatataagggttctgattctccacatcttttccaacacttattattacctgtctatttgataatagcagtcatagtggttctgatgtggtatcattatagttttgatttgcaaaggatattgggcatcttttcttgtgaggtttttttttttttttttttttttgatacggagtcttgctctgtcgcccaggctggagtgcagtggtacggtctcagcttactacaccctccgtctcctgggttcaagcaattgtctcgccttagcctcctgagtagctgggattataggcacctgccatcctgcctggctaagttttgtatttttgtagagatggggtttcaccatgttggccaggctggtcttgaactcctgacctcaggtgatctgcccacctcagcctcccaaagtgctgggattacaggcatgagccactgcacccggccttttcttgtttttattgggtcttcatatatagtccttggagaaatgtctatgcaagtcttttgtcaattgactttgtcaattgtcattgcactccagcctgggcaacaagagcgaaactccatctcaaaaaacaaacaaacaacaacacaaagaaaattaaagacttgtgctgcagaggatactatctagaaaataataagataagttacagaatgggagaaaaattttgcaaatcatgttctgataaggaattagtatatctaaaatgtataaaaatgtcttacaactcaacaaccaaaagacaaacaattcaattaaaaaatttacaaaggaccagatgcagtagctcatgcctataataccagcactttgggaggccaagtcaggaggatcacttgagacccagaccagcctgggcaacacagcaagaccctgtctctacaaaaattaaaaattagttgggcatggtggtatatgcctgtagtcccagctactgaggaggctgaggcaggaggatcacttgagccaaggtgttcaaggctgtagtgagctgtaagcatgctgctgcactccatctgggtgacagagcaagactccactggattaccatggaaggtttaagggtactattggcaatacatgtagagtctatttctggactttattctgtttttctttatacgtctgtccttaagccaataccatgttcctttgattactgtggtgttataataagtcttgaaaatccaaaaataataattgatttttttatttttttttttaatttttatttaggggagttttcagggttttaaaatttcaaataaaaattaggatcacccctgggtaatttttaccaaaaaaaaaaaaaaaggaatgcttgcaggaattttgattgggattttattgaatttaaggataaaattgaggaaagtaacatcttaacaatatggcaaactcccattcatggacccggtatttttttagctttaattaaaggctaattaaatttttttaacaagggtttaaaattttttttttttttttttttgagacagcgtctcgctctgtcacccaggctggagtgcaatggcgcaatcttggctcactgcaacctctgcctcccaagttcaagtgattctcccacctcagcctccaagtagctgagattacaggcacaccaccatgcctggctaatttttgtatttttggtagaagcggggtttccccatgttggccaggctcatcttgaactcctgacctcaagtgatctgtttccctcggcctcccaaagtgttgggattacaggcgtcagctattgtgcttggcctatagttttagaataaaagtcttgtgcacattttaaaatatttacctctaaatgattcttctttgatgttgtttaaagattgttaaaattaattgtgacaaaatacacttagcataaaaattacccttggccaggtgcagtggctcacgcctgtaatcctagcactttgggaggctaaggtgggcagattgcctgagctcaggagtttgagaccagtctgggcaacatggtgaaaccccgactctactaaaatacaaaaaaaaaaaaagaaattagccaggtgtgttggtgcacacctgtagtcccagctacttgggaggctgagccaggagaattgcttgaacccgggaggcggaggttgcagtgagcggagattgtgccactgcaccccagcctcgcgacagagcgaggctccgtctcaaaaacaaaaacaaaaaattaccctcagttatttaaaaatgtacagttcagtagtgttaaatatatttacattgttatgctaccaatccctagaactttttcatcttgccaaactataactctgtacccattaaacaactgctttccatttccctctcccctcagcaaccgccattttattttctatgagcttgaccactcttaataactcatataagcaaaattgtatggtatttgtctttttgtgactggcttatttcacttagcgtaacattctcaagatttatccatgttggagcaaatgtcagaatttacttcctttttatgtacataacacattttgtttgtccccattcatgcattgcatttatggacacttgagttccttctgcctttggatattgtgaacaatgctgtgaacacgaatatacaaacatcctttaagaccctgctttccgttcttttgattttaacttgattaatttttttgaggcagtgcctggctccgttacccagtctggagtacagtgcatgatcttggctcactgcagcctctgccccctgggttcaagtgattcttatgcctcagcctcccaagtagctgggattacaggtgtgcaccactatacctggctaatttttgtaattttagtagagacagggttttgccacgttgcccaggctggtctcaaactcctggcctcaagtgatccaccagcctcagcctcccagagtgcttggattacaggtgtgagccactgcgtccagttggctttcagttcttctggatacatatacccagaagtgaaattgctggatcatatggtaattttattttaaaatttttgaggaactgccataactttttcatagcaactgcaccattttaccattttacattcttactaacagtgcagtgcgtgagttccaatttcttcatatgcttgctgcaatccccaccctccaccccccctccccaggttcgagctattctcctgcctcagcctcccaagtagctgggactacaggtgtgtgcacaactatattttgtaatttttgtagtgacagggttttgccatgttgcctgggctggtctccaactcctgggctcaagtgatcctcctgtctcagcctcccaaagtactagaattacaggcgtgagccgctgcactgggccttaaaatgtttttcttatagaaagtatacatttgatttttctcttttttgagacatcttactctgtcacccaactgcagtgatcatgcaatggtgcgatcttgttgccacccgcaaatccgaatggctctgcagcaacctcaattcttggctcctcagaagaaagaattcaactgaggagcataggcagaaggagagactgaagcaaattttagagcaggagtgaaagtttattaaaaagctttaaagcaggaaagaagggaagtaaagtacacttggaagagggccaagtgggcaacttgagagatcaaatgcacggtttgaccctttgacttggggttttatatgttggcatgcttcggggtcttgtgttacttctccctcgattcttctcttggggttggctgtccgcatgcgcagtggccgccaacacttgggaggggccccatgcacagtgtgcttcctgaaattgtgcacatgcccacttgaggcattcctttaccagctaagtgttcctagagaaaggtcataaactagttaaactctgccattttgcctcttagtgctcatgcctgagcccactcacccaactcctaagagcttattgggatcaccagtttcagctttttctatctactgggagactaccgttctctggcaccagttgcgaccaattattattttagggggacagcttaacaactgcctgaccatcacctgatggtcacctgacattcctggttgggggtgtgaggggacctctcctgctctgctcatgttttactagctacctcctataacaatctcagctcacagcagccttgacctcctgggctcatgtgatcctcctacctcagcctcctgggtagctgggatcacaggcatgtgccatcacacctagctaatttttgtttatttttcgtagagatgagctctccctatgttgcctagcatgccaggctaatttttgtattttttagtagagatggggttttaccatgttagccaggctggtcttgaactcctgaacctcaagtgatttcctgtctcagcctcccaaagtgctgagattacagccgtgagccactacaccgggcttgatgttgctttttaatccagactgacagtctttgcccctaaactggaatgtttatatttaatgcagtcatcaatataattgaatttaaattaattatcttgcttatttgtttcctatccaatactttcatctgtttctttttttttttttttccctctccttctttccttcatttggattaagaaaagttcttatttttttggccgggtggacaacctgtctaaatgtagaaacaacttcattcattttctttctcagctgttcaaactttaaatgtttaaaagggatactaatacctttgtgataactgggtaaagatttgtccagattacacctggatggtatatgtttgtatgtatgtattatacacacgtatgtttaattccctcggccactctgaattgagccatatgtgatttcatttctttattatgtttgcttagagtatattcgagaagatgcttggactatgcagcacttttataggtccagttgtgttgatttgggagagaagagagaaggtgagcatgaacttgacagttcttgtgtgcctgttctgtgccaggcacttggttagtactttacacatgctcttatttttttcctcacaacaatcccaagaggtggaaataaactatttccatcttacagatgggaattgacagagctagaatttcaatctgtcgattccagcagcatcttttgaagctttcatgatgagcagaatggatgatactgttgagatctgtattcatccaggatcttttgttcctcctgtttcagcaaactcttaagattggaactacatcagtagataggtgtgcaatgccagtcttttgcctcatttattaaacaaggcagccgggaagtactcagttttaatgtcacttggtcttcactcttttgtttttttgttttgttttgttttgtttttggagacacagtctccctctgtcacccaggatggaggacagtggcgcaatctagtctctgcctcctgggttcaagcgattatcatgcctcagcctcccaagtagctgggattacaagtgtgcaccaccatgcctggttaattttttgtatttttagtatagacggggtttcaccatgttgaccacgctggtctggaactcctgacctcaggtgatctgccacctaggcctcccaaagtgctgcgattacaggcatgagccagcattcctggcccactcttcttgtttgtgggtagatctcccccaccccagaccttctctccaattcaccttttcttccatctcctttaacattgtaaaaaatggtttctggaccccaaatctatgaatagaatgtgcttagaggcaggagagtactgagctgaaaacatctcactaaccactgattttagttagcatggcctttagaaaggagttaaagcactcatataacctgttttcctaatacaaaatttgggaagcaacaaaaccttttgctgacaaatgtggaaaagtctatgatgaggaagtggattggatcttgcttgtgaacacttattttcttccttctggtagctagatttcaagcttctcttattcctgagatgtagtgaccaagttcatatatgttgactatgattgcatatcatttacctagaagaatattctagggcagacttgaagcctatttttgttgtctgttgttaggcaacaaaacctacctcaaaacttaatggcttaaaacaacatctattttatatttgatcataattctatgacttgggaattcaggcagggctcagctggatggttcttctctatgtgactaacagctggggtgtctcatgacattgtagtcagtgactggaatggctaagatggcttcattcacacatctggcaagttggtgggcatgatgaggaggcaaagccttctctctctcgctgtggctgtctccctagttgtgactagcttggcttttgttatttggaagctaaattccaaaagtgagcataccaggcagcaaaggcagaagctgtaattctcctagggcctactagccttggaagttacatgatgtggctttctccaccttccgttggtcaaaacaagaatttggtttggcattgtgacaaggggaagggcaggagaggggacattgctgaagagctggtaagatggacactattgttgcaactatctttagaaacataatttaccacagaacactttccttggggagcttgagccccactgtaagccagttaaataagaatctctgaagaaacagtaagatgctctccaggaagtcctgtgtgtgtgttcttctaagcacgatctgcagtctggctctttctgtttcatacaacatggcattccagtgtgcaagatgatgagtcctcccactcctttgagccatactgataagagaaattgaaaataatttaagtgctgttattttttttttctaggacacagtcctacttctgtaaaatttccccatctgctccagtatacagtgatgttgagtactattgttttataatcactggtgaattcctggtaagaaccatatcttcttctgtgtttaatctctgtgttaagcacagcattacattccagtaggtatgtgataaatccttgaattgaaccattgaaaatggcactgttgctgctgttctcagtgcctatcagaattgtgcagaattaatagttcctatagatctaacaattacatacccctgttaaaaatatagaaaaaatgtggttttgaaatgaacagatttaaaattagactaaacttgaaaagtggcctaaatgtttttaatggcaaaaactttctgttttatttattatttttaatttgtttggaaaacttttttttttaatgtggaagcatatttagaatactgtgaataaatataagttgctttcctgcaaattgctttatttagggaggccaaaggcagaaccctaaagactttagaaccacttaaaatacagataatttacttggtcattttcaacccaggaacacacagattttactcttgaaactacttataaaaatccttggagttaatggtatacgagagtgttgtagctcatggagtactaaaccatgagatcaatcataagattctccctgatacttgtaagaggtacagattcccaggttcccctttgttagagatttggatataatacatctctggtgagactttgaaatctctgtttttaatgactggtcctggagcttttaggaatgcagatttatgggccccaccccagacctactgaatccagtgggaagagaggggttggtctgtcaacaggtgttccaggtgattcttacgtgtgctgttgttgaagaagcactgttaatagagaaatccctttcatagttctttgccagaaaactacagttctaccagaaagtatcccaaaagattttcactgtatataggaacctgcagttagggatcctccagatgttgtgggatattggttgttactgttttgaaactgaggtatagttgacataccataatattcatacattataaatgtacaatgagatttagtaaatatatagttatgaaaccatcactaaaatcttttgtttctttcttttctttcttttttttttttttttttttttttgagtcttactctgtcactcaggctacagtacagtggcatggtcatagctcaccgcagccttgaccttctaggctcaagggatcctccttcctcagccttccacgtagctggcactgcaggcgagcaccaccacgcatggcttaaaatccaattttataacacttccatctctcaaaaagtcctttttttatttttattgttttaaaacaagggtgtcactctgccacctaggctggagtacagtagtgagactgtagctcactgcagcctcaaactcttgggctcaagcaatcctctcactttgtcctcccaaagtgctgggattacggatgtgaaccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccatatgagaagtttgtgtttaaacgtttgagaaactggcagccttttccaaagtggctgtacattttacattttcatgggcaatggttgagagttccagttttgccacatccttgccaacaccgtgtattgttgacttacggattatagtcattctagtaggtatgtagtggtaccacattgtgattttaatttattttatttatttatttatttttgagacagggtctcaccctgtcgcccaggctagagtgcaacggcatgatctcagctcactgcagcctctgcctcctgggttcaagtgattctcccacttcagcctccagagtagctgggactacgtgtgcatgccgccatatccggctaatttttgtattttttgttacagatggggtttcaccatgttggccaggctggtctccaactcttgacccaagtgatacgcccgcctcagcctctcaaaggtctgggattacaggcgtgagccaccgtgcccagtcctcactgtgattttaatttgtatttcgttagctagtgatgatcccttttcatgtgtttaacaattcacttatcttttttggtgaaatgtcaattcaaatctttgcttgcttgttgttttctgtttttaagacttaattctctcaggagttcgagaccagcctggccaacatggtgaaaccccatctctactaaaaaaaaaaatatatatatataaaattagctgggcatggtggcagacgcctataatcccagctactcgggagcctgaggcaggagaatcacttgaacctgggagacggaggtcgcagtgagctgagatcatgccactgcagtccagcctgggcaacaagagcaaaactccgtctcaaaaaacaaagacttaattattttaatagagcagttttaggttcacagcaaaattaagaggaaggtccaatgattttctgtatatcctcatttttaaaaattgagttgtttgtcagtgagttgtaagagtttatgtattatgaatatgtcttttgtcagatatgatttgcaactattttctcccaatgtgtggcctgtgcttttatttgcttatatggtatctttggaagagcaaacatttttaattttggttgtctaatttatcaattttttgcttttatgaatgatgcttttggtatatgtaaaaaaaagtgtctagaccaaggttacaaaaatttctcctattttcatctagaagttttatagttttagctcttacatatgtctgtgttccattttgagttaatttttggatatggtatgagggagggagtgtctgtttctttcttttttttttttttttttgtaaacacacatatttctagttgtagcaacatcatttgttgaaaagaccatcctttcttcctgaattcccttggcagaatcaactggtcataaatgtagtggtttatttctcggctttcaattctgttccattgatttatgtgtctgttgctattgtggttacttgtaactttatgataagttttgaaattgggtagtgtacagtctccatttttgttcctctttttcaaaataatgttgggttttgactatcctaggtcctttgcatttccatgtacgttttaggatcagcctgttgatttctgcagaatggtttttgaatcctgatattttttcattcagaggtccttgtgacctctcacagagggcctgaaatgtgctcactgctctttagaggttataataagcgaaggcctgctgtacaccaatgcttgatgtattagcgttcttccaggtttggcatgttgggtttaacagctagtgggaacgcaggccaaggccagctccgggacggtaaagatgacccttgagtgcttcccttggtgttatacttggtgtcatcccacctccttgtctcactggtagttggcactccaaaaatacttgaatagaagtgggagactgtctacaataaagaacaagttgagactgatgcatttatcatctctcctctttttgagcctcctttgttttaaagccgtatttataccaatgagtttctaagcagcctggccaagtctggttccctcagccctgagctgtggccagcttcatggttgattgcatttatcagatttttttcacctgttcttgcctaagcctgtaacacattatcactgaaaccagacatggttttatcttttcagaagcttgtgagaggaaactggtgcttcccttcctcagttttactttaaggaacattttttctctttcttgtaaaatttggctgttcttcttttacattttagacatgtgtttgttttgaacaggctgccttccaaaactgtacagttcttatcttccttctacctcaccaggcctttttgtgctggattcactcaaacccagctaatacttacagaacatttaactataatatatgcaaggaatcattttcagtcctgatagatacacagaaatggataagacatggttcttgccctcatagagctcacaatctgataaactctgataaaagagacagtatatggcatatatacacaggtatatatagcatgtaagagacatgggggatcctgggttgggtggagtactggttttccacgaaacctgttgcatatcaggagccagccattcttgctttgtacttttttttttttttttttttttttttgagacagagttttgttcttgttgcccaggctggagggtaatgatgcgatctctgctcactgcaacctccacttccctggttcaagccattctcctgccttggcctcctaggtagctgggattacaggcatgcaccaccatacccggctaattttgtatttgtagtactggctaattttgtgtttgtagtagagacgtggtttcaccatgttggccaggctggtcttgaactgctgacctcaggtgatccacccgcctcagcctcccaaagtgctgggaatacaggtgtgagccaccatgcccagctgctttgtacttttaaaatgtgatcttgactttcagaatttaaactttggaatttcttagagtggtttagatgtcaccttccctaggtgtaggacagatagagctctgactttctttaaaatttattttattttttgagacggagtctctctctgttgcccaggctagaattgcacagcttactgcaacctctgcctcctgggttcaagtgatcctcccacttcagcctcccaaatagctaggactataggcatacaggcatgcgccaccatgcccagctaatttttgtatttttagtagagactggcttttgccatgttggccaggctggtctcaaactcctgatctcaagtgatctgcctgcctcggcctccaaaagtgctgggattataggcatgatgagccactgcacccagccatttttttttttttaaatagagatgggggtcttgctatattgcccaggctggtcttgaactcctggcctcaagcgatcctcctgcctcataaagtgctgggattacagatgtgagccaccatacccagcccaagctcttgactttcaggcttcctcatcctgttgacttctctgccactaatttcacaaggcagtatggccatatttttaattaagttatttgatggacatacccctttcccttggaaaagggactgcgtttataacaaatgaaccatgaatggaattcttaaaagtgaagtaacataatatgttaagcagcttatctgttatttaatataattccctaaggagagcttagtatggtgctctgtcacccatgggcctattcaaagtggaattcctttctctaatgttgcataatacttccaccagaagaaggaggtggtagagtgtttgaaataattattgtgttagctgctgcccctgtcctttttctgtaatgtgggaaacaaacttcgtcttaggatcttctggcaggtgtcctggttggatcgtgggtggtgcttgtccggctgcctcaaggatccagcctagggacatgttctttgagcacttgatgtgagagttttatttgtttgtttgtttttaatttaacccacacccatgcaaactatgttccccatgccaggaccagaataaccctggccagggctcaagaaaaacctagtaacagacctaaaattaaatacatgaactctgcctgcccttttgcatttgcattatggttttttgttaggtgctcttgaccattttttttctattaggaaaaggctgggaaggagaagcttgagtcattaccttaggcatagagaggggatggatgagctgtgaagattactactaataagtagaggtgggaccagtgcaaattgtgctgggtgcaatatttttttttaacttagcaataaagatgctatgacagtgtcaatcgctggctttatctgagccatccatagtaatagacttgtttgtttgtttgtttgttttttaagagacagggtcttgctgtgttgcccaggctggcctcctgccatggccatagcatggtcttgactttgagtgtgaacctgcatctggtgccagtaaacctaacttgctcagctgaatcttcttcttcgtctttttttttttttttttttccagagacagggctaattcacccaggctggagtgcagtggcatgatcatggctcactgcagtctcgaattcctgggctcaagtgatcctcccacctcagcctcccaaatagctggcactacaggccactgtgtcccgctgtcatttagaatttaatgtttgctttttttttaatttttatttttgagatggagtttcactctcgttgcccaagctagagtacaatggcacgatctcagctcattgcaatctccacctcctgggttcaagcagttctcctgcctcagcctcccaagtagctgggattacaggcacgcaccaccatgcctggctaattttttttatttttagtagaaacggggtttcaccatgttaaccaggctggtctcgaactcctgacctcaggtgatctgcctgcctcggcctcccaaagtgctggtattattacatgtgtgagccaccgcgcccagccaaatgtttgcatttatataggcctcaatgagttgggtgtttcattttgtgttttgttttgtttgagacagagttttgctctgtcacccaggctgaagtgcagtggcacgatctcagctcactgtaacctctgcctcctgggttcaagtgattctcgtacctcagcctcccaagtagctgggattacaggcatgtgccaccacgcccagctaagttttgtatttttagtggagacggggtttcaccatgttgcccaggttgatcccgaactcctgacctcaggtgatctgctgccttggcctcccaaaatgctgagattacaggcgtgagccaccacacccagctgttttcttctattattattttttatttatttttttatttttttgagactgagtctcgctctgtcgcccaggctggagcgcagtggcgcgatctctgctcactgcaagctccgcctcctggattcacaccattctcctgcctcagcctcccaagtagctgggactacaggcatctgccaccatgcccggctaatttttttgtatttttaatagagacggggtttcaccgtgttagccaggatggtcttgatctcctgacctcatgatcagcccacctcggcctcccaaagtgctgggattacaggtgtgagccaccacgcccggaatgaagtatttcaggtatacgggacagtacagaaaaataatatagtgatcatctacgtgttagcaccaaaatgaaatgtttatattattttttatttctgtggatttctctgtacttgtaccacttataagaatccccacaattttgtgtgtatgttaaaagtggatataatctgtctcttgccattaaaaaaaattaagcattatgtttttgagatgtattcattacagatccaccccattcatttgaactgctttatagtgttcccttaatatgtggataaatatacctcaacagatttatttatttattttaagagatggggtcccaccctgttactcaggctggtgtgcagcggcatgatcacagttcactgtaatcttgaactcctgggctcaagcagtcttcctgcttcagcctcccaagtagttaggactacaggtgcatgccaccatgcccagctaattcttaaattttttgtagcgatggattctggctatgttgcccaggctggtcttgaactcctggctacaagcaggcctcccagagagtcgggattacaagcatgagcttgtgcctggctcaatttatttatttgtattcatagcaaggggcagttaacttgattccacgtttccgtggttagaaatagagtcacaatgaacacttttgtgtctgtttgttttctaattgttattggcatgtggaggagtgctgttgacttttgtgtgtgtagatcttgcgtctagcaactttgctgaacttgtgttagttattaccatttgtagattttcttgcctttcctaatatagataatcatatcacagctgtttcctccttttaagcccttaaatcttttgcctaccatgttactttgctagggctgctgtactaccaactgggtagcttaaacaacagaaatgtattttctcacagttctagaggcatggcggccgagatcaaggtattagcagggttgtttcttctgaggcctctttccttggcttgcagatggtggtcttctccgcttctccgtgtcctgacatggtcttccctttgtatgtgtctgtgtcctcatcattctttttttttttttgagacaaggtctggctttgttgcctaggttagcatgcagtggtgtgatcatggctcactatagcctcaacctccccaggctcaggggatcctcctgcctcagcttcccaagtagctggaactacaggcacgccgccacgtctggctgatttttgtattttctgtagagatggggttttgccctgttgcccaggctcatctcaaactcctggactcaagtgattcacctgccttggcttcccaaagtgctgggattacagacatgagtcagccccagcccctaatctcctattctcatatgaacaccagttatgttgaattagggcccaccccgatgacctcatttttacttaattacttctttacaggccttattttcaaatatagtcacattctgaagtactggaggttaggacttcagcatataaatttggggagggacactattcagcccctaacattgaataatgctggcttggctctctaattcaccactgaattaaagcagtgaaagtgggcatccttgttttgttcctgaccatagagagatttaaaagagaatgctcttaaaatttcgcctttacaagtggcagttgatgtgggtttctagatacctttcactgagttgaagaaattcccttttgtaacttgtcggctctcgagaatagaaccattagggcctgcctttaccagttaagcatttttggcagaaggactgcacagatgatgatgtgtccttcccactgcatcctatcaggaagctcatgatgtcagtctgtccgtggcttggttcgggtgatctctactaggcaaaggtgatctgtagctgccaactctgaaatggtgcgcagatctcgtttcccagtaacctttgaccggtggtttttaaaacctgtggataatccttacattcattgaattaaaaaaattttaatgactatccttttcatttcaagaaattgtttagttattttttttgtctactttgtccttccttccattctttattagttttttatttgctggaatttggaatccctttttttttttttgagatggagtctctcactttgtcacccaggctggaatgcaatggtgcaatctcagctcactgcaaactccgcctccagagttcaagcaattctcctgcctcagcctcctgaatagctgggactacaggtgtgcaccaccacacccagcttctttttgtatttttagtagagacagggtttcaccatcttggcctggctggtctcaaactcctgaccttaggtgatctgcccgctttggccccccaaagtgctgggattacaggtgtgagcaccacacccggcctggaatccttttttttatgtctttaatcttttaaaaattttttagaccaggtctcgctctgttgcccaggctgggtgcagtagcacgatcatagcttactgcagcctcagccttccaagctcaggcaattctcctgcctcagcctcccgagcagctgggaccacaggtgtgcaccaccacacctggatagtttttaaaaattgcttgtagaggctgggtgcagtggctcacacctgtaatcctaacactttgggaggctgagatgggcagatcacttgagctccggagttagagaccaacctgggcaatatggcgaaactccgtctctacaaaaaatgcaaaaaacaaatttcgctgcttctacttacttctgtacagtaagactagcccacagagtggtcctttgtaccttcgcccggttttcttcagtggtacatcctacataattacagtgcaatagcaaaatgaggcaattggcatgggtgctgttagtaccatccatagaccatattcagatctcatcactttcacatgcacccatttgtgtgtgtgtgtgtgtgtgtgtgtgtgtgtggtttagtgcagtttcatcatacatatgggtttatgtatccaacatcacaatcaagataactgttccactacctcacagatccctaatgctgcccattatagtcatacccatctctcttccctcctccccatccctaataccagtcagccactagtctcttctccagctctagaatttcatcatttcagtaatgctatataaatggaatcatagggcatgtaatccttgggattggctttcttcacttagcataattctccaaactcttgtgtatttcaatagtctattcctttttattgctaagtagtagtccatggtatggatggaccacggtttgtttaatccatccgaggacctttttaaaatacttgtgcccagatgcagtggctcactcctgtaatcccggcacttggtgaggtcaaggcgggaggattgcttgaccccaggaattcgagaccatactgggcaacatggcaaaaccctgtctctacccaaaatacaaaaattagctgggcgtggtggtgcacacctgtagtcccagctacttgggagactgagatcagaggatggtttgagcctgggaggcagaggttgcagtaagctgagattgtgccactgcactccagcctgggcaacagagccaggccttgtctcaacaatcaatcaatcgatcgtgtgttcctgatattaaaaaaaaaataaaaatacttgtagccgccgggcacggtggctcacgcctgtaatcccagcactttgggaggccaaggcgggcggatcacgaggtcaggagatcgagaccatcctggctaacacggtgaaaccccgtctctactaaaaaaatacagaaaaattagctgggcatggtggcaggcgcctgtagtcccagctactcaggaggctgaggtaggagaatgacatgaacccgggaggtggagcttgcagtgagccaagattgcgccactgcactccagcctgggcgacagagcaagactccgtctcaaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccgggttcaagcaattctcctgcctcagcatctcgagtagctgggattacaggtgtgtgccaccacacccagctaattttttacatttttggtagagaaagggtttcctcatggtggccagggtggtctcaaactcctgacctcaagtgatctgcccgccttggcctcccaaagtgttgggattacaggcatgagccaccgcatccagcctgcatctttccctttttttttgggggggggacggagtcttgctgtgtctcccaggctagagtgcagtggcatgatctcggctcactgcaatctctacctcccgggttcaagcgattctcctgcctcagccttgtgagtagctgggattacaggcatgtgccaccacgcccaactaatttttgtatttttagtagatatggggtttcaccgtgttggtcaggctggtctcgaactcctgacctcatgatccacccacctcagcttcccgaagtgctgtgattacaggcatgagccacagcacacagcccatctttttttaaactatgtttgtttaatcatcacaaatctattcatctatccactcctttatttatctatccacctcttattttgtacacatttcaaagtaaactatagacatctgtatacttatctttaaatatttcaatatgtacatcattaactggtgttaagtatttctttatagcttttcctcttggtggaaagtttacatacaaagaaatgtacacattttaagtacatgttcactgggttttgacaagtacatgcatcagcaaaacccaaaaccctatcaagatagagaatgtgcccgggcgtggtggctcacgcctgtttttccagcactttgggaggccaaggctggaggattgcttgaacccagaagttcgagaccaacttgggcaacatggtgaaaccccatctctaccaaaaatacataaaaattacctgggtgtggtggcgtgcacctgtagtctcagctgcttgggaggctgaggtgggaaaattgcttgagcccaggaggcagaggttgcagtgagccagcatggcaccactgcattccagcctgagtgacagagccagaccctgtctcaaaaaaaaaaaaaagaaaagaaaaagataatgttatgttaccccacctgcctcacattgtgagtcagtagactcatagttgggtccaaacataagatgtttgtaaaaaggtccctgattttgaccactacccttttaaataaagaagcttggggatgtgaaagtcctcctccaggtcagcaggcttgtttaaggtgagaccatgtcctctgacctcagggctatgactgccattctcacttcttcaaggccacctccatttccagcaggcaggtgtgtcagacagtaaaattgagagaactgttcagtgaacacccatataaccaccacctcaaccgtgcagccaacattgtctatattgctttatcacagactgtctatacagccttccctccatcgatctgtctgtccgtccagcttactgttgtgatgcatttcacaaaatgcactcttaatcattgcatgatctcttttgtgattttgctctgtggaacacaaacttacagagttaaagcaaggctggcaacccatgtgaaaatgaggagaatctgagccttttcatttgctgccactggggacatgatgtgaatcggcgccctctgacttagctccatggggcctctggattggaagtgagggaggagcctcctgagcaaatggactgaaattcctgccctaggtaggctgattgccttcctgaagctctatttatagatcgcagaggaaatctagggggctttatctcacttcccaccccacataataaaactggttcaggtgggtggctagaaccttaaagttaaacatcaattatctaaatatacatataaggtgggaatagagggtcagaaaagcatttttgttctctaacttgaggactccagctaaaaacataaaaatcgccaatggctgggtgcagtggctcatgcctgtaatcccagcactttgggaggccaaggcaggtggatcacctgaggtcaggagttcaagactagcctggccaacatggtgaaaccctgtctctactaaaaatacaaaaattagccaggcctggtggcacacgcctatagtcccagctactcaagagactgaggcaggagaatcgcttgaacctgggaggcggaggttgcggtgagccgagatcacaccattgcactccagccttctgtgacagagcgagactccatctcaaaaaaaaaaaaaaaaaaaaaatcaccaatgtccagtggctgtcactatcaggggctatttgtgagcttccctaatgcccatgatagatgtgccccgtgctgtaaaacacatccacctattaaataagcagagtggactcacataagtagtaatttcctcacaagctcagaaaatgtcttttcagtttgtactttggtgtgtacacatcacattttggagaaagtctagactttagaaaagagcctttagggtattcccaggttgttcctgggctcctgtactccctgttcaggtcacctctgctggctttggctcattgtggccacgcaagttctttgttacatattccctttggtgatcagagtcttcccaagccatggtcaaaactttacttttcgtatgaactatgtgtcttccccttcagggaataggactgatgccatttgagattatttcttccttccttgttgacaattccctttgtactcccccaaggccctaagcaaggacccttagtttcctctggtttcgtggttcctgtgaaaaaggcagaagcccatgtggaaaatcctcatcctgctgtgtttcaacaagcaaagtgcattttgtctttcagagtgggaaggaccttaactgtgttgaccagaagtgcagttcctggcttcagccattttgctttggagaaggaaaataaatgcagtgacctttgttgtgagggtagggtactcttgttctaaaagtccatttgtggtgaggcgtggccctgctgggagaagctgatgccactttgcctccctggcaccctgccagttctgtctgctttgttgactttggtggctcaagggacaagccaggcactggctcatcttttcctgcctgattctctgggcagatttctccatagggtctgcagggaagtgggggaaagctgggtatggtcagagtggagatcactatgtgggcttctcagtcctcatgctggtctgtgtcaggtgcctttaattcagggcctaaggaaccattgctttttagcctaagcagcaatttaataatttagcaatcaggtaatactggcactttgttctcccctggctgttttctcaagctaagttctgtgttagcatttcttgatttctcccctgatactaatcctcctgggagattggccttacctattcacgtggagcgtggcttctctaggaatgtgggaattgctccatggcaatggtgctttggccttcactgcccacatcactgggaccatcccagcccttcttgtctctagccttttttacaggtcaagtccaaacaggaggatctgactctcttcttggtcttttctcctgtctagctgtcttgttttagagcagaaattaaaggagcagggtgtcctaatgaaactgttactgtgatcatatcagctctctagaacaaattcagaaagacggccctttgtaacaggcagactgggtgggcaggcgttcgtttgtaaagagatggctttcctctcccaacaagcagggccaggcatcaccccatgctgcattgatgcagggagtgaattgagaagtgtgggaacgtcatttggactctttccattgctcccattttaatgctttctaaaggaactgtttctcaggtttaaataaagtggcaacactggcttactagaacttatttatttttatttatttatttttgaggcggagtctcgctgtatcacccaggcttactagaatttagaaccactccttcatttgtgtgtatccattctgtctttccagtccccaatgtatgatgtagaatctcaccttcttgcagcagaaccagtgccctaagttattggatgtctttgttgtgaagaacttggttccagcactttccatgctaccagcccaggagtaggtcgtgttctgtcctcaaacattggagtcttgggtagactgcaggcctgatgacaggcattgctcgtctccctatgagaggccttttccttcctttgcccacagagcattgtggacacaccagctgcctgcctggaagaaggagctccttcctaccagcctgtggagtctcatttctgctggaaaggcataagaatgctgcagacttgacctcgggaccctaccacgctttccaagtgaccttagagattaaagatctttgattttacagaagaaaaacagcataaacactcagtcttgtgggggtagttattgcctttcctactaaaagtagcattacctgggaaagctggccttgtctccaactgggcacatccttgaaggaccaagagggtcttctaagaaaaccatcaatgtttctgttccagtatttcctcgataaagacatttgccaaccagtgatccaagctatccctcagctgctcagaatttacctcaattcctttgctgagcaggcatgttgtatttctatgtaatggggcatatttgcctttggagaaaattctgaggactgtaatcattttagccattgatagctgatggtcagttctgcaggtgcctctccccatatcacattaagactcctttttatatatagtttgaagtttaaggatccataaggatgaattggaatcttcttcttaagaggtatgggcttaagaaagttgaactgtaaaaggatcagtttcattctattcagcccagcgtgtaagcctagtgactgtgtgttcattcacattttcatcaggcagctctggccagaggccctgaaagggttgagtatggtggaagattccatcgttttcaatgacagtactgctcataagttctagtggttctgaaaagaataggtttaaaagtgaggtataagattatgtatgatgttgatgttatgtgtgaggttgatgtttacctttcttggttgacaaatctggtattggtcctctgacaagaatggaaactgtatgtttggacaaaaatactgaagatacagatactgaagttcacaagtatcatgatgtgagaggatagatcattttcatttcaaggacttggttcatggaaaaaccttttttttttttattcctttgagacagttttcctcttgtcacccaggctggagtgcaatgtcatgatctcagctcactgcaacctctaccttctgggttcaagtgattctcttgcctcagcctccctagtagctgggattacaggtgtgtgccaccatgcttggctaatttttgtatttttagtagagatggggtaacttaagaagttaccatgttggccaggctggttttgaactcctgacctcatgtgatccacccgccttggcctcccaaagtgctgggattacaggcctgagccactgcgcctggtcaggaaaagactttttaatgccactagattcctctcctgatgcattcaggcctgtggcatcctctagttcagtttcttgggtagttggtattacagatttagagtcttgttttgatggacatttctccatacagagtaccgtaatgctgttgcattttctttcagatttgttcagaatctcctgggggtttctctcattcagaatcaggtactaccggggcatcttggaatacccccaccctgccgtcctgctgcatgtccctgctcctttgactccattgtagttcacgtgcttgtttgttgcttattcatgccagatttctaatataaatggaatttagtaaggttattctaatacaaatacagatggtgacagttttgttttcttctttgctctgctagagtcaccaggtttgatcaacacttggagttttttttaatatattgatttggtcctggataaagaggtgccagattaagaaaagctccttaagaagcaatttattccttagccaggggcttggcctgtttggtgtagcagagtgaccagattcattctggtctttcaggtgctatcttgaccgctttcatttttataaataagggattcatcttccctggcctcaggatcgtcataacagctgctttgcaagaaattcgatggaattggttctttccttctgccttggaaactgctatgtatttttcatttttatttttttgagagtctcactctgtcaccccagctggagcgcagtggcacaatctcagcttactgcaacttccgtctcccgggttcaagtgattctcttgcctcagcctcctgagtagagtagctgggattacaggtgtgcactaccacacccagctaattattgtatttttagtagagatgggattttaccatgttggccaggttggtcgtgaactcttgaccttaggtgatccacctgcctcagcctcccaaagtgctggggtttacaggcgtgagccaccacgcccacccagaaattgctgtttatacatggtgggctgtgtgtggagaaaagtagggaccactgctgttgtaaaccttctcaacaaatatgaggcctgagagagaaccgcattccatcctttctggtcctctaaatacactgatacttgacctgccctttttcctttccttttcttttttttttttttaaatattttatgttattttattattttagagacgggggggtggtctcactatgttgtccaggctgatctcgaactcctggtcccatgcagtcctcccacctcagcctgcctgggactacaagcatgtgccacaatggacgctcctttgctttctgtgcgggagcgtttagatctgaggagcgctgtggctggtcccttgaggtgagctgttctcatccattatatgcagctttttctactttggctttcagtagctttgcttgcaaggagcactctaagaataacacaataaatgttagacccaaggattatttccccaaacctgctggcccaacactgttgcagtcagcaggaactaaggagaataacagagtagccaaggcctctcaaaagaatgagataaattgttaaagatgggacaactactctagaccagaaatgactgccatagtggggatcagttaaagaggaatcatagccctactggacaacagggctcccaggacttgggcagaaagtaagtagcaaacctcatcacgctgctttggaaaagggatttgggttgagtttggtaacctgatgacagactaggtggagggtagatggcagtgggtgttggtactcatcttgctctgctggttggactcaggagagttgttccacatcctcgtggttcctttccgtttgtcctttaaataaatcggtctcatcccccaggagatgcgctgggctttctgtgtgccttagttgagagtgtttgaccaccttgtgttttccttggactgttgatgagctgctgccaaatgttacccttccaaggggctgctacccgccaggcttttcatacttgaatataaacaactagatactggccttgatccccagctgtgtgagcatctgggagcagtgaaggaagcctcagaatgtgtcaggcctgcctgctctaggaagagccagaggaactgccaaccatccggactgttttgagagtaggtgtcaggactttgcagctaccctttgcccttgtaggcttggccccagatatcttggattttcttttttcttttcttttcttttcctttccttccttctttccttctttactttctttttttttttttcttttttttttttttttttgtggagaaagggtctcatctgtcccccaggctggagtgnnnnnnnnnnnnnnnnnnnncaagtagctgggactacaggcatgcaccaccacgcctggctaagttttgtattttttgtagagacagggtttcaccatgttagccaggctggatatcttggattttcaaaaagaacagcataatgaattcagataaagcatgagaaatctcagatgcagtgggggtatcagagaaaactacccatcttcttacttttgtttgtgacgaaatggctcagatctcgtaggaaccggtttttcagccatcaaaaagactcccatctatctcttgaagtttgttctcaggtcttatctgatccttccatttctgaatgtgagcagagaagtgtttggagccaaaagttcgaagtttttactctacctgtaatgtttggaaattgtataaatcaatttaaacatggactaaaggtcttaggctgatggatttgaccgctcctttctctccttcaggccggctttgtttcatttgacccttgaagttacattctttatgttccttcatctcatttctctcttcactcctttacaaagtctaggggatcagacagacaatttgactaggattttatgactagacctcgtttgattatttggtacagcccaggatattaggagcttctctcagttgtagaaacccaggagcacttggacttgccgttacaaaccaaggtgaagtgacagttttcttttcttttttttttgaggcgagtctcactctcttgcccaggctggagtgcagtgacacgatctcggctcactgcaacctccgcctcacaggttcaagtgattctcctgcctcagcctcccgagtagctggaactacaggcgcgcatcaccacacctggctaatttttgtatttttagtagagacagggtttcaccatattgaccaagctggtctcaaactcctgacgttgtgatccgcccatcttgcctcccaaagtgctgggattacaggcatgagccattgcacccggccgacagttttctaagttagggtagtcccaccttgcctgtggcaggagcagggaaatatatcctatctctacatttgagcacaatgaccatgaaatccaccctagcataccagactcagaaaatctttttttttttttttttttttgagacagtttcattctgtcgcccaggcttggagtgcagtggtgtgatctcggctcactgcaacctccgcctcccaggttcaagcgattctcctgcctccctcccaagtagctggtattacaggcacacaccaccctgcctcgctaatttttgtatttttagtagagatggggttttgccatgttggccaggctggtcttgagctccttgacctcaagtgatccacttgcctcggcctcccaaagtgctgagattacaggcgtgagccaccgcgcccggccagaaacttggattttaatcttggccgcagctttgattttgatggtagaattccaaggtcatctctatttctcccctgtactatgagggtactggagttttgtaacttcgtgaggaggaggaggctaagaaaatagggaaggaagttctcaagaaggctgtgcagtggtgactccccttcaggggacactaacgaattcagatcctaatatgaagctctgattaaaaaaaatagtaatacattttttgtgggtacatagtaggtatgcatttttatggggtacatgagatgttttgatacaggcattcagtgtgaaataataagcaggtcatgaagaatggggtatccatcccctcaagcatttatcctttgagttacacacgaaacaattacactctttattttaaaatatgcaattaagttattaactggctatagtcaccctattgtgctatcaaatagtaggtcttattcattttttctattattttgcacccattaaccatccccacctccccccacacccccagtacccttcccaacctctggtaaccatccttctaccctctgtgtccatgaattcaattgttttggtttttagatcccaccaataagtgagaacatatgatgtttatctttcttttcctggcttatttcacttaacataatgatctccggttccattcatgttgttgcagattactggatctcactcttttttatgggtgaatcgtacttcatagtgtatatgtaccacgttttctttaaacattcatctgttgatggacagctctgatatttttgccagcagttttgtgatttgattttgcatgtgtgtgtgatggcaaagttacctagggaagaagacataaaaagtatgggacttctcaattgatccctacaccacagtatgactttcactcctttaggtttcttaacacaacgagtcgtcttgtcagcagcttggtttaaagtgctaatttgaggaaccaggtgctttgcgtcagcttctgacctggctgagaccttttactgacaattggcccaagtgtagtagaactgggagaggttccctttcccaagagcctgctgccgagacagtagaagatggtggtttatattgtatttcccttaaggtaatctgtgagagaagcttaaaattaggttacacttttgacttgacacaagtgtcaatgaaaaaatattcatgttctcgttgttatgctacgagatctaagccaagtgagaaatctaagcaaatggttgttcagtcacttcagaagaatcgagacaacttacagaacttgctttgacagagctgttccagctcatttgtaataacatgcttagaaccttctgcgttcaagagcatgtcagaagggaatgcctggtcgttgtctccctgggaagcagcgtggagcacagccccgggagacgaaggcagcagaggcccgtgaccatcaagcaccagcctctcaaggcatctctgaaggcagctgagaagtttccatcgacagtggctcatggccagtgcactgaccttttgctaaagttggcagttgctgaagtgaaatgaattctttatcggaaagagtcaattaaaagagctaagtcaaagagagtgcaaatatggactgtgtctttacctttccacagcagctttggccgcatgcccccgagctccctttgtcatctatgtgtgtagcaggatcacccgggaggagcagggacgcccccttatcaggcttctcttggccgcctgcggcaagatgactgttcctgcggtcctcagtctttcatgactttgtgagagcctctgtacgtcaagccactgtgggtaatggaggctcatatggggtggggctggtgcttgctaggagaggcgtccggagggcctggccgtatgacacacacaggaggaacgaggaggaatcttctaagttacaggctgtgtgtgaatagcaagtacccccttgccttttctaatgcagacttttttaaactgaggtgtcagttctgacaatattatagaacatttaccacgtgggaggcctggggcttcccagctccttttgctcacctggagatagtgccccctttcttcagggtggaagaacacagggttcttccagaacttccccttgaggggacctgtggtaggaaagaaacatgacaataatctctaacttttcagaggctttataatgggagggaaacttagaggcataagcctcactttacgagtgaaaaacaggagacaaagctaaaatttttgcagagtcatgcgagtggttagggacaggcctggatgagaacgtacctgttgtcagctccccacatagccccgcttccccagcgccacgccagcagcaagctgggcgctcacagccggactctggaaagccccaggtcattcctcctaccctgatctgcagggagtgccttcagggaggcccgagcagaccctctagcctccctgtggggtgtgcacattcctggaggtgagggtttaattccagcctagatttggggtgggcatcaccagccaggccccacctgctttactttatctcccttcatctctgatgtctcccacctccatcctgcttggcatccagggtgctgcattcagtgtttgccgtggataggtgtgcatggcatttagctttggaaaaatatatggtggtatttcgttggcatgtttttaattttagcctaaagaccttgatctactcttaaaagtatttgaattaataaatcaaggaagacactgcgggtagtttctagagtgaatgatgaatttgtgaagttactgtgtgaactctgaaattcagtggctgtcaaaagaggtgaatgcttgcgagcaccttgcagacctgcccccgccaccaagctctgtgagtggaagactcaatcagagaaggagtgagaggagggaaaactccaggcacagtgcagtcgctgcctttgttcagcaatgaggaggggaaaagtggccttttgggttggctgtgacctccctgtgtgtatctgcccccctcatgctaggtggcactagagaagtgttggagaatatggagccagtctcctggcttaggatttttgttaaaatacggggctccattcttgatatttcttttctttttaaagagacagggttttggccgggtgcagtggctcacgcctgtaaatcccagcactttgggaggctgaggcaggcggatcacttgagctcaggagtttgagaccagcctggggaacatggtgaaaccccatctctaccaaaaatacaaaaaaaacagccaggggtggtggtgtgcacctgtagtcccagctacttgagaggctgagttgggaggatcagttgagcccgggaggtggaggttgcggtgagccaagatttgtgccactgcattccaacctgggtgacagagtgagaccccatctcaaaataataataataattaaataaacaagaaaactcctgaggtcaagcattcaagaccagcctggccaacatggtgaaacactatctctactaaaaatacaaaaattagccaggcgtggtagcagatgcctgtaatcccagctactcaggaggctgaggcaggagaattgtttgagcccggggtgcagaggttgcagtgagccaagatcgtgccattgcactccagcctgggtgacagagtgagactcagtctccgagggaaaaaaaaaaaaaaagcgtgcttagagcagaggttcatgggattaaatgcaacaatgtaaataaatctcccagaacctgcctggcacgtaggagtggctctagaaatgtgggctgccgctgtggttttttcttcctcctactcacttgccccactccatgaaagagctaaatgagcaacggactcagagctgctttggagaatggagaccttttcaggctgttcctggcccttcttctaatacttggcaccctgtgtgtcttgtatcaaggaaagccagagagagcttttcggaagaaccgactgctgggccctgccacagctcaccctcctgctccctcagcagtgcatgtgccgtcctttgcccctcacagggcccagcaaactggcaggtgcatggggttgcaaacctggtcctgcaggaatgtagaatgggtgtatctcaccccacttcacgtgagagataggccgtgttcctgtgacccttgctcagcaactcgtgtgctttcaaataaggaaaaaagggaatgtgttttcatgcaacgagaaattataccaatcccattgccttggcaattatagtattacaagtgatagcaggcagccagagctgaagacgaggaaaagcaaaaatgataagaaagcctgggggaggctgttcacttcttactctagtacaatcacccaaccccgaggtgcctgcggctgaggctcctgcactggggtttgcagggctggatgtgttagcacctccctgagacgggggtgccttagactactgccgcacggcaactcctcaactcctccagggttttgttgttttgttctggccagagccacgctctggccgtttgttacttacacctttgtagtagcagtgccaactattgtgacgtttagctgagatccagggataattagggtagggattaaggtgtggggcgacttgtttttaattaattataaaagtaatttgagttcgtcatcacaaaatgaaacaatatagaaagcttaaagttaaaggtcttatcccttcttctgccctggtctccctgctcttgggtgaccaggcagcccttgtaaagcatgggtgtgtacactcagaaatgtatccttccttatgcttatgcaagcatgaatgggttttgtttgctaagggtgtcacattcttcgtgtctataacttgcttttttttccccttcaatttgtggacaagtcagtatatcgaagttttacccttttcagggctagtggtagcccctcctgtggacactccaccaattattagccagatcacgattaaccttagagacaagaggactgttagaaagtcctgtatgtggaagccgctgctgctcctctctcaggtgactttttccaagtcctgcacctgttgggagggctcctctggagagcaggagtgtatggacttggccaagcacctaggaagggaaggtaggagtgagatgccaaaccacagggtcagaaggcatctttgcagctaggctccaaactcgtttcccattcaattccagaagttcaagggtagagacaagagtttggaggctcgctctttgaagaaactgaatactacataaaaaagactaaacagatactaatgtttaatcacaaatgaaaaagccccctggtacctctgttacaaaaactccaaataaagtatcagataactggcctaatagtgtattgaggacatatatcacaaatactgttttcccccaaaatacaagactggttcaacatcagagaccctgttacatcagtagaccaaaggaggggaagacatgattatctcatttgatacggaaaacaaattcgatgagttcagtaccattttatgtttaacattctcaataaaatattgatgaagggatatttaatttgatttttaaatcctgtaccaaaaatctacagcaaacattatattcaatggaagatttttttgagacagttttgctcggtcacctaggctgcagtgcagtggcgcgatgtcaggttaccgcaacctccactttccgggttcaagcaattctcctgtctcagcctcctgagtagttgggattacaggcatgcgccaccatgcccggctaattttttgtatttttagtagagatggggtttcaccatgttgaccaggctggtctcgaactcccaacctcaggtgatccgcccaccttggcctcccaaagtgctaggattacagatgtgagccaccacccctagcctagatctagtattataaaatgataatcttcctttctcgttgacttagaaattcagggctatttcagtaactgtggggtaacaaattaccccaaaacttaatagcttaaaacagtaataatcattatctctcacagtttttgtgaaccaagcatttgagagcagctctgccaagcgtttttggcttttgaagcctctcttgaggttgcagtcagatggtggctgtggctgcgaccatctcaaaggcttttcactcacatacctgttgcctggtctgggaagactcaagcagtttggggctgggacagctgcagttctccgtcatctgtttatgtgtacattttccatgtgatctctccaatgtggtgccttctgggttactgcactaagtataggttgactcagggctcccacagcgcttgtcccaaaagagaaccaagtagaagccattttgcctttctgactgccccttggaagtcacacagcatctgccacattccgttggttgaggcaggtgggaaggtcactctaggtacaagagaacatagaccccatgtctcgatagaggagtgttaatatcactttgtaagaaggtcatgtgggatgagatatatattggtgctatctttggaaaatacagtctgctacaagtaaaacccgttcagaattctaattggattttttgaagaaatcttatttttaaatgcatttggattacctaagttaaacttcagaaagaagagaaaagggaacttttaagcttctaagccatagtactaaaagcaaatgatgtctgcgcaaaaacaggtaatagacaaatgaaatagaataatgatctcagagaaagacccatatacatacgggaatttaatatacgataaaggggcaccatgaatcaatgggagaaggatggattgcttaatagataatgttaggagaattgactaattaaaatggagaaacattaactggatctgcacagactatcatacacaatggtagactctagaagggctaaagacctaaatgagaatggtaacaccacaaaattaatacgtctcttatctacaaatctgaaatccagaacactctgaaaattaaatgctttttcttaacccacatggcagcaaaacttgagctgaggtgaagctatttataatcatgtatttatcctgcttaatgtgaatatcctataattcactgcagttttaaaaaactattattataaaaactttcaaacattcagaaaaatttaaaaatagtattagagggccaggcatggtggctcatgcctgtaatccaagcatttggggaggcttaggtgggagtatcacttgaggccaggaattcaagaccaacctggtgaaaaagagcgagaccttgtcttaaaaaaaaaaaaaaaaaaaaaaaaattagctgggcatgattgcatgcacctgtagtctcagctactccagagactgagatgggaggattgcttaagccctggaggtcgaagctgcagtgaactgtgatcacaccactgtactccatcctggttgacagagcaagaccctgtctcaaaaaaatcatgaaccagttaaccctggcctggccagggtctcagtttgcggggggcacaagcagtggagcagctgtgctgctgtggccaatccctttctcccacagcagagtcgggagtggcactctgatccatatctactgctcctttttcacggattgtctacttgattggttttgcctattaaagccaaattcaaatatttgtccaaaaagctacagacccagtgatcctgctatatagcaggacctttggaggaagactaccccaggtgtgtgtgagggcctccgagaccagctgctgcagtggatgagcagggctggggctggccctggggtctagcatctgtgcaacaagctcctcaccacttctgcagccacgcaggtccaccacctctaaggcacaaagtgaaatcgccctgatccatgcttaaaatttggccctggtagccaaggcccgagaacacacttcccttttcacccaacatctattcccttacttgtctgagtctttttttttttctccctcttctgtgaaatgggccagaagttcctcactcagttattttgggagcattaaaaaattcgagggtcccaccccctcctccctctcttcattcagaaaatggatggaatcaagctgatgcccgaagaacaccaaagggacccaagaaagtcagaaaaatggtactttctgctgctctttagccaaaggggtgaacagcgttaattggctcatcgttttaaagatctgagttgttcaaccaaagttaggagataatctttcagtggcactattgccttttcagaaaagaaaaaaaaaaggaaggcaagaagagttgctttgcacatagacatctccagtatgggaacatcatttgtttggcaggggggttattttttcctcttaccctgctgtaaatattcttcactgctctcttatatttcctgtatccaccatctttgcccaggtgtttaactctgttcccttaaatggtttcccctcaggcttagtcttggatctttgtacattctcctggagtgggcttatctgggcttttgtttttttgagacagagtcttgctctattgcccaggctggagtacagtggcgcgatctcggctcactgcaacctccacctcctgggttcaagcaattcttctgccttagcctctcgagtagctggaactacaggtgggtgcccccatgcccagctaatttttgtatttttagtagagatggggttttgccatattgtccaggctggtctcaaactcctgacctcgtgatccacccgcctcggcctcccaaagtgctgggattacaggcgtgagccattgtgcatggcctcatctggactttttaaaactgtttgtaccctaatccatatctccagtccagatcttccccctgggcctcggcccctcacaccagataaaccagctatctccacttacatgtttctcacattcctagaacttggtatgccccaaactgtatcatcatcttcacccctgccccctttctagcagcccattccccttgtagagttcatgtctccacaaaaaccaccatttacccagttgcccaagcgagctgcttgagtatcattaacttctacacccctaaatctctgacttctaagctaataacatgtccaagagagtaaaccctttaaaaatccttttaatccatacactttctgccagagccaggcagaaaatataaggggatgccaaaaaaactcagtaatcaagacaaataattgttcagagtcgggttgaccagatgtcccttctggattctaagtccagcagatggcccattgggcagccagcccactggccccaggagcatagggaccttcatgtttggcagggcagcagggccgcctagcccaggccggcctctccattcacaccaccgatagcctgaatgactgcagtaactccccactgctctgcaagcttttcgactcctcccaatccatttactgcaccatggccaaagtaatatttctgaaatataagccacctctgaactgttcaacagttctgcagtgtttctggaatgatgcacctaaaccctcaatggaccttgcccccgatcctgctttcctctttagcatccacatccacatttttttgcaactctgtcagcattttttaaaaggaaacctatttattgcagtttactctccatacaaaggagtgcttatattacatcataagcatacatcctgatgcattcacaaactaagtacctctgtgtactgacatcctaggaaccctcccccaaccccgcccaccataccccttcccagttgcagctcccatggaggtactgctttcctgacttgtaacagcgtggacttgccttgcctgttttgtatcttaagtagatcggatcagatagtgatcctcgtgcactcatgtgtctgcttccttcattcacatcatgtgtgggagccgcccatcttgttgtgtagggttgtagagttttcgtcaccttgctataatagttttccattatgtgaataaactatgctttatccatttgttctcatactggtgctgcataacaaaatacccccaaactcgatcacctacaacaactatttattatgcccatggactatgtgggtcaggtattgtatttgcatagggcacagcagaagcagctagtctatgatgtctgggacctcagctgaaaactagaaggtcaggcacaggtgtctttttttttttttttcttttgagactgagtcttgctctgtcacgcaggctggagtgcagtggtgcaatcttggctcactgcaacctccgcctcccgggttcaagtgattcttctgcctcagcctccgaagtagctgggattacagccacccaccaccacacctggctaatttttgtatttttagtagagacagggtttcgccatgttggcctggctggtctcgaactcctgacctcaagcgatctgcccaccttggcctcccaattacgggtgtgaaccaccgtacctggccacaggtaccttttgatggctcattccctcacgtgtctggttctccacagagacctcagcaagggccgtcaatccaaatgctgatggtggcctctctatgtggcctgggcttcctcacagcatggtggcaagcttccaagggtgagggtcttgaaataggcagtggctgcatcttttgtgtgacttagccttacaagtcatagcattttggccgtactctgggtcagaacagtcccaggcccacacaggttcaagggcagggaaaacagactccagtgcttgatgaagggtggcaagattctggaagtgcatgtgggacggaaatagtcctggggctgtttggggaaaatacaatctactatacccatgagctgctgataggtgtctacctttctgatccaaccacatcattattcttccagttctttgaaacaataatctccctgtcaccccggggcctttgcacatgatgccccctcgacctgcaactctttccttttcacccctgactcctgcacctagggtaccccttgtctgcctggctagcttttgcttatcttttattttttattatttttgagataaggtctttccagctggagtgcagtggcatgatcatggcttacttcagcctcaacctcctgagctcaatcagtcctcccacttcagcctcccgaatagctgggactacaaagtgcatgccgccacgcccagttaattttttttttttaattatcagatacatggtatgcagtcagattttttgtagaaatgggtttcactgtgttgccctggctggtctcgaacccctggactcaagcagtcctcctgcctcagcctcccaaagtgctgggattacaggtatgagccaccatgcctggcctgcttatcttttagtctcagcctaagctttccttcttaaaagaatgctttcctcacatcactgtcaccccaacccactggccccaaaatggcagtgcaggccccactcctagttacttttgggaccttgccttgtccctgtcgtaatgctgatcacaaggtagtgctctggcttgtttacttgtctggatccctcatcagagtttaagcttcaggaaggagcttaaactgccccttgtactgttcagtgtccagtccagtgcctgacacagagtaacctgcagttaattggagaaagtggattcagccttcagtgtccacccactagagacagtaacgtatgcacaaaattaagcattaacacagtttagaacataggattagctatgttgtagtatacacaaacacatacacacttgtgcaagtgtcaagtgttagagcaggaagcaattttaggtgtagattgtcccattgaacccctccttttgcaagtaagaaatgtaaacagagctgtgacatggctcacccaattggaagcaggtggccctgtgaccagcaatcccaggccctcactgtgagggaggcattacaatgaaggcctccatttgagcccctccagcttcccctctgagatgcagatactgtgttggtgtagtgatgggccccagtgctactgttcatcacactcaaccggttatctagttagtgaaagaaagcatttaaaaaattgaggggccaggcaggtacagtagctcacgcctgtaatcccatactttgggaggccaaggtgggaggaatgcttgagcccaagagttggagaccaacctgggtaacatagtgagaccccatctctctctctctctctctctctctctctctgtctctctgtctctctgtctatatatatgtatatatatatacacacatagatatgtatacgtatctatatacatagatttatatacataaatataaaattgaggcaagattttttttttcacaattgttgattgcttgctagtttttattaatagctgttgtttttcctttctttttagacctccctccagtgcatggtgttgagttaatgctattacatgtttgacacactattgctggtctcactggtcttggccaggctgctgtcttggttttattcattcatacattgatctgttttttaattcctgttgtccattccccaccccgccgtagccaaccatgtcaatatgtttggtgtattggtttaatttttcatttctgtgcatacatgggttttgttaatctaaggttttagttgtgtgcatgtgtttttaacttaggtaaaatggcacaaatggcctggtgctacggattcttttgtttctttttttctctcagcactgtttttggatctgtccgacgtgcacatttaatccattgcttgtggctgctgcatagtattcatcatgtacatgctctgcggggaccttgcccgttcccctggggatcatctgctacccgacatggttctgtggccaacatcctcgtgctgtattctgattgacctgtgtgaggatttcgctaggaaatatacccagaaatagggttgccggatcatagactagggaactttccggttcacttctgaggactcagaaaacatgattatgtcccttttctcttgctattttctcgtaaatgtcaggaaggtaggttgcttaaaataccctaactttcagcctggctctagaatcttgcagtgctaccacccggagagcagagataaagattgggattttattctctgtgggtcagtttgaggtttgcattttttcacttggaatgattgaaactcgtgctgctccttccgcgtgcatgtgtaaaacgagccacagactgctagtctgttctgctctcctgctgtccgtgaccgttgctagacctcctgtatggaggcagtgtggtgccatggaaggaggcgatgcagtagagtcaggccggcataagtggcttctctgcatgtgtgtcagccccatccctaagctggggtcatgccacccggtgaggctccatatgccagcatgtagcacagagcctactgggtgacccttccaacagccccttgagaggagagggcacagtgctgcataagttggtgtctaaagggtgtggagttgtatttaagcctttactatcacattgtgaatatttatgggtggatttatttcgtgtctggaattttcttcaaaataatctggtgcagggagagtgagttgggataaagatcagatgaccatataatttatcattcaatcccaggcaagtttgaaactgaaagagggagctattaattacaccaagacgacacgcttgaactggggttgttgcagcaaaccaagacatggacacctcaggggaaaatcagataggactgaccctgatttgatcattgttgaagctgggtgatgagtacctgggagctcactctattcaatttttttgtttgtctgaaaatttccataataaagttttttttaggcccagtgcagtggctcatgcctataatcccagctctttaggaggcctgggcaggaggatcacttgaagccaggacttggaggccagcctgggcaacataacaaggccctgtctctataaaaagtaataataataaaatattgaataaatgtattaaggaaatgtttgtatcagagtgcagaagcacccaaaagttcgcactgtccaggaaatggctattgagtactttgccaacccctgcctggggtcataagcccaggtcaccatgctgtctgcttttcccccctatctctgggcacttccaggtgggggtgggtgggagggagtaaatggagaggctcctcctactcttcattgttggtgggaggaatgagaacctggaggctgtcctagctgtctgtgacttgatttagcatagggggaaagggctgaccttttttctgccagcagtactgtcaaggcctgcccaggtggcagccgaagtagctcccttcatgcccactgcacaccacagcatggtggcaggggcgcctgcagtctgtgcacatgcacacatgatcgttctctgcaccccttatcggaactgcgggttgggcaggaagcagcatgaccgcagtgggttcctaaccgacattctgtctcacacacgcttcactgtcctacttaaccctcgctgtggtatggcagttactggaaccttgactggtagaaggtagcctctgctgggaatggactcagacagcaggctgactgcccttaatttgttatctctttccggttgtacagctgggcctttttcacacatttccgtgaagtgtgatgttcattcatccaacagatattttcaagagcccatcatatgccaggctctagggctacagcagtaaaataaacagactctgccttcaaggggcttatactgtaagggggccacagacagcaggtgcagcaaaggtggaggaggagggtcacctttctcacatggctgctgagtgctcaggaatcgatgttaggatgctgtcatgtggagatcattggcaaccgtggaaaggatggttttagagattggagcaggttcaagaggaactgggagaggaagtgaagatggccattggagatgcttcattggaactggggcagttgctgcaggtgtaggtgggattgagagagcgttgtgtgaggtagagaatagcttacatatgtggactcaggagagaggaaaaatatgcttaacagaacttgttctgaatggcccttttgtatgccatagcaaatatcaaacaaccctgatcatgagatatagagccctggagggcctgattcagttttcttcttccttcagagtcccatcttctccatactaaaagtaaatcacaaatatttggattgttattgacatatctattatatgttttaatcttctatctataatctttctcttgttatataaatggttctgaacttttgggttctaagcccaaacacttttgacatctaactctatgaatctcccttagaatgtggcatcttatttcaggaggctgatggatccgctgatgtccatccccataggtttcaggtcaagagcctgtgtgtgggacacattcgctagacagccacttcgggatgtgaaagaaatgagagctctgtggcctcctcttttcttctcttccctaatgggtcatcccttcactgaggggagaaattatatttgttttgccattttccttacaacttaataactagaatacatatgaatggatagacagactgactgacttgattgcttatcctatttaagtgtggcacattcagtccatagcacatggcatcctctcttggggcacagttttcaatggtttcccaagagaggatgccatgtgctacggactgaatgtgttttatccccctcctcccccaaaattcatgtgttgaagcctaatccctaatgtgatggtatttgaaggaggacttttgggagataagtgagtttagaagaggtcgtgagtgtggtgcctttatgatggaattattagtgcccccagaagaagaagagacaccagcgctttctctccagcatgtgagacacagcaagatggtggacctttgcaaatcagggagaggccctcaccacacatcagacctggcagcaccttgatcttgggcttctcaacctccagagccatgagagataaatgtttattgtttaagccgtccagtctgcagtattttgttacagcagctcaaactgactaagatatcctgcttcataattttcagcagagccagggaaccccagctactctcctttaagagttgatccaggccgggcatggtggctcgtgcctgtaatctcagcactttgggaggccaaggtgggcggaccacgaggtcaggagatcgagaccgtcctggccaacatggtgaaaccccatctgtactgaaaatacaaaaaattagctggggctgggcgcggtggctcacgcctgtaatcccatcactttgggaggctgaggcaggcggatcacctgaggtcgggagtttgagaccagcctgaccaacatgtacaaaccccgtctctactaaaaatacaaaattagccaggcgtggtggtgtatgcctgtagtcccagctattcgggaggccgaggcaggagaattgctcgaacctgggagacagaggttgcggtgagccaagaccgcaccactgcactccagcctggcgacagagcgagattccgtctcaaaaaaacaaacaaaaaaagagttgattttttagaagaacagccatttctcttagaaggttttacattcatttcctgttgttgctgtagcaaatatccacaaatttgacaacacaaatgtattttcttgcatttttggagatgagaaatctgcattggtctcgctgggctgaaatcaaggtgtctgcagtgctgtgctgcttctggaggctctaggggagaatccatttccttgtctttcccagctcctggaggccacgctttccttggctcatggtcccttcctctaacttcaaagctaatggcaaagcatcttcaaatctctgtctgtctgcttccatagtcatgtcttcttctctgcctctctctttccataataaagatgctgtgattacatcggacccacctgaataaggttctgtattcatcacatctgccaagtgcttttcgccatgtaaggtaaacattcacaggttctggggattcggaggtggacatgtttggggagccattattctgcctaccacacctttatacaactggttgcacacatgttcccatgtaatggctagggtggtaacatgatttctgttttacagttgagaaaatggaagttcacggaggttcaggaaattgcccttggtcacataacttgtgcgtggagaagtcagcacttgaatgctgtagctctgagcccagatctctgtttttccattatatctggctgcttgtttttttaattctcttccatacatttctttctttccttttttttttttttttttttttgacagagtctcgctctgttgcccaggctggagtgcaatggcgcaatctctgcttactgcaacctccgccccccaggttcaagtgattctcctgcctcagcctcccgaatagctgggattacaagcacacatcaccatgcccggctaacttttgtatttttagtagagatggggtttcaccacgttggtcaggctggtctcgaactcccaacctcatgtgatccaccagcctctgcctcccaaagtgctgggattacaggcgtgagccaccacgcctggccacacatttcaataagtggtatttgtcaatatttatgtttctgatgccaatattctgggaagttgaagtgctgacttgagagaatgttacaatcaatgtaaagttagtcttcaaggtgaaaagtcaaaatgaagaaggaattgcccatttatgtggtcctcttctttcataaacatttgtttgtgaggaccaatacagatattgcttcctggcttaacatttctgtccactgacatatacttggttttaatgttatgtcatatcacacatcttttgcttgctagccagatttcttgttatccttaggagatccttaactttcttaaccttggaactgttattatgaatcaagatttacaaggtatgtccatgttcctgctaccatgttggagcctcctccatgccttactcccaaccttctccttctcccattcttatctacccggttcaagtaacctgaaccagaggcaaagaaaagcaatatggtagcatactttacatgccttgagtagaagtcattcactattttagggagcttagaattcatggtccttctcgttcgtgctttctgtctggagagtctctagaaaactgcttttgggggccgggcgcggtggctcatgcctgtaatcccaactctttggtaggctgaggcgggcggatcacaaggtcaaaagatcaagaccatcctggccaacatggtgaaaccccgtctctactaaaaatacaaaaattcgctgggcatggtggcacacgcctatagtcccagctactcgggaggctgaggcaagagaatcacttgaaccagggaagcagaggttgcggggagccgagatcatgtcactgcactccagcctggcaacagagcaagagtccgtctcaaaaacaaaaacaagaaacctccttttgacccatcggtcaggccctcacagctgtctagagtctttgcatgtctttctctgtggtcaccatagccctgggtgagagaaaagcaaggactgaagtatgaaggccttctctcacccttatccttcccttggataggattgatcactgcactgctgtttaccttttggaacaactccattctactcttttggcttcttcctcttagatgccatttcaaaacacagttgtggcctactggactgtgccctctgggttccagcctccatctacctgtgttggaggtgcagctgaacagaggatgccctgatgacagggtaccaggactgggtccaaggcaggaaggtagcctgtagtgtagctgcgtgccaggaccccagcctgagttgatggtgtttttgttttttgttttttgttttttctgttttttgagacggagtctcactctgccgctcaggctggagtgcagtggcgcgagcttggctcgctgcaacctccacctcccgggttcaagcgattctcctgcttcagcctcccaagtagctgggattataggcacccgccaccatgcctggctaatttttgtatacttagtagagatggggtttcactatgttggcaaagctggtctcgaactcctgacctgaggtgatctgcccaccttggcctcccaaagtgctgggattataggcatgagccaccgtgcctggctgagctgatggttttgatgaaatgaatacagcagcacacattctgcatcccaggattatgctgggagccgtggaaggagccttctcacagacctccagtgacagaaaggctgggctgttggcatcaactgatgtaagttatacagtgcaaggcaaatggttttattccatatgagcagtcacttacatgtgagtgtctgttcgctggtgagtcagatgctgtgctgaacatgatctaatagtatgttcaggcattttctttcttgctggcaaaaaattcctatcagccagtagggtggacagtagggtagacagtgcctttaggagcccagaaatcaactattggtcctgtatagattctctgtgaaagtttccttcattgtccttttcccttccctaactgtttttccccttttcccctccaaacacctcccccaaccccacacacactccataaaaaagggaagttagttggaggttggaatttctaattacatcaataaagactccagctgggcatggtggcgcactggcctgtaagtcccagctacttgaggggctgaggtaggaggattgcttgagcctgggaggtggaggttgcaatgagccaagatcccactactgcactccagcctgggcaacagagagagaccctgtctcttaaaaaataaaaatgagggccgggtgcagtggctcacacctgtaatcccagtactttgggaggccaaggtgggcggatcaccaggtcaggagttcgagaccagcctggccaatatggtgaaactcccgtctctattaaaaatacaaaaattagccgggcgtggtggtgcgcgcctgtagttccagctactccggaggctgagacaggagaatggcgtgaacccgggaggcggagcttgcagtgagccgagatcacgccactgcactccagcctgggggacagagcaagactctgtctcaaataaataaataaaaataaggactccaggacttggaaaacagtctatatccagggaagaagctgcaaacaggcagttccaaggccagtcctgtttttctaggaaggtcttctgagggcacctgccaagagcgaagcctgacctgcatggctggtcctacttggacagtgttcctcctgaaggtggaggaagtgacactttcttctgctttatagacagcccacaaatcccttgggagtggtaactgcctgttttacctagagagcagtttttattgttgcctttgtttttgtttcttgagggaaggtggtccttggctccagttgttgctgattttatgaggaacaggcaggggaattcaagccactctaaggagtgttctctggcattgcccaaacgctagaagtccacaccagcagcagcagtgggttttgggtccaagggatgtaggtgtgcagtgtgtcggcggtggaaacagaggtggagcagccatgtatgtgcaaggagagcgtgatgttcagtcgaatgactgggcatttcctggccagacctgtctatcctactgcctagcttgtaggtaatccctagtgtctaagaactagaagaaattcttgggctactgcaccaagagggagaggatctcctttttcaacagatggtccatcctttaaataagacatctccaaaatacaagccaagtgtttccctggagactttacatccacactttctgagtcataattaaatgcccctaaacttacccaagcatggtagccaggtgacaaggagttataaatcaatattcatctttcttagacagtagttggggacttgattcacacttcacactcatgctgatgttttcagctgctgctgcttttttttggtagagatgggggtctcactatgttgcccaggctggcggtcttgaactcctgacttaaagcaatcctcctgcctcagcctcccaaagtgttggaattacaagtgtgagccactgtacctggtcagttttcagcttcttgtatctgctcggactcaggtcattggaccatcatgtcccggtccctgcttccccgtcatttccttcctaagcagccctttgagggcctctctttggaagaaatggtctagagggtcaaagggaagaggaccaatgaatggccatagctcctgttcctggtagatgctttccccattcttcatgtggctggaatactgttgctgaggatccacctggcaggctgcaggctggacttactgtacagcagggtgggtttgatgtcttcacgctcacctccatgcacacagtgtgcagtccttccttttgttcctagctgtagatagatgtcttcacttaggctcttctggtttgcagtaagtagacaggaatatgtttgagacggggtcttgctctgtcacccaggttggagtacaatggcccaatcaaggctgactgctgcctcaacttactgggctccagccatcctcctgcctcagcctcccaagtagctgggaccacaggcatgtgcaaccatgcctggctaatttttatatttttggtagagacagggtttcaccatgttgcccacgctggtcttgaatacctgagatcaagtgatctacctgccttggcctcctaaagtgctgggattagaggcatgagccactgcacccggccaggaataaattgattgggtctattattggaattcagtctgtatgatttttcagatattcatatatgtatttttcatatgttcattgattctaaggcacagacacttcaccatgtaacaactttaaaatcgagatgtgctatataatcacatcttaaaattataaatatctgtggaataccatattgaaaaaaattgttggcagcttttcttccctttcttgaggtttataatgatgcctcttacaattgatggcatcttggagtcacaaaatacattatgtaagttcaactcatttttcactttttttgcctgaagaatttgtgaatttcctcgaatggacagatttaccagcaagcttcagtatatttgggcagtactggatgcagccgataaaatggtttactctgcacagagcagtcacacatccatccttggttggactttaaaacaattctggaataggaagggcactacttgaatattactaagtagctggtacaaggccatctggctagtgattgggaaagcgtgttttcctctgatgcctagtctgattctctttcttccataccagtcagtgtggaattcagaaacctcagagatatgttggagtggaatctaccatgcttagagtagaaaatgaagatcactactaagaggatctttatagttggtaaaaattgagaatcctaatacccaacagaagaaagtggctaggcacagtattattagattatcatatggaatacaaacattgaaaatgacaagtgcctagattgcagttgatacaaggaagcctatatttgtaaagagcagaatataaatatcctaactccttgacttccaatgccaaccatttacctccttgagccaagcatgggggaggcagttgaggcctaggcagagttagaaaggctgcactccagagaaaatgcacagagaagttatggagaaagagataaggacctggaagatagaaccaagagatttgacatacaagcagcaggagtactagaaagagaaagggtagaggaagggtgcctgaggcaggactggccaggactagcttatactgtcataatacacagttccagaagcttgctggctcagctcggcacattgatttcttccccatgctgctgcatacagtgcaggtcaagaggtgggactctgctcaccattgttactcagggacctaagccagcagaggctttgtcgcaacacctgctccctggtcactgcagcagtcaggtagaatggcaggtcatgccctggcccttaaagtccgcttgggtgtgtgcacgttcttccgttcacatttcattggccaaagcaaatcacaaacccacccttaacttcgaagagagcaggcacatgcagtcattatatatggatggaaggaggaaggctagaaatatttggtgaacagcattgatgacttaccaccaggggaagtaatgaaacatatagaagaaaatttctctaaagaaggaagacttgaggctgcatattgaaaggtaaaactgataagagaagacactaagcatgtcctggtaacgtttctgaactcttaggatgaagagaaaaatcttcaagctttcagaagccaaaggaacaaattattaaggaaaagagtcacactggcaccagatttcctatttacaacaccaagaagctagaagatggtggaatttcatctacagaccacggggataaaaggaatgcagctcaagcatcctgtacccaggcaagctatccattcagctgtcagaatgaaagaaaggtatttgagcatatacaaggattgagagtgtgcccccagctgtcacccgctgcccttgtcctcacggtgcctagatgctctgccctcactgttcttctaatacatcaagggctctgctcacctgtcacctcctcagaggctgtccctgaccgctgtatccaaattagcacacccacccactctacttggctttttcttcacaacacagctcactgcttgacactttgttcaatgtttattaaaatttcaaacgtttggaaaagttggaagaagtttaacttatgcatctttgtttctgttcatttcattttaatgcagacatcagtgtacttccttgacacagatcattaactacagttagttaactgcagttccatatttgtttacaggttttttttctggttgaggtaaaatttgcagacaatgaaatctcaaatcttaagtgtatatttggtggattttgacaaacacatacgcgtgtgtaacccaaaccctcctcatgatatagaacatttttgtcatcccagaaggttctctcattaccttctcagtgaatctctgcccccaccctaacccctggagacaaccactgttctgatttcttccacagtagattaattttgccttttctagaatttcatataattagaatcatgtgtgcacttttgtgtccttcacttggcgtgttttaattcatccatgttgttgcatgtatcagtaattcattgctttttatagctgagtagtgtttcattttattccacggatgtaccacagtttctatatccattctgttgaccaacatttgggattgttaccagtttttgcttgttaggaataaagctgtgatgaacattcttgtaaatgactatttgtaggtatatgttgacatttcttttgggtaaatacatagatgagaatttgcttgggtcacaggctaggtgtatgtttgttttataagaaactaccagacctttccccaaagtggctgtgtcattttatattccctcaaacatatgtgagagttccggttgctacacatcttcaccgacattaccaacatctggtgttgctagtcctttaaagtttttgtttggtattttaatagacagatttattggtcagtgttttctagagaaacagatccgacagagtgagagagagagagagagagagagagagagtgagtgtgtgtgtgtgtgtgtgtgtagagatttattataagaaactggcttacatgattatggaagctgagaaatcccatgatctaccatctgcaagctggagacctgggaaaactcgtggagtatgtagttccagttcgagtttgaaggcctgagaaccaggagagcttatggtgtaagtcctagttcaagggcaagagaagaccagtgtcccagctcaagcagttaggcagacagagagtgaaatttctcctctttgccttttgattctattcaggtcctcagtggattggatgaggcctgctcaccttggggagggcggtccgcttcactcagtctatggtttcaaatgctgatctcatctggaaccaccctcacagtcacaccaaaaataatgttgagccaaataatctgggcaccccatggcccagtcaaattgacccatcacaacagatatgttaacacacacacagatacattaaactttgtcagtatggctgtcttctgatgtctgcttatgagaaatttctggggaaacaggtgagcctccaggccccagaacagaactgcagaggttgagtccagaagagaggttttcgaagaggcaaaagccagaattcctgggcctttcccagtcaaggatgttctctaggagagactgactcacacctcagcaactgataaattgtgccaatgttttcacttatttctgtgttgacagagagggagtctgtgtctttgagggtgaagaatgtgatacctacagcttagaaatgtgaaagaaaatcatcagtgttaccccttgatcttttattcataataaatcccatttatgaaaattagtttattcaagtcccattttattgacactaagcaccatgaggatgtgacggaaagattgaggctggaaactaagaactgaatgctaagggcaaagtcaaggggcacgcgctctctgagctcctcagccaagagttaccctcatctacccctctgccccaggacctcccatctgtgtggcgtggctttctttaccctggttgcttcctttgattcttctacctttaggtgatcccagagacaggcagaactggggcagcctttaaaatagcgcatcagcatggggaggggggcagaagggagggctggggagggaaactggagcaacacgccgccagcacatggtcctgtcctgagaaatcaggtcttaaaggaaaaggttgcagcttcggaaaatgagaagtgcattggtctccagagcataaaaactcgagttgatattgcatgataaatgttgtagtggattgggagagttcttgtagcttgaaccagttgcccccatccttcctcggctgctctgtcaaatggtagggcctgggtgaagggatgcccagttaccctggtccaggaacattgatgcacatgaccacatcagcattcctgggatcactgttggttcccctaacagtgggcttaccctgatgttgtgagtgtccctttgacctgacagtaagaggtcacagatggcaagtgcagacttgccttctctcaagagctctgctctctggtacagccaaccaaatggcaaaggatttcccacttaaggcacttgttgaaagacaggaagcagctggactctggctgatccaactctctgctcagctcttctggctgtgtaaacagtgagctgatctgatgacaagagaaagaaaggaaaccaggtctccattagaaggactctcttggcttctcttgattggaagtggagggatcctgtaggcgcatttgcttggcagaacccacccagagcagaattgggtgattaaggacacattccccacaatgctctgtcattcgttccttcctcatctgaacatactggcagaaaaggacaaggaacccggggtacgttccctgcctctgcctctgtctggtgggaggagatgattgcctacggtgaaccagtatcaggcttggccagcaagcccgagcaaactgacatctcccttcactgacagttgcaaactttcggcagacacagcccatgtgcagggagccgctggggcgctggctggctactcccctggcctccagggtgtgccgctcagagcctgctctcagaggcttagggagtgtcctgtagatgtctcctgaagcatctcttacctgctctgagtgctgatgaaggtctccgaggaagtttgacaaaatcatgcaggccgaatgagtttgcagacctttggtttacttttgttttggagggctgattttaatttggtgtgagcttttttccaaaatggaatcaaaatttcctggatgttttaaccttcaggtagttcataaatatcacaggatttatcattctgtagggctgtagtggacgcttatgggaaaagatttgggcaatagactgggagaatccttcttgatcatcggatgacatttcaggaaagaagctggggatattagtcttttctagctgtccgtgttttttctgtccttcttaccttttaccctttattttccatttaaaaggtcatctgcagattcagcatcttacaaccagtgctgtaggcccagtgccaaatggaaagcagaactccagatagttataacagagttcctaggaaaaaaaagtgtccattgtttcaggctacaagttagcccggactatggggcacttaaggagaaattgctgggacagtgtagaaggttcataaatgagtatttggtaatagctggtagtatttctgttctttctgccatgtaactcttctgtgctagtcagtcagtagcacagcacacgagcaagagcgcagacttcctaggtgtcgtgggccagctctgcctctttctggccatgcgaatcttgatcaggttatgtaatcttctgagccttgatgtcctcatctgtcaaatggcgttaatgatagatagtacctacctaccgtatatgagaagacatgtaaagcaccatggctgtccatagtaatgactcaataaatgcaaactattatttattatcatatgcaagagtaggtgctgcagaggttaaagagagactgttggtttccagttggcagtatggaaagtgccagtcgtagtgcacagtgctcgagaggttcaaaggaaacgatgatggcacccggcagagatgggagctgctggccaccccctagtggactctgcatagcccatggccagtgtgcccttgccatggtctcgaggatggaaaagccaggtcatcatgtgatttcccactcacataatagacaccaacttactcatttttgttttttgtttagacagggtctcactctgttggccaggctggagtgtagtggcatgatcatggctcactgcagcctcaacctcctgggctcaagcgatcctcctgcctcaacctcccacgtagctgggactagaggcatgcaccaccatgcccagctaattaaaaaaaaaaagtttttaatagagacggggtctccctgtgttgtccaggctgatctcaaactcctgggctaaagtgatcctcccaccatggcctcccacaatgctggtattacaggtgtgagccaccgtgcccagcccagagctatttcttgagctatgccaaaataaaacagaaacaccagaggtagtagatgctggtgttactaaccctgctttagttaaagtgtaggcctcttcctacaccagtggtgcttcctctccagaggtaatatttcccaacatgcctcgttcttaaaaccctatggccaactctccctaccctgatggaaaggactttagatttgaagcagagaaccctgaggctagtctcagctccacctcctcagttgtgtgacagtgtgctactcagaggccttcaccagggcccattccctcatctggacagtgaggggattgctctaaacttgagtctccgccttttttttctaggacatgaatgtctggtgacattcccttgtagaccttcttgttgggtggcctacttcctagtaccttagctgtaactcaactcccctcctgcactcaaggaatcacgctggaatacaggggagtaaatgatgctattatagggataaccttgaatctgttctgagttatcagaaacataagtacctgcaaggtgtagttttgttcttagtcacaggtcactttaacgctaggcagtgagagtgtcagggcctggaggcagaaggcctgtcctagaccacatccctcctctccttccacagcctcagcctgcaggcaggtgccaagttaaagtgcagttgtcctttagttatttaaagggttgcaaaaccttggtctttggggttgaaaaaaaccccatgtgagtgcagagggacttaggctggatcggaaaagcatcttccatctgtgagacgcaggttcacacctcacctccccatcgagctgtgaccctggatctgcacatttctaaactgagttagaaaataatcagcctggtgtgtttagatccagctgtgcaagaaaactggatggaattcccctcctttctttatagtcttctggggtttgttgttgttgttcttgttgttgtgtcctttttgtggagaacggggtctcactgtgttgcccgggcaggtctcaaactcctgagtccaagtgatcctcccaccgtggcctctcaaaatgctgggattacaggcatgagccaccacaccaggcctggtcttctagctttgttaatgatggatttataaccacccagaggttagaaatacagccctttcccgaagctccaccaaagtccttggattggtagcgtttccaagactttttaagtgacatgctcagatgctaagaatctctgaggaaagaggttggggaaatggcgactgtgccatggagtcaagtgtccactttgtctgtagttagccaggccctgaattttctgcctggtcccatagttcaaagcactgccaatgaagggaaaaaaagaggatttggagaggactttaagcaaagtggttgcgtcagttagcctcctgtctctcagcaccccgggccaccagagtcacggcttttcatgcagagttaggcacccaattaaataaaaatttaattttaatttgtattttttgtagaggcagagtttaactatgttgctcaggctagtcttgaactcctgagctcaagtgatttccccaccttggcctcctaaagtgctgggattacaggcgtgagacaccacacccagccacattcagccttttatctgtttcataagaaatgttgggtgactcatgcctgtaatcccagcactttgggaagctcaggcaggtagatcatctgaggtcaggcatttgagaccagtctagccaatgtggcgaaacctagtctctcctaaaaatacaaaaattagccaggcatggtggcgctcacctgtaatcccagctactcgggaggctgaggtgggagactctcttgaacccgggaggcagaggttgcagtgagcggagatcgtgccactgcactccagcctgggcaacagagtaagactccatctcaaaaaaaaaaaaaagaaaagaaaagaaatattgcagatggttatcactagtatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtggcacaaacatggctcactgcagctttgacctcctgggctcaagccatcctcccacctcagcctctcaagtagctaggactacaggcacacaccaccactcccagctaatttttttttgtaatttttgtagagacaggcttttgccatgttgcctaggctggtctcaaactcctgagctcaagcagtctgccggcttcagcctcccagagtactggaattacaggcatgcacgaccacacccagccctgtggataacttttgactcccccacaacttaactactaatagcctactgttaaccagaagccttaccaataacataaacagtcgattaagatggattttgtatgttataaatgtattatatactgtattacaataaggagagagaaaataaaatgttattaagaaaatgataaggaagtggccaggtgcggtggctcacacctgtaatcctagcactttgggaggctgagggcaggagactgtttgagcccaggggttcaagaccagcctaggcagcatagcaagaccccatctctaatattaagaaaaaaatttttaataacatttaaaaatatgtataaggaagagaaaatatatttagtgttcgttaagtggaagtggatcgtcataaaggtcttcatcgtgttcacattgagtaggctgaagaggaggaggaggaggggttggtcttgctgtcttagggtggcagaggcgatagaaaatccacatgggaagtggagccccaccattcgagcccatgttgtttgagggtcagctgttgttaaatgtgccacattaggaagtccaggctgggcgggcaggaatcacagtcacaaaagggagaaactgtgatgtgcacaatttaatgcagagaaataagatttcagtggcaacagatctttttgatagaatgtatatggaaaagaattgatccatttgaaaatcatttcaatgaaagtagaatggaaaaaattagaaataattcatctgtgttgtatggacaaatggatcaggggattaggtttgcttaacggagttcaactcgaaagattctcaaccaaaattctccagtatgggtacaattctgtatcagttgaaactctggatgtgtaagcagttcacacacatctcaaaggacagtggccttaagccacaaaggaggcagagggggctgtgggtgagggagagagttgctacctggcatgggcggctgaggctgggagctgggtgagggatgagattcctcccagggtgatccaaccaagtggctgaaaggctgtgaggcagaagaatgttaaactgttatgcaaaggctgtttccaggtgccttggtttgatgcctccctaccccattgtccaccagacccatctgagaaagggtctaaagaagataaaactcaagtcaggtatcagtgaccttggttaaaccttaacgaggcacataaggcagggtgagccctagtgaaagctggcagtcagtcaaaggctgcaataaaaggcaaatgccaccgggcgcggtggctcatgcctgtaatctcagaactttgggaggccgaggcgggtgaatcacctgatgtcaggagttcaagactagcctggccaccatagtgaaaccccctctctactaaaaatacaaaaattagccaggcgtcatggcagacacctgtaatcccagctacttggaaggctgaggcaggagaatcgcttgaacccgggatgcagaggttgcagtgaactgagatcgtgccactgcactccagcctgggcgacagagtgagacttcgtctcaaaaaaaaaaaaaaaaaaggcagatgctcaaatgagtccttgaaggaggacaggtccagggtctgttctgatggtcatcctccacattgaccctgagcccacatggctgtcattcgagagtgtccacatgtactgtggatgtactggatctggagaaaacatttcatcccattctcctctctttcaggtttcaagtgccccatttgctccaagtctgtggcttctgacgagatggaaatgcactttataatgtgtttgagcaaacctcgcctctcctacaacggtaagggcttggcctgcctcaccagcctccagagcatccgtcgggggagccggccagtccttgtgggagcctccagtcgagggtggttctgggcagtattttcaccctgccctctggcaggtgtgcctcagtggtggtgaggaagtggactgttctgggagccttgctgctcaggtcagagaggaagaggagtgggacaaggaaggaaggcccaggggtcaggtccgaggtctgggaaggctctcgggctgctcagttaggcccctgcctctctgcaactcagttctgaggactttggctgggagatgcagcctttccttcacccttgactgtggaaggccccaagacagccaggtgtcctccacggcttagcagaggggcccagagcaagcacccgccctccttggggaggtgggggctgtgtgctggtggcatgcatagagtgctgggaagctggtcgtctccttgtcacgttcgaactcggacgaacacctgatttagtcctatgagtccacaccagagagcttgacgggggactatgtgtgacatagagacgctctggggattgaaaatgcggataggacaccttgctgctccaccctggccatgttgcctcctaccttggaggctgcctcagagccgaacagtgaataccgcagagggtaggaccctgagggcaggggatttcaaaacacccaagctaacctaacaggacgcctctgggaaacaaaatgactgtcaacatctgcctagcatgctgtgcataaggctttggagtccaggtgatgggagttcaaatctccctctaccactctgtgtctacaatcttatacaagttgctcagcttagcggagcctcagttttctgctctgtaaaatgtggatagcaatacttggttcataggattgtcagaactgggtaagagatggcacataaaggcctttggtacagagcctggcacatggtcagtgcttgggaagttacagctgccatgaaagatgtgagaccttcataggtttctttttgcagttttccagagcccacagacttctcctcagtgctgctcagcccacgccactgctgaccctcgattttccatgcttagtgtttagtctggtctccaaaccatgttcatcagaaaacggcatcttccactagaccaggcagtggatctgagtgcactccaaccctggtactggcccaccttcccagattcaagtcatagtagtggttggaaaaagagttctgggatttctgagagcatctgaggactggatcacgcaaccagcccagcgagaatgtttcctagggagactcttctctgccctgcagcctcctcactcccagagggctctttcccctacaaagcatgagcctaggagggatcatggtctcagagcatttcctgggaagtaactgactaatggcgtccactcaggtctcctgaaaacttctctcttaattacttgttcagccaaaagactctggatgcaggtgggcatattacccacgtggctcagctccatgcatttgttaggccatgctcaggtgggaggacccgcacggccctcccctgggcatcatagctgtggtctgggaagcccctttcctccccaggggacagcgcctcctttctcctgggctgactgctgccagttctctaagtctgttgtcacatgtgctgcaggcttcgcgtcagtcctgtcgcatgcatgctgtcaggacgctcaggctcagctttgtcccctgttcgccgtctccgcttgggaccagggagggagaggagccttccctgcgtctcacagccctccctagccatggcctcaaaaaccctattcacttctttcccacatgtgtggagacctcatgaagtcctccgtttgtcctgtgggttgctagggcgttctctgtagacactgcgtttgttgtaggaagaatacaaagaagcctcagaggggctcagcctgagaaaacctggctctcaggaagaactttgcaagagcagccgtggaggacagagtgctcttgggcccccatggcccaaatgcagagttacccccactgccctgtggagaaccgggaaggtgaggctgtccagctcctctgccagagaactgcctgggacgccaccatgtgtccccctgtccccctctgtatcagcacttgagtgcctggcgctgttggtttacccccctacaccccaccaccggcagcctcacccaagactacagaaaccacaccgggagccgggccccccttagaggaaggggagattggccagccagcctgaggcatgaccactgctcctctggttctggttctagtttttcccttgtcatggaattgaggggcaggccacctcctcaagggtgcatgtgtttctgtatgtgtgcgtgtgtgtgtgtgtgtgtgtgtgtgtgtgtgtgtgtgtgtgtaaactagaggctttacacctaaggctctcttttgcaaaagccagtcctttaccactggaggcaaagagaggccagttgtctccagtccttccagtggactttgtctcaacgtggtgaagtgctttgttcagaaacaatggtccggccctctgtggaccctgttcatgtggtatggactcctcatgttcagtctttgtcttttctgaagaccctaaaccttccaggtaagaggagagcatttgcttccgggggtgtatgtggagtgggcatccccaggcacgcccagggcctgctccagctcagagagagcacagaccgtgggccaaagctcaggagctccaatgtattccccatgatttgtcatcatcccaacctcacctgctgcatgttaccttttctaatttaaaaaaagacttaagagtcagaggtgtgagttcttggaatctttctggaaagggggcgaggcggggctttcttagtgaagagttttcttatgaagattcactagaactcctggtcactcccctgaagacttcccatttacacacacactttctgtggttgttggcaccaattgcggaaatttttagaaaatttatgatggttatataagatgaaatttagttaaccactaaaggaaaaaagtagaaacctcctaaatgaggcagatagaaagtagtatttttcttattatgagggttggcctgagtggtgggttggaaggcctccagtagctgcctgctagcttagaaaaaacacaacttaggaaaggcgagactagtttaactggttcagctagtgcctggtgctccgaggacaggcacctggctggggaagtttgggaatgtgctgagcccctgctggaggggcagggaagggcggttgactccagagcaccgaatgttaaaccccctgtcctcctaagcgccttcctggaaggtgaggatactgtataagagggagggggttcgttggtttgtttttgtgggtaagatggatcaacccgaatgggccttttaatttctctccctttctaacatctctgtttgtgactctgagactgagggaccttgccctaaagaatacgcattcaaattttgaccctcgagtctctgggctagcagaacaagcgtggaggtgggggtctgattggtgatgctctgaacggaagagcattgtaatcctgtggagtcgtggagatgacccgcttttgactggaagcttaggggtcctcagcccagggagaatctggggggcggcaggttcatttgccagcagcaccaaggagagctcccctcagctgtgttctgggggagcagaagcccatgctcagcttcttatgtcatgatgccctcttcctcccctctgccaaaggccattgcccccatctttaaggctcttgagatgctaaatgtcacacaagctgtcttttaaaggcaagggaggccggatgcagtggctcacgtctgtaatcccaacactttggggaaccgagattgcttgagctcaggaatttgaaaccagcctgggcaacatagtgagaccccatttactaaaaacaaaaaatttgtctgacatggtggcaagcgcctgtagttccaacttctcaggaggctgaggtgagaggatcacttgagcccaggagattgaggcagcagtgagcttgatcacgccactgcactccagcctaggcaacagagcttgaccctgtctcaaaaaataaaatataaaataaaaatgtgagaggacctggcttcctggaaaagcagaaatggctcctgctatagcctgccctgtgcctgcaggcaattctttgtcccatgtctcctcctctcagagaccctgtggtcagaatgaaagcaccctaccctttccctgcctggggaaaccgggtgctggccgaggagtttgcccagccttgcttggggcattgcccagagccattgttagatgctggatgggctggagtcaggctggacaggctggagtcagactgcggaggtgtctgtcctgttactcctcctacaggagggcgaggaggggcaggtgactgctcacccagggtgtccagctgttgctgaccggctgcactgactgccagactggccgctgctgggtgtatgaggagcgaaagcgactaggggaggcctgcaaggccctaacacaagtggggaaaccaggaacaggtggctacaggaaagaggactgtgggagggagctgtagtggcctcagtaggaaagtatgaagcgctccaggcctgagctttagttggctgcccccactatcctcattgcgggtggcccagctcaccaaaacaattgcattgcacttcaaagggctgggcagttggatgggccgctgctggtaggctacactctctgctcaaggtcaccctgttgcctgaagagcacagccccccagatttcccaaaaggggagctgacaaggcctggcatgggtggcactgccctgtcctgtccctggcagactgggccagcagctctgcatgctgaataggcagcaggaccaggcactccaccgcacctaggctggaaatgaggtcagggggtggaacctgagcctgtgcgtcatttgctaggggtttcccctctgactcccaccttccttctctctgggcccttcatggccaccaggcacaagtggagatggagaggcatgttcctgtgctcagctgctgcctcggagctgcacgggctttccctcccagccaggtgcagatctgtgtctgcagctgtgtgagcctccccacccctccatacttctagcagttccagggtctcttgaggatgtgttgccagaactctgcagaatactcgagcctggcatggtggagggcaggtgtgtgtctctcctgtctggtctgttcactcagtgaccaggttcctccatccaccttgggtcctctgcacacacttcacagaaagggggagatgcaaagtgcctgtgagacgggtggtgttttccagccccaagggaagacacccttatggcctggtcttttaaggaaaaggggccaggtcgctgggtggcagaaacttgggcttgggagtcatcaccacttagcagctgcatgagcttatccgaagatccccacaggggctttaggagtcatggtgtgtgtgtctgaggagttacctgcatatagctggcttagagaattaaggctcttttgctcctcctcccagatatctttgctttgacaaatagcagctgtcagaagcaccgtgcctggatcccagggagggagcagaagatgccaccgcctcccacccccagcccatcacaggcatcatccctccctcctgtttcagctccagggccgtgctcgccattctggtttggttccctggtctggttagagggacaggcactgacaccatccccagccaggccaaacacacttccaagctctcccttgggcagtgacattggctggctttgtacagtggcgtcaggaaacttgggaggtgcttcagaggtagtaagaaaagggcagaacccagatggcagaaagtttggctttgttcttatccggcagcatttgttgaacctcttctctaggggcctggagataccaggggacatttgactccatctgcagcagagtctcagtttgtgtgggccaggcgcctgggttttgtgctgcgaggcccccgccatggcttttctctgacggcaggcagcaggttcgtgtcagatgcttctggaagtcttgtaggaaccagttgataggcaagcatcagcttcagccatttccacttccctgctaggctctcagggacatccggaggccactaactcccacagccccaggggtggggacaggaagttgtactcagcccactgcaacctcttgctgggtttgtgtgcctcctgcctcctgctgtggaagaatgctgctccctgggcactgggctctgtgtgggcactgctggcttccccatgctgtctgagtcaaagaccctgactccttcctattgccgggaacctccaggtggccttttgcagccagtggctcttggtcccagtgaaatgtgctccctgccgtgtgccagcctggttggggtgcctgcacattttagttcttcccaccagtgcagcagactcaggccagctggtaaaggcacaacactgcactgtgcataaaaccgccttgtggagtggtgaggaaaggctgcctctaaccttcctctgctcaagtctgagtcctttagtgcacaggccttccgccccaggacaagaagaatcgccctcgcgcccccttccccttccccttccctttcccctagtgaggttcggtgcaaaaagagagtcaagtccagtcttgtcataaagcgcctaagccttatcctcatacctgcctctcccttccctgaatccatcacctcctggggggcgatgagggagaccacatgtgccctcctggagctgacacagatggggagagaacacacctggtgtgggaagctgtatgggacccagagaattctaactagtcccttgggctcacagttgagttaccaatcagtaggagaaaatgcaaagataaactacttaggaatcagtaattgccatgttcccaggaaatcctccttaagtatggaggggaaggaatgctttagaggaaactaagggctatagcccatacgctcatgtcatagatgaggtgtccaagacaaagagagtggggaatacaggtccaagaatgtctgcatgacgactctgccctcactaagctatgctgtttttcctcccatctctgttgaggtttttccctctgttttattatgaaaaatgtcaaacacacagcaaagtttttatgtttttttgagacagagtctcgttctgtcacccaggctggagtacagtggcacaatcttggctcactgtaatctctgcctcccgggttcaaatgattctcctgcctcagcctcccaagtagctgggactacaggtgcatgccaccatgccaggctaacttttggttttttaatagagacagactttcaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctgcctcagcctcccagtaatgctggaattacaggcatgagccactgcacccagtgtacggcaaagctgaaagcattgtatagagaacacccttattgctgggcgcggtggctcacgcctgtaatctcagcactttgggaggccgaggtaggtggatcacgaggtcaagagatcaagaccatcctggctaacatgatgagaccccgtctctactaaaaacacaaaaattagccgggtgtggtggcatgcacctgtagtcccagctacttagtaggctgaggcaggagaaactcttgaggcggaggttgcagtgagctgagatcatgccactgcactccatcctggcgatagagcgagactccatgtcaaaaaaaaaagagagagaacgcccctattacatagcacatgcaccacctggagtctgcagtgtactagacccgtttatccatccaccaacccatcttatccttctgatgcatttcatagtaaaatgcaaacaccagtatgcttccttatcagggtttttaactaaagtagtgcacattcgaacgctacagaaatacataaaaggatttttctccaagtcctcctttcctctaccactgtgaaagtgtgtgcatccttccagactttgatctgtgcctacacatgcatttgaatatgtatggtagctagtgctttcaagcagggggatcacacccatgtgttcatccactacttgccatgtttggagtctgaggggacagacacttcagcagcagactgtgccatctcccttctcagtttgtgtcaccctttcaggtgggtcctcgggctagccagatgttctagacagaaaatgaccacaagttgtcctggtggccaggaagctgacagtgacttctctcgcaactcatgtgcctggggacttaaggatcgaatcggttccattttatgctttttccttggggttcctggtggggggctttgaggagcggaagccatagccttctgggccctgaagaatcttcattttatgggccccaggtgtttgcctttccaccaaaataataagagaacacaaagaaacagcaatgggaaggcctcttaagcagagggtcccagtcccagccccacaacccacaagcccactcatgaggtgtgtgacttccttgggcttccggatcctcattcgcaaaatgagaataacactgggtgccctgcccagcttggaagatggtgatgctcaaaggaagacacgcacatgtgtttgtcattggcagtgttcgggacagttaagttcctttagtgacggagaagggatcctgccacaagctctgccttcttcacagctgagacactgctctcctgatatttctcctgtggcttggaggacttctgggtcgccttttgttcacgtcgcctcttttcacctgcccttcaaatattcatgtcggcctgggtttgtcttctgccttctttggattttggtctgaactttctccctggactgcctctttatcccacatccatgcctggcacccatgtctctgttccaaacctcagctctaggcttcagcagcctcctggaggtctccatcagctggccgggcctcctcccacccaactcagaatccgtcccttccttctcatgctttcctcctgggcaccctcccttagtgcaggcacctgctgtgtgtcccgctgccctcatccgcacacgcagggctgctgcgcactccttgttgtcggccccagacaccacagcagaacacaaggctgttccctgtgcccagaatctcccgtccccaccccagcttcatccatcctcaaccttctccagaaccttcccagatcagcccccatcctgatgaggtctctttccccataccctcagccctgggcctgcgcgtgagaagatgtcctggaagtcctcatgctgtgccttttgatttccttgttcggcatccctgctagtctgtgagctgcttgaatcccgagatcatggctattcactgtcgccggcacgcagaatgccataggacttaataaaaaccagtgggttcccatgggtgcaagtagcttccttccattccttctttttgggatggtgagcggggtcacttttgtttctttctttttaaacattgagatgaaactcaccataaaattaaccatttttatatgtgcaatttaatagcatttaagacattcacaacccccatctttatctggttctaaacacttcatcgccccaaaagaaaacctctggtgtgattccacttacatgaggtagctaaaatactcaaactcatagaagcagagagtagactagtggtggccaggggctgggcggggggaaggggagtggtggattaatgggtataacattttagttatgcacgatgagtaagttctagacatctgccatacaacatagtgcctacagttgacaatactatattgtacacttgaagatttgttaagaggatagagcatatgttagtcttaccacaataaaataaagtttttaaaaggggaaaaaacgggtcaggcgtggtggctcacacctgtaatcccagcactttgggaggccaaggtgggtggatcacgaggtcaggagttcgagaccagcccggccaacatggtgaaaccccgtctctactaaaaatacaaaaactagccaggcgtggtggtgggcgcctgtaatcctagctactcgggaggctgagacaggaaaatcacttgaacccaggaggcgggggttgcagtgagccgagatagtgccactgcactccagtctgggtgacagagtgagactccatctcaaataaaagcggggtggtggggggggagaaaaccccctacccattaagcagtcattccccatatccctctgtccccaatactgatctcctttccctctctatggatgtatctattctggacatttcatataaatgggttcatacaataggtggtttcttttactttgtgtagtatttttgacgtttatccatgttttagcatgtggtggttcttccttttcttggcttagtaatattccattgtgtggatacatcatcttttgtttatccgttgcgcagtttgtagacactgggttgtttccacctttgggctgttgtgaacaatgctgctgtgaacctccgtgcacaaggattttcttggggacctgtttcttcctctcattcttgcctcctaccactctacccattaccatatttttccaaaccagacatcagcacactggctacgtgtgtgtttaggaaagcatctgtggagggaaacagcttgcctcatgctgcccctgcttcctgtctacccttctccaagcctttttcgtccgctgtcacctaggcttttggttaatcacatgttgagattaatcccattttgtctttgggtaattaacatgtgatgtccacgcattatctccacggtgaaagtcttaaggtcaacgtccctcttggggttctgtgtcccctgcagagccgggcacagcttggggcagctaagcagtcccctagttcctaggcccttgcttgccccatgccacctgtccactggtgactaaccctcctgcactctcccctgtcccccttgcagatgatgtgctgactaaagacgcgggtgagtgtgtgatctgcctggaggagctgctgcagggggacacgatagccaggctgccctgcctgtgcatctatcacaaaaggtaggaggggttggcaaggtagcttagtgcaccccacctcccagaggggcggacccccatctccagccattctgtctcctttggttatgggatgacctctcccccgacctctggctccgagcgggtaagggcagaggccgtcagacaggtgtccactgtgccggcgggaaggtgcgagcatcccaagtgcagagcagagtggagttgccagaggtgtgctctggtttgagggctcaggtggtgggagctgatggggagacccgtagagcctcacaggttggaggagcttcggatcccactgggaaggttggttctccgtctgtctccctgcctcttcttcctctacgggtccctctgctccacaggggtagaacatcaatctgtgcgaggaaggccaggcggagggtgtacccactgccttgcactggccttctccctagagggccgggaggcaggaagagccatttcctgtggggccacagcactgggcacagttaaaagtagcagggcccagatatgccttgggactccagtgtgagcctcgtccttgtttccagctggaaggaaggcaccctcttgcccaagacaggacactgtgctgcctggggccagcacctgctgaatcctcgagcccagagcttcttcctgacactcaggcctttcaaagcctgactctcagggccactgctgcacagggtgacaaccgggcatggcacgcagtgtggctggtgcagaggaggcttaaggctggcctgggagagattcttggtctagctcccagcacggagccttgcttgtgtcccagggcggcactaaccagaaccagaaaaggaaatctttggccctcggggagaattatgccaattatctgtctggttcctgtctttgaaaatgcccagatgttggtttacaaatcaggaagctgtcttggggcaatctctgttccctctttgatgcagagagcctttctctgtaaacactggagagcagggcttcactgtctggctcccctcccgcctcttgcaggaaggactagatgctgctgatcagctgatcatggctgagccgggtagagcttggggctctcctaagaggtcacccactgggagggagcttcacagctgttcttttgacccaggaaggagctctttcaggactgtggcacccagagccgtggccctcctgccatgccattgttcccacttccctgcccttgggagtcttggagacagctgactagctgccctgaggggtccaccgctctcaccttctcactggtggctgctgccattctcctgggctctgcacagaaagctttggtccttctgaaagccactctgccccttcctgcagcaccagatccccctgagccggtactgctgcctccacctgggccaagactagtcttggtgttcacccttcttcgtgcttcagaaagtagggatatctggggacatgactgtgtttccctggggtcctttcagaagagacttaggaagctcctgctcaggaatctggccctctgaaagagccccttcaaagcagcctgggcagcaggtaacgtggtttcccttgcggccccctcctcccagctgcatagactcgtggtttgaagtgaacagatcttgtccggaacaccctgcggactgacctgcgggcttgcttgctgactcctctcaaaggtgagcccgcgtttgggggtgctccgggctcaaggcttggggtcaggtcactttgggggcctgcagtttagggagccgggctgcccttatgccactgagaagaaagcaggagcagagggaaggagcacctcatcagtgagcagttagtcatccggaaatgattttccctgggaaggacaagagatacaaaccaacatggacagttatgaagaacaggctcagaagagttaggatcagttggggaagagaccagtacaatctacattcctaaagaaagttcaggaatatcccctgggaatgtgcacgggcaggaaaaggagcctgagcggtgggtttgtgcctggcttggcctcatcctcgctcacctctgagtctccgcctcttctatggtaacggggataatctcactccctgttgccataaggacattgcacttactaaacagccatgggcagtgcattgttccctgcaaagtgctggtcagcgatcatttgaccactgcttcttcccatgccgcttccagatgaatctgaggcctccaggccagactcgatccctctatcccacagcactgggtgctgactccacacatccccctggcttaccgctgggtctggcctccccatttctcccccaggggtaccccacttgctgccaaccatccacccctgacccccatctcacctgtcccctccaagttctgggctggcattttcctttttctggcaaacaagtagacaaaacccccataaaaaccaaaagcccaactccatctcacagccaaaggttttgggacctttttcttcccccctccctttctctctctcttgctttcgttttcttttgttaggtttattttatttattccaagtaaactcccagaacagctgatgatgtcagacaaatcagggacatttgctctttttacctccacctcaaaaactgatgacaaggggagaagaaagagccaggggggagagtgaggcaggggagtagaacctgcccaggcacatggctgcaaattccccgtgtgctgtttggcttctggggtcctgtgtagacgccccagccccgcctgccctcttgggatgcagctgccctgggatgagcagacagccctcggcccgatggagcacgacttatttattacggtccacacagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgccggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcgaggcagggcccagccctgaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagcaggttctaccctctctgctaagggcctagcacgctttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctccaggctcaggttggtgtaactgctgtcggctggagcccagtattagcacggaggaggggttccaagaactgaagttggactggggcgtctcagcgcagctgcctctgcctaaggcctagcagcctgcctgagcactgacagctgatgggaggaggagaggggcggaggccagggagggcgtggggtgtgacatgcctctttccaaaagggaccgaaggctagaggggcaaggaagatgagacagcactgcaggttcctgggacctgcaggggatggaggactagcttggcttccaggctgccaggacttacctgaccctaggaggaggtttgcccagggctgagtgccgcaggccctgggcagaggagtcgtgagctgcagatgccgcgtggtatctgagcttcatgatttcgggcgccctcctgtgggcttaggggggaacaactgccaaggtctcaagacgggctccggcccaagacaggggcaggccctcgggtggacagaccttgagggcaaaacagctggtggtacgatacatcaccccatgaagaggtgggtgcaaaaatagtctcatctctgtttctagagacgtggcagctgctgaggaacacattcagtgtgttcagaggcccggttcaggcccagctggggagcccatcctgagtgacatgtgccgtgggcaggtcctcagctctgaggcggagtagctgggacagggacctgggttcctttccgaaccctgagcaccaacctcctccccaggctataagaagtcagaggacagccccaaaacaaaggggtcactgaccaaaggacagagaccctggagggggaggggaggaagtgctgcctgctgacttccaggtagctgtaggtgggtttcaggtttattacagatttattgggggaggccccaaggagaagacctatcatcatgtcacgggagctcacgttccataccaggaaaggagtgttcctgtcaccaggtgaagggggaagggtcctgggaccccggcagtgggaggcctcggggaggggtgtcatcagagtcttgaatggacccagacgctctcttcccgccaggacaggatgcgtaggagcagagaggaagcagctttgctgggaaccaccctgggtcgtttactgaaccaaaggctcctggggccagccagagggccagggaggtaacacggtgctcaggcttctctctgggccctctggccttgggcccagatacagtgggctcgctggcaggaagactgcctcagcatctatttccttgcaggggccgtggcatgaagaaaagttccagaaccggctccgtagtcagggaacttgtgggctaagtgctcagacccccttcacagcactttgcctggattcatgaggccttgggggtctagcacggccttgagctgccgcatggtctccacgcccacggcgcccacctcctcctgcagcagctgccgcttgcccattccgatgccatgctcccccgtgcacgttccgtggagagccagtgcccgcctgggggcaggaaggagacatcctcagggggctccctttcctctgccctcagctcttcccctccctggctttgctcctacctgcccagctgttctgcaaaagccttgaccctgcccagttcctcggcgtcatcagggttgaccagcaggatgcagtggaagttgccgtcacccacatgcccgacaatgcttcctgggggcccagaggacagaactattctccagcccagtcctcctcttgcctcctgctgccccaggctctgatcagccctgacacctccccacctctccccagcagcagggtgggcagaacctgtgagtcctgaggcattcagatcctccttggtctgcaccacgatctccggcagccgggagatgggcacacacacatccgtggagtagccctggtcagagggaagcctatgagttacccctgcctgattgggtgtacggggtcaccgtggtcaaggctgaggatgggtcggagggcactgggcttcagctcttggcctcacacaaggaaataatcctgctcttctctaggcctcagccctcacctccccccgacacaacacaggagaccaatggcccaggtgtgcttgccacacctcccctgtggctcccacccccaagccccaggctgctgagcctttgcatagctgcctggagcccagacttcccttccccaggttaggctaacatccccctctctatcatctcttcctccaggaagccttccttccatgtacagctcccaagagcaccgcaccgttcccatgacctggctcacaggaagggcttttgagggcttagcagacaactgtgctttccctgtagacggtatctgaacagctgggtggggcggtctgcagcccttgtttctagcgcctgctcagccaggcccagccccgttgttgaggctcagcctgctgctctgtgcagtagagtggtgggttgaggaaagggtttgtgggccgagctgtgggccccatctgtaccccagccccagctcaccttgcagcctggccgcgtggccagggctgcgtaccaggcattgtgccgtgctgtccaaagccggctgcgctcctcggcctccttggcccaggagaagtcagaggctccgttctgctggactatctcctctgcagttggggaaggggggctgacaccgggccgccactgaggcagcccaccctgctgccccactccaccccagcatacctgtgcgctgcagctgctcctccagtgcctgctgggagccatggaactccaggaagagtgtgggcgccactaagcaattcagcttgctgtacctgttgcaggcatccatcatgacttcatccaggaactctggatccagggagatggcaggccaggtgaggcctggccttcccagggggcctcttccagggagcccaccctgactgcccccatcctcagctcaccaatgcgggctacgggcactgcagcctggaggatgtgtacagtgctgtccacagcagcctggacactggggaacgcacacgtggcggccactgtggcctcaggggcagggtgcaggcgcagggtggtggctgtgatgaggcccagcgtcccctcggagcccacgaagagccccgtgaggttgtagccggctgcactcttcctacgtcccagggacacacaaggtgagtaccaggctgtgtgatgagggatttctggccagaagccgaagctggaacccaagacaccgaccccaggcactgaggtctgggctggcctccctcgggcccagtttccctggcccagtgctttctgctccacaaagccagtcggcctcaggcagggagagcaaaccctggtcccatccactttggcccagctgacagggcttcagagcctgaggaagcctagcctgccaaaccagggggccgccaggaggtgcttttcacagcccggtctctgcagggcagcccgccagcagtgcccagggccagagcccgggccccccgcagagggcgctcaccggaaatgccggcctcggcccgccgtgtgcagcagccgcccgtcgggcagcaccacctccaggttgagcacgttgtcccgcatggtgccgtagcggaccgcgttggtccccgacgccccggtggccgccatgccacagagagaggcgtccgcgcctgggtctggagggcggcgtacagaaggcagcctcagggaccggaggtcctttccctcgggctgggggaggaaggtcccctgaaccccagacacagccctgctcccacggtgccctcagggtcccaggaaaggttcgcgagtcctacccacgggaaaccagaggccgctgtcccgcaggtgggcgttgagggctttgcgggtgacacctggctccaccaccacagagaagtcctcctggttcagctccaggattcggtccatatgcgtcaggttaacgcagacgccgccctggttggggcaggtgctaagaccactgcagacctgggtctctgacctggccacgtccccggaccacaccccgcgggtgtccccccagcagccagaccagacccccagaggcaggcagcccacgggcgggagcagacccaaggtgccgtgtgtggcgggggaggcagccacaggtgtgccaaggtgtgctgggaccatcctcgggccgggcgagggagccccactgtacctgcacagcacagacgccaccctcaagcccggtgccggtgccgaatgggatgatgggcacaccttggcgatagcacagggctgccagccggctgacctgctccacgttctggggccacaccacagcatcaggaggttcgcacctagaaccagaccctcagcgatttagcggggcgtgacaccctctggtcccgaggtgttgcagggcctgaggctacagcaagcgaggggcagagaacatgccagagcaccccaaaacagatgagtgaggaggaaggcaacccagcaccctctctctcagctggggttgaatccagaagacaggggaggggcccgcgaaccctcccatacctgtgcaccgactcatcgcgcccgtgctgctctcggaccaccgcggcagtggacacgtgggagccgcccaccacggccttcagagcctctacgaagtccctgcagagctctccctgcagggaagaaacacactgccagggtcccccgaaagacacatggggccacagccctgccccagtgtcggggggagggctgggggctggaggctggagtgagcctcccctgcgcccgccccgctgacaacatccttgccaggtgggcccactttaaacaaacccactatccagaaatgcctcttttccaaacagagccattgggggtcaaagtttcccctcagaaaaaaacgccaccagaatttttttaatgttttcttttttaataaaaacagggtcttaactatgttgcccaggatggtttcaaactcctgggctcaagcgatccacctgcctcggcctcccaaagtgctggggttacaggcgtgagccacagcgcccagccatccaaataaaaaaccagaattcactctccaaaaaggctatcagcagggttccttcaatagccagcccagcctgagcaaccgaaaagatccctcacttcctcctttctccagggccaaccaagcaccaccccagccacagggaactcagagcttgataagggaattagggggaggaaaagcttccactgccccctccccactctacgttgcctggggcttctgggcccttcgtggggggcggggcgcggcggggcgggggatgtgtttcttcccattttacagatgagaaatggaggccaagttaaggacagagcctggcctggaacccaggccctttccttcagggccttcttccacaggtgtgttttattccaggggcatccatttgactcccccagccccactcatggtagcagtggggactcagctgatctcactctacacccacccacagttgccacagggtaagcccagtgcccttttgcccaaggtcaggtcacttggtgctggggcgtcacagagcccaggaaacttgggatcagaaccccctgctccccgctccccacctcatccctccagaggacttctcttctctcccggtacctttgccttctgggagcagtagcccctccaggggaacagctcccaggttgcagacctgagcagtcgggccatagccaggcactggccagagggtgtgagcactgggtggcagggtgaccagtcagctactgtggcagcagctactgctgctgtcagcccattggctaggccaggggtggggcctgcttaaggtggcacgggctttaaggtggcccttgcagatcttgcagacattttcgtgggctccagggacgacacttctaaaggagaggcgaggttcactggacgttttgggaaactgtaaggcaaaaataaaattctaagcctcccaaccgactgaatggacctccctctcagcccagggcattccaaaataaacctgaaaaattaattcaggctgtgatgggaagaggtttaggacaagcctcattatccccctccttcctttagaattcagacacaactgaccagcattaacattaaaacagagaccttaaggcattctgatcttaagacacaaaacagactctttgtagcaataagataccaaattccaacctgactctagcatcacctgacagatagcaggccctgaaagaaatcaatgtattttacccccaaaatatattcctctgatttttttttttaaatagctccaaaaagctgtcttttgtggggaaaatctagaatctgtagagaatcccctcccctttccaggttttttgttttgttttgttttgttttgagacagagtcactctgtggcccaggctggagtgcagtagcgtgctgcaacctccacccactgggttcaagcgattctcctgcctcagcctcccaagtagctgggattacaggtgcctgccactgtgcccagataatttttctatttttagtagagacagggtttcaccatcttggccaggctggtcttgaactcctgacctcgtgatccacctgccttggcctcccaaagtgctgggattacaggcatgagccaccgcgtccagcctctttccaggttttatcctgatctaagggagatttaactaagagtctggcaccttttaacgccttagacatttaccatctatgttacataataagaaccttgggccgggtgcagcggctcacatctgtaatgccagcactttgggaggccaaagtgggaggatcacgaggtcaagagatagagaccctcttggccaacatggtgaaaccccgtttctactaaaaatacaaaaattagctgggcatggtggtacacgcctgtagtctcagctacttgggaggctgaggcaggagaatcgcttgaacccaggaggtggaggttgcagtgagctgagatcgcaccacggcactccagcctggcgacagagcgagactctgtctcaaaaaaaaagaaccttggtctccacaactccttatcttaacccagatgcttatttctattgattccaggttgtcttttttaaaattttttatttaaaaaaaattttgttgttgtataccaagattccaagtctttggataataacttctttcaaccaattgaaaatcagaaatttttttttttttttgagatggagtctcactctgttgctcaggcagtggcgtgatctcagctcactacaacctccatctcctgggttcaagctgttctcatgcctcagcctcccaagtagctgggattacaggagtgccaccatgcccagctaatttttgtatttttaatagagacagggtttcaccatgttggtccaggctggtctcgaactcctgacctcaagtgatccacccgccttggctccccaaaatgctgggattacaagtgtgagccaccgtgcccagcgccaatcagaaaagtctttgaattcacctatgacctgtaagctcctccctcaatcagaaggaaccaatgcataccctgcttatattgattactgtctgatgcctccctaaactgtataaaaccagttgtaactcaactgccttgggtacatgttctcaggacctccagggaatgtgtcacaggtcatggtcttcatgtgagtggtgggaaatccatacaggtctacataaaactcaatgcttgcctcatcagaagaaagaattctactgaagaggtctgaaagggaaatatcttgagcccccaaaattactaagctaaagggaaaagtcaagctgggaactgcttaaggcaaacctgcctcccattctttcaaagtcacccctctgatcactgagctaaatgcatatctgactgcctccttttgagaggataattagaaactcaaaagaatgcaaacatttgtctcttatctacctatgaccgggaagccccctccctgtctttccagacccaaacaatgttcatcttacgtatgttgagtgacgtctcaagtctccccaaaatgtataaaactaaattgtgctctgaccaccttggggacatgtcattgggatctcctgaggctgtgtcacaccatcatcattggcaaaataaactttctaaattaactgagacctttctcagatttggggggttcatattttggtaaccacagaagaattctgactggaggcgcccctgacctttgacaaagctatcagtgcttggtaccagcttgagctatctttatggctcaaaccaataggacaatttgctgaggcccggaagcacaccctccagagaataccttatctttcaaaatctggtcaagatctaaagttcattttgttgtacaactcctcttttttttttggagttttacttgcttctaacacaaggaaggcaaatttttcctgcttccatgttgatggaaggcaggtaactcctttatggtgtttgagctcgcaaccaacagggaagatgagggtttttccctgcttctaggatggtagagagcagtcttcagcctgaaacccatccctaggtaagtaactgaattggggtttgttttggctaaagttaagattacaaccagctggtcttaatttctccttaccactagaaagcttagtaatcatataaattgtgtgatcatttgttttgcttaactgttttgttgttgttcatttctctttttgttgttctttcagtctttttcccattgggtttgatcaactctatctgacttgatcaaatacaaaggaagtcccaaattatggggaacaaggcctctgaagtggctaaattcacacacacacacatacacaaaggatgatgtgatagggggtgaaaaacagccagcaaaaggaaaaaaaaaaggaaagattttttattttgactact

SEQ ID NO: 1373 - DNA, 1112 bp, Homo sapiens
  misc_feature (1)...(1112): n = A,T,C or G
nccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcgaggcagggcc

SEQ ID NO: 1374 - protein, 240 aa, Homo sapiens
RPTGARASMGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGPPDVLDHPPAATAPGSAVTLHQMLPEAPTLCKGIHNRPVGKREPGPAEKH

SEQ ID NO: 1375 - DNA, 34389 bp, Mus musculus
  misc_feature (1)...(34389): n = A,T,C or G
tccaaagcctgccaggatacatgggaagaccccgcccccaccctagataaataaaggcaagaaggcaatcctgctgtcatcagcatgcttgaaagagatgcttgtggggaaccttaccattcagagtggacttttctcacagagggccagagttcagttcccagatagccctaagagatagctccttcattctttaagttatattggcctacattttataccagtgccttgtttaaggggaaaaaagagagactggctatggttggctttggtcggtcttgcttcatttcttgggtctaggtctcagcttcctaaacaggtcaggactctgttggcagggaaggaagggaggcacagttaatgggggttaatgggtgatcagtagtgtgtgccacagatggtaaatacacagcgggggtgtgggtgaggatggggtagagtgggaatgaatttgtgtggaggccagaggagagcctcacggaatgttcttcgggaaacatcttctgtgtttttgagacaaggtctcttatacgctaagaggctctggatctgtcttccccagcactgggatttcaagtgtttgctactgcgccagggttttttaatatgtggtttcaggaactcaagctcagggccttatcctttttgggaaagaactaactgattgagctgtcttccttttttttttttttaagatttatttatttatatgtaagtacactgtagctatcctcagataccccagaagagggcatcagatttcgttacggatggttgtgaaccaccatgtggttgctgggatttgaactcgggaccttcggaagagcagttggcactcttaatcactgagccatctcaccagcccttgagctgcctttcctattcaaattaaatttataattccaaagagacagagacagagagagagcgccagaattgttaagtacatcaaccagagagatgaggagtgaaaaaagacagggaatttaattattaagttataccaggcttctgtcattttcaaacccaggtttcaataggaaaatgcaggtatgctaacaatttaagatacttattataagaagaggaatttaatcttcaaaccagaaaggaaaaaggggataaaggtagaggataatatggcagtttactgaaaaccgagaaaagaagaaaagaaaaaaacaaaactaaaaacagagaaaacgcaaagtaagataataacttatgaacaaatacatgcgggcaaaaccctcacacagacgaaataaacagaacaggtacagtgagatgggtcagcaggtacaagtgtttactgccaaatctggatgacctacttggatttcatcttcaggacccacatagtgaaagaagaaatcaaactctttgtaagttctctgatctttacagctgtgcgctgcagcacacagatacttaagtaaatgtaagttacaacaaaatgtggaccagcaagatggctcagtgggttaaagcacttgcccttaatcctaaggacctgagttcgatccctaggacccacatcttctaaaagaatgggtgcctaaaaaagttgtccttgtttcctgtgtgtgtttgcctgcatgtgtgtctgtgtgagccacatgtgaattgtgctgcagggagaccagaagaggacttcaaattgtctggaactggagttatagacggttgtaagccactatgtagatgctgggaatagaacctaggtcctttggaagagaagccaatgcttttaatggctgagctatctctctagctccaagaaaacaaaaacaaaaaaactttttaagggcctcttaagtagaagccagaggacaactttgtggagttgattcttcctactttttcatgggttatagtgataatttttaccatcaaacactgagctgtcttcggaggactctgggtctcttactcaagataatgacagagtccctaggctatctttggtccaatttttggctgttgcctcacccggaaggcaggagttggcccctaacagtgtgttggcaggcatcgacagaaaagagagcttttggtgggataccccagttggtagaaaaagcctgtttgaaaggtttataaaagaaacagtggtgtggttttttttgtttgtttgttttttgttttttttatttttacagacagggtttctcctgggttccctagctgtacctggaactcactctgtagaccaggctgnnnnnnnnnnnnnnnnnnnncgtgcgccactcttttttttgttgtcaattagcatattttcttcatttacatttcaaatgctatcaggaaggtctcctatacccgcccctcccgctccgcgcccccccacctcccctccccacagaagcagtggtcttaaagtattcacgtttgtctggctgacctgatcagttagtcctgggattcttgatcagggatattaaataagaagcctgagatgtgcctggggttcataaggcttcctgacggttcagccatagcctgtgattggctgtcttcgggaggacgctttaggatacacagtcttaggcagtgcgggaatggacggagggagagagctctgctccccctccccgatccttcacgccttcctttgactttcctttgcctgccaagaaggttgcaggttgtgttcagctgtgccgatctgaggctctaccggcccacgtttcattagggttatttccgtgcctggtctcctgggatctggccgagatgggctctgaagacactacactgtagcctacggtacattccccttcccagcatcctttgctgcgtttaccactgtgctgctgcgagcctcccctgggcgttcatttttaatttgttccgtgggagcttcctctagccgtgggtttcctggctataaaaagctgggggaagagaggaagcaagtccatccaactctggaggcctgacctccagccgcagcctcctgggtgctactttccctgagattggttaggtcgcatggaaatggttattatcccatggtgccccctccactccaatctcgaacctcttataaagacatagtgaaacagtttggcacagaggtgcatgcgtacaatcccagcgtttgaggtgctgaagcaagaggattgctacaagtttcaggctagccagagctgcagagtgagacgctgtctctggttgggaggttgggtacccctccccacccccaaatgtaattcacccatttgaagtatacagttaaaacttccccctcccttgtttatttgtatgtgggatagggtgcacacacactggtggaggtctgagaacaacttgtgggaagttggttcttaaagtctgccgtgtggtctggtccctcaactccaatggccaggcttggtacgagcatctttacctgttcagccattttctggcccagtgtgcttaatgtcttgtagccctgtctggccttgaactctttcactgttgggggtcacaggtatgaaccaccaccctacctccaaaggaatttctaaaacccggaaagctgtctaaaataaaagactcacctcaccgtatcagttattaccgttgagtgggaaagaagaagactgcatctaagtcccctcgattctccctgcacctccggagcgcctattctgaggaagcaggatgtcccagacagcccgttttgtgcccagcaacaatgacagtcatttgtgaaacacttagctaagccacctgtgaagaggtgcagctgggtcggtactcacggttcagcaagcatcatgggtagagcattctcctggatcttggacggtcgattgaagcccatggcgtagactccttggagaagctgtggtttcctagggggaagggtagacacagagtgggtttttagagattacgtttttttagacaggatctagcagtggcctcaaactcagagagatcctgcctcctatgtgctgggataaaaagtgtgtgccatcacacctggcttctttgtttttagtctttctctgtctctgtctctgtctgtctgtctgtccgtctgtctctacctctctctctgtctctctctctctctctgtctgtctctgtctctgtctctctctcggtttgttgagacagggtttctctgtatagctttggcaatgtcctggaactcactctgtagacaaacctggcttcacagtcagagatccacctgcctctgcctcccgagtgctgggattaaaggcatgcgccaccactgcccatcgaggccctatctctttatggagtccaggctaaatgtatattgtccaaggagtccatggtggccttgaactcatgattctcctctctttgcttttcaagttctgggactataggcatgagccaccacacctcaaacccccatttcttacattttatatgaggatattcgtggacgttttgtgggtgactgggtagctgtgaagtagaggggcctcatttagaatacccaggagatagcatgagacattcgcaactggaaatgagaccagttggggccagcactggatgacctcggggtgagagttcgtgtctggaggcttctggttccttccaatgctccctttgctcagtctgtttactatcccagcttaagttcccaggatcggggcggacactggggttctacagcaggaccttatgcccgtatccactctgctcttccctagacacattgctgaactggggctttttttttttttaaattcaattctgtccctatcaaggcagtccaatgatatcaggtgacctggcactgatttgagtccctaggaggcagtgacatctctaccagcctccgcccagcacccgctttcatggtcacacaggagttcctgcaaccctcatttcttcagcggaagctcctcattccttcagccaccagcctacagagtcagtgccccgccagggctacctgccccatgaatggctctgttcagatcacagaggctagtgtgaagagacacaatgaccacggcaactcatataaaggaacatttgattgggcctctcttagagcttcagaggtttagtccactatcaacatggtgggaagcatggtagcatgcaggcagacttggtgctggagaagccgagagtactacatcttgatctgaaggcagccaggactacttctacactgggaagagattgagattttacacacacacacacacacacacacacacacacacacacacacacacctcgaagtctacctccacagtggcacacttcttctaacaagaccctatctactccaacaaatccacacctcctaataatgccactccctgagccaagcattcgaacacatgagtctatgaaggccatacctatttaagccaccacagctgggaacaggactctgcaggcttaagttatttccttacacgttaggcgtagagaggggaaaagggagacctggaagatacagtgggttggcttcccgttttcagccttgttcagccagagtctttaatgtgtaatctgcataaggatcccgggggagcatttgaagaagctcattgaagccagtgttactggggtctccttggagtccgttccagggccttggatgaggcatgtgagagaggcattgggtttgttgttgttgttgttgaggttgtctcatgtatcccaggctgccatccatcttactgtctagttgagaatgaccatgaagttctttttttttttttttaagatttattttattaatatatgtaagtacactgtagctgtcttcagacactccagaagagggagtcagatcttgttgcggatggttgtgagccaccatgtggttgctgggatttgaactctggaccttcggaagagcagtcgggtgctcttacccactgagccatctcaccagcccgaccatgaagttctaatcctgactcttaagtgttgggactataacataaaagtatttcttgggtgcggggggttcttacaccccttttgctcccagataactgcagggcatttctatgtccgctctagctcatcttagctcctgaataaagacacagagacctggtatttttattagcaagctgcaagcactaatagctgggcaggttctgatctattctaacctgactaggctgcgactactcagacaaatgccccattacttgccattcggtctttccctggttcactctggtccgtgtatgtcctcgtggctgctctctcatcatgcaacatggtggtggtgtttccagtttcaggggtttagtcagttatcatcatggtggggagtatagctgggagcatagcagtatgcatagcaccggggtagtaactgagagttctgtcatgacccacaggccaagagagagaccctgagcatggcatggacttttgaaacctcaaagtccatctccagtgacacatgtctccaccaaggcaactcctaatccttctgtgatggtttgtagatgctcggccgagggaatggcattttagaaggtgtggccttgttggagtaggtgtgtcactgtggatgtgggctttaagacccacatcctagttgcctggaagccagtactctgctagcagccttcagatgaagatgtagaactctcagctctgcctgcatcatgtctacctagatgctgctgtgctcccacctggatgataatggactgaatctctgaacctgtaagccagccccaattaaatgttgtcctttataagacttgccttggtcatggtgtctgttcacagcagtaaaaccctaactaagacaccttctaatcctttcaaattgtgctactccctggtgactaagcattcatctctatgatgtgttggccattcttactcaagctactgcaatggctttaaactcaaatgattcacttgcctttatgttccgagtgctaggattataggcatgtacctgcctggcttgaagcttcaaaaaaatggtacttatttaattatttgtgtatgtatattttggacatcagagaaaaacttaagggagccagtttttgttttgttttgttttgttttgttttgtgaggcaaggtttctctttgtaacagagccctgactctcctggaacttgctttgtagaccaggctggcctccgactcataaagatctaccttcctctgcctcctgagtgctgggattaaaggtctaagccaacacaccaggcaagggggtcggttcttttcttctcctatgtgggtcccagggattgaatttgggtcagtaggtgtggcaggaagaacgtgttccttctgagctatctcagcacctctgccgttctttcacttcctccctgagccttgtgcagctgcagtgactcacaggtttcttctagcactccgtctcgtctcaggcattgagcgagatcaggtctcaaagctcactgccactcataaggtcatggccttaagcaggtgctttcacatctataagcatcattttcctgatctagaataatgtcttccctattatatcgtgctaatactggtccctgatggctctggggtttcgcttcactgaagaaatttgagccatcacaaactgaggggacagggggcttgttctttcctgttctctcttaaaagacgtatttattttcattttatgcatatgaatgttttgtctgcgtgtatatctgtatatcgtgtgcatgccaggtgccccaggaggccagacgccggtaaagaattctctagaaatggagttacagatgacagtgactgctgccctgtgactgctgggaactggacctgggtttcctagaaaagcatccagtaccattcaccactgagccgtttctctagttgctcctcccccctttcattattgtttgtgtctgggtgatgggttggggtcacaggtggactcacgattctctcttttaagtgtgttctggggaatgaacgaaggctgttcaacttgtacaagtggtttgcccactgaatcatcttgctggctttttgttttgttttgttttgttttgtttttgtttctactttgaggcaaagactcggatttcttgtagccttagctgacctcggattcactactgaacagcccccacccagctcctcatggcccttctgtttcctcctggggctgcaggcttctgtcctgactgccccaagactgtctgccactgtcacggcagagaatcctagaatgtctggctggagccttcaacaagggagcgagggtttagggctgccagacctggggggtcacatcggagctttaaagcgatttaaagctggctggatttaaagcgatggtttggagatgccctgagcgtggattcaaactcctttccctcaggccagtgtgggctcttctcccctctgtgtgctagggacagcttggagcctcaggctgctgggactcccgggatgggactctaggggttcattttgtccttaatacacagatgaaggcaactgcccagagggctggttggtggttgttccgagaccagatacctcttctcctgacatcttttccctctatatgagcaggaaggattgttcatggttcactgaaccaatctgtgcagtccacacttgagagaccagggacaaacttctgccagctttccgtgggcactacaagttccctgagagcattatgtggggggaaaccattattctcagaccttgcaatcctccctaggctaatttcccctcagttttgtccgaaagtaactaactacacatagctggacaaggcttcctaaatggagtgtgttagcccttgccatcggacccaggggaaattaacttattccttgtttattctcaggctaattaatgaaggtgcagtcctctgaggctgggagttaggcaaaatgatgctatccatggactgtttgaggagagagccttttcttttgtctacgcttttgttgatgggcatctcttttactgctggctctgtcctcagaccatgggtgggggctgtgtgtgtgtgtgtgtgtgtgtgtgtgtgtgagagagagagagagagagagagagagagagagagagagagagagagagagaatgcatgtgtacatatgttatgttcaggttctattgtctaacagcatattctttctcctctctgaatttcagggtcaggctgtggccgcccggtgcctgacaggtgaggaagagcctgccaggggatcactgccaacaggagccaagggcagaacagcctcaccctagaagcaggggtgggcagggcagttgccctgccaaggccaacagtcccaggaaggagtctggagtcccaatgaggaccacgtaagctctcctgatccacatggcttagagtctggcaccttgctgagcagcagctgttcccagctccagacgaccccacagcacagagtaggggaccagcccctctgatgggaggcagcaggccagacgctccgcagaaggtcttgggtttttgtagccctgacgcccatgaagatcactggttttctttctggccttgagtcaggctcttttcccctggctaaggagttggaccaggacggcctgcaagtgcgaagaggactcgtgcatggaatgcaggccccctgaagcccgtgcaccctctgctgtaatcagggttccagggattccccactgcaggggagcaggggctgccttagcgtctgctcatgagccacaaggacccagactgctccagactggaccttttcaagccaccaaagaggggggaccccggagctggcagccagcactcacaagggactagagggctgagatggactgacctctgccttgacggggtggcagaagacgcagaatctttgtggcccagctagtgactgagagagacccgaggaagttctgagcgagaggctctggtggctcagggacggtgggaggggggggctattcctgctttccccttttgttgagggaaggtgtggcaagagtcccctgtcacgcttcgtgcccctatgccctttctacgtgctgccaaaacaagcaggctgcgccgtggctggccccgcagcgggccgggaaaggattggccacggtgacagccaccccgtggccagcacgatgaagtgctctcttcgggtgtggttcctctctatggcattcctgctggtgttcattatgtccctgctcttcacctactcgcaccacagcatggctaccttgccctacctggactcgggggctctgggcggcacacaccgggtgaagctggtaccaggctattcaggactacagcgcctcggcaaggaggggcttttggggagaaattgtgcctgcagtcgctgcatgggtgacgccagcacctctgaatggtttgacagccactttgacggcaacatctcacccgtctggaccagagataacatgaacctccccccggatgtccagcggtggtggatggtaaggactgtgccccacccccaccccctgctgatttccttttactgcctgcttttcagaattggtcctctttatttttggagccgctgtgatcagtccccttttggacttaggctgtccgtcttatgactcccagcaccctgacaaagcaggaagcccacctgagctgagccatatccctggatcacagaccgctgccaggcaggatgagctttgacctgggaggagagagaactactatttgtggggcttgtaggagtcctgtgtagacaccccgcccccaaaatgctctgggctcagggaggcagcacaaatggtcagagtggtcagagtggggacctggaggccatgccatatagatagaggcctgccgagtaagtggcaagaagccattccacagctgcagcaaaggctgcccagctggcaagtgacttatacttctctcccagcagcatcttatttttccaaaattcttttttttttaatgatgttaaagatttgcttatttattttatgtataggagtacactgtagctgtacagatggttgtgagccttcatgtggttgttgggaattgaatttaggacctctactggctccattcaaccccactcgctccggtccaaagatttatttattattataaataagtacactgtagctgtcttcagcagatgcaccagaagagggcgtcgggtctcattacaggtggttgtgagccaccatgtggtttcagagatttgcactcaggaccttcggaagagcagtcagtgctcttacttgctgagccatcttgccagccccaaaatttttattattatttggtgtgtgtgtgtgtgtgtgtgtgtacatgtatgatgtagcaggggctgtgcggatgccacagcgcacatgtggagattataagacaactttgtggagttggtagtttcttcctttacctgggatccagggactgaacttaggttgccaggcttgtgtagcgaggaccatttctccccaacctcctggcctgccatcctccagcctcttaccagactccgggagcctggatctgtgaaggtagtattttcgtttttattttagtatgtgaacggatattctttgttgcatgtatttctgtgccctcagaggacagagaaggactttggatcccctggaactggagttacagacaattatgagccaccatatgggtgttgggaatgaaacccggcatctctggagagcagccagtgctcttactggctgaaccatctctctccagctcctgtttatgctatgcaagtcttgtgtgtgtgcagaattgtgtttgtggaagccggatgttgtgaactatcgacttaatcactgtccaccttattttgttgttgttgtgggttttgtttgtttgtttgttttgttctgtttttaggagacacagtctcactgtgcagctctgactgtcctggaattcactctgtagaccaggctagtcttgaactcacagagatccacctgcctctgccttctgagagctgggattaaaggcgtgcaccaccacaccggccattccgtcttaatttctaagatagggtctcgagactctggagcttggtgatttggcgatttggctaagctggccggcctgtgagattctgcataccactggcaccaggttacagaaatgttcccaccccccaatctggcttttatataggtgctggggatctgtaactcaggccctcactgcatgtatgatagctacttattgctgggctatcccagaaataatagattttaagactgaacatcctaattggtaaacgttggctcagagtaattatgaacacttcaagagtccttcttggctcttcacagttgctgggaaagattgctctggcttgggagagtaatgtaagcctcagccgctatgggaggtggggcacaggagcctcagagggccccataacaggtccacctctggtctccgatgtcccaagcaagacctttctgcttttcatgtcctccaccctgcccccatcattgctggagcatcacttcccaggttctacaaggccatctggtcgcctcctgggccaagaatagagcccgtaggatgcctgctctccctggcacggagaggcaattcctggtccttgttcctcctgccagtataggagcaagatgcctcgcctctcattcttcatggatgtgaggatgtccacatttatcaagacagctgtccagaacctatgtcttggcccagactgttagagtcctccaagaccagtgtctgtggaacacgggtccagaggagcccacaggaccttctagcagagtcttgcctgccgtcactttcggctacaactttgttttatggagaaagtcaaggttcagaaagtgcccagtgtctgcctggtgttataggctcagcagtggccttattcctcagggataagacaggcctctggtcacaggaatggaactcagagcctgtttgggtaccatgttccttagtccacacatcttcctgtgccccacagccaacccctttgtctcagggttgagaattcttgtctcagaggcagacttctgctccagaaaggtgtcgggttccctgagcagctcctacttgtccacagacccagggggctgtgcctccatctgcagcaatgctgttattgctgagtgtcaagggcaggccttggggtatataggcaagtgctccatcccagagtgacttctctctgcttgttggtccacagcgttgcttttcttgcttttgttttttgcttgcttgtttttaaatatttatttatctattttatatatatgatgagtacactgtcactctcttcagacacaccagagagggcatcggatctcattacagatgggttgtgagccaccatgtggttgctgggaattgaactcaggacctctggaagagcaataagtgcccttaaccgctgagccatctctccagcccccaaataaataaatctaaaaaaattaataaataaaaaattaaaaaaaggttaaaaagaaaagaaaagctggatttccaagggtcccaagtggctaactgggcctaagttcagaagggaacctggtagccattggatgcctgctaggtcgtgcctcagttctctcacgctcttcctggaataaccacaagatgaactcttgtagccatcgcctgggcatgttcctgtgtcagctgccaagataaacaggctctggaaagttctattttgccaccaggacctgacctgctctgacctgcagtcagccaatcaggaccgagtatttgctattccttgacacctctcattacagagctgacctggtgggatccagaggccaggactttataggaaatagcccctctttggtcctgtagatcatgattttctttgggactctgctctccctccctccttccttttgcttgtctggtgtgtgtgtgtccatatgtttatgtgtgtcagtacacatagtacttacaaccatccaggactccaagtccagtgggtctgtccgcttctggtctctgagggcaccaaacactcatgtatgagtacactgtagctgtacggatggttgtgagccttcatgtggttgttgggaattgaatttaggacctctgctcactccagcccaaagatttatttattattataaataagtagactgtagctgtcttcagatgcaccagaagagggcaccatgtggttgctgggatttgaactcaggacctttggaagaactcttacccactgagccatctcgccagccccttacacttcattccggtgttgcacttttgacctttttgttaattgagatgatatcatgtaatatgaaactgatcagatcatattctatcactcattagatttaatgtacgattttccggctccacttgtctctcccatagggtcagagagagagtgggcaaaggcccttgccttgaagnnnnnnnnnnnnnnnnnnnncctgccgtcactttcggctacaactttgttttatggagaaagtcaaggttcagaaagtgcccagtgtctgcctggtgttataggctcagcagtggccttattcctcagggataagacaggcctctggtcacaggaatggaactcagagcctgtttgggtaccatgttccttagtccacacatcttcctgtgccccacagccaacccctttgtctcagggttgagaattcttgtctcagaggcagacttctgctccagaaaggtgtcgggttccctgagcagctcctacttgtccacagacccagggggctgtgcctccatctgcagcaatgctgttattgctgagtgtcaagggcaggccttggggtatataggcaagtgctccatcccagagtgacttctctctgcttgttggtccacagcgttgcttttcttgcttttgttttttgcttgcttgtttttaaatatttatttatctattttatatatatgatgagtacactgtcactctcttcagacacaccagagagggcatcggatctcattacagatggttgtgagccaccatgtggttgctgggaattgaactcaggacctctggaagagcaatcagtgctcttaaccgctgagccatctctccagcctctgcttatttgtttttgagacagggttgctctgtgtatccnnnnnnnnnnnnnnnnnnnntgtttttgagacagggttgctctgtgtatccctgactgtcctggtactcactctagcccttgaactcagagattgcctgcctctgtctcccaagcacagagatcactgcccagtttttttttttttttttttttatttttgagacatccataatttggcctgactctcctccgaatcttgagtgttgagattataggtatataccattgcatttggcttgtttttgttcttgttttgagacagggtcctatctaaccctgactgacctggaacacactatgtagaccagactagctttgaactcacagggatctgccgtctctgcctcttcagtgcggaggcgtgtgccaccatacctgacactgctctgttcctttgcgacagggtttcattctgtcttccccgtggcctcaaacttaggatcctctggcctcagcctcctgagagctctcagtggttttttttttttattttattttattccattttgtttttctgtgtcgtcctggctgtcctagagctcgctctggagagcaggcaggcttgcttctttttgcttatggcatttcaaagtcttagtttcaaagtatttcaaagtgttagttgatggccctatatcatgaaacaagtctagcccagtgtctttaaaaatatttatactaccaatatttaacattcagaggatttcatgtgaaatctatatttttagtttctcctggacattttcctgcacttctcagaggttcagagtgcctatagacaagtcccgcaggtggactcctggaaaccgttggaaagactcctgaagtgcatttctctgctttatggcccaggaccataaacccctccagaatgcctctaatagcactcggacaccccacccccacccccaccccaagcctctttggagcattggagaggcagcttctgtctggcagggtactgggtactggtctcaatagtgagactgactgagagtcaagacttgctactgtgaagcgagaagttgtttctcagtgctcggggaagggcttcccagacagccctgcgcgaggaggtccgtatggctctgattggaggggagccttgaaggggtgagggtttccccacgctcacagccatctccctcccctgcccagatgctacaaccccaattcaagtcacacaacaccaacgaagtgctggaaaaactgttccagatcgtgcctggcgagaacccctaccgcttccgggacccccaacagtgccggcgctgtgctgtggtcgggaactcaggcaaccttcggggctctggctatggacaagaagtggacagccacaactttatcatgaggtgagctctcacggaacaggcagggggacagggaaatcgatgcgtgaagcgtccttgtgtctttgggttttgtttgtttgtttttaaacattatttagttttcaggatagccgaggacggcgtgtaggagttcctccaccacgtgggtcctatgaactaaactcagattttcaggtttggtggcaagctcttttacccactgaaccatcttgccagtcttctctgatcttttctgctagggtacaagtactaattgcccagtgtgctaagggacgccagcatccagaggcttcagttaatagtcctggtctctcttcccaggtttttcaggttgggtgtggagtaagtgttcacaatacacattgtgggagctggagcggtgtctcagtggctaagagcgcttgctacctttgcagaggattggagcctggttcccagcacccacatggaagctaaaagtcacctgactctgcttccagggatccaacactttcttctgacataggtgttacaaatacatataaaaggcaaaacagttatacatacaaaatacactttttccccctctgtgtagtcttggctgttctgaaactctgaagattagagtggcttcaaactcagagatttgcctgcctctgcctcccaaaaggtgtgtgccaccactgcccaacaaaaaaataaatctttttttaaaagttgcctggcatgcacgaaactctggggtcaatcctgaacagtgcacacaccagggtcagtggcatactcctgcctgtgtgtttggtgttagaagaaccttaatacatacagtcagtcactggggctggagagttgactcagtggataagaatataagctgctctcccagaggactcaagttcattgcctgtcacatgactcacaactgccagtaactccagcaccaggagatctgactactctggcttccctgggtatccatactcacatgcgcatacctacacccatatatgtgtgtgtatatgtgtatgtttgtatatatacacatatataacatgtaatacatgtatacatgtaatattatatatacatagtgtattaatatgtatacataatttaaaatacatataatttaaaataataataaatatttaaagaaaaactttactagcagaaagtattcctttgtttgtttgtttgtgtgtgtgtttgttttctcaaggcagggtttctctttgcacccctggctatcctagaacttaaccagtctggccttgaactcctggtggcaggaggtgttcttattattgtccattctactgcccttgaggtacactaaatcactaaatcaactcatcttcttttcaaaagggtaaggtaggtgtggtagcacacattcatgaatcttagctcctgcaaggtgagactgaaatatcccaagtccaaggccagcctgaggtgccatagaaagcttctggtttaaaaaaaaaccaatctcaaagcaagtcatggtggcgcacgcctttaattccagcacttgggggtgggggggcagaggcaggcagatctctcaagttcaaggccagcctgatctacaaagccagttcaagacacccagggctctgttacccagagaaactttaccttgaaaaacaaaacaaaacaaaacaaaacaataatctcaaagctaggcacagtagcccacaccttaaatcctaatacttggaatgtagaaatcggcgaatctcttagtttgaaaccaaccatggctacatagtgataccctgtctcaaaaaacaaaaaacaacaccccccccccaaagctcctgtaccccggtgctggtggtatggagattggtacatcctggaagcttgctggtcatcaagtttagccaaaattgtaagccttggttcagaaagaaaatctgtcttaaataatgaggtgggggttagggaagtggcccaagagataaatgcacttgttgagcaaccctgacaacctgagtttggaatctcagagcctgtataaaagccagatgctgtagcacaggcttctttgattccagtgttgccctatagggagctgagacgccgagacagggcattctccagaagtttgagcgcccattaccctagccaacacagtggtaaggagaccctgcctcaggtagagaggtgaggactgaccccagactctgtcttctgatctccacacatgtccccgtggcaaaaacaagcacacacagaaataaaggagaatcaaaagaagctgatttccattgtcaacacatgcaaacacaaatatacacatacacaaatgaatgaatgaatgaatgaatgaatgagtaaataaaatactgaaaatgccaggtttttgctaaacatcacctaggatgggcattgtagaaagaccagatttcccgggaggcagaaggcctttgtcgtagaaacctttgctgtctccatagcaacaccaacatagcaatttatctcttgaggctttccgtatttttttttcctttgcaagatcttcctcgagatgaggaacggtgacagatgtagaaatagaatgctgagttccccccagaactccagagccacctggattatcctcattttccagttcctggggttttaaagggaaggaagccgaaagctggtgcaagaactctgtctactgagagaaggtggccaagattagggggtcgaggctcccattgcttcccttcagctctggggccctttgaaaacccaaggaaactcagatacctgaatacctgcttctctggccaactctatcatatatatggttcctcggtgatggttgggaaacctcagggtcaaagcctgtggcccaaaagctgtgccttctgacatgtgggtgtcctcgctgcggacacacccatagattctccttcacatgaggcaggctcaagatacaatgtttggagtggtccctagaatcgctgggcagaaaaggtgacccagatggtagttgtctgtctgtgtgtggtctatagaaagggccagatggtggccggttgcagatctctcttgattgggaaccagaaaggaaacctttcaccccagaatcagggagagcagtgaaatccagatctgtcctctcacctcgagctgtcgtctccacctgtaaattctctgatctctccgcttatgacccaactggagttgagcctttcttacttcctctaggcagcagatacatccagctcctggcattgtcaggtgacagaaggcacgatggaagcacaaggaaagggatgaggcagccagacactgtccctgagtaaagtgtggtccaccctgcccagcctttctttggctgctgggggcagctgggagcagataggtttctggaatgcgtggctccatgccccagaggtcgatgtcatcttctggcccctttccaacttggcttatctagaatgagtcacagtctccagaagaatgccaagtccctccctgttcctgtggaggctgtgcgacatcatctggactttattttggatcttcattccctgccccctgctgtctggggcctgaagccggtagtagaggagtgaaggaagctgacggtcccgccactaggaccagggggacacttcttgactctgagtagactggctaatcagtgagccagcctggggtaactgtaccctttatcttccctcattacacaaaacagtgggcttcattccaatattttcatatgtgcatataattagttttgatcgtactcacccacccaccattgacttctcttcttcctcctcccaagtaggctgctttcaaaccttttttccccctaaaattggatagtcacagctctttgatcttcagggcttggtctatctgtctcttgtattgggtggtggtggtgcacgcctttaatcccagcactcaggaggcagaggcaggcggatttatgagttacaggtcagcctggtctacagagtgagctctgggtcagccaggaccacacagagaaaccctgactcaaaaacaaataaacaaaaacgacgacaacagataaagtttgctgcttaggtcctcagaagcctaaatctggattccagcatcggtccagcttggtaacaccagccgaattcttccatgtccttcgtgccctttccatccacaggcaactgagatgttgggagaggagcaggaggaaaatagcaagaggtgctctgtggcataggaagtctacacccattcctgagattggtgccagctactctgattcgatgtttgtacagtttcatagagctggcctgaaagctaggggggcgcatggagactgtccctccctcccggatccctgtgccatagtgaaggagcagagcttctggtcaccctactgtggtaggaatgctgcaatgtcctcttaaacagcaagaagcaagaccaacaggctcgtgcttagagcctgtgatgtaagatgtttaccaaaatgggaggcttgtcttggcacacgggtacatctctgtgatcccagcacttgggaggcggaagcaggaggtcaggagttcaaagccgatgtttgatacacagcaaatgtaaggccagtctgggctgtatgagatcctgtctcaaagaggaatcggggtactttccatccttaggatatttcactgaatagagctgggtttgttaccaacatgtaacacttactccatcctggtacctaagtggtattcggtgggtgaatgtacagattgtacccccagttctttgattaacagaatagtctttatctttacttaagcaaccattgctgagccaaagtgtacgtcattttatttcttttccttttttttttttttaagacaggtgttacgttacgctgtagtgcaggatggcctcaaatgtgtggcaatcctcctgcctcagcttcttgaaagctagaactttatgggcattagccgtcatgtccaacttccttttttatttttggtgagtgccaaattatcctgtaaaacccgcacaccacgtttcatggtagttccttctcacacctctctctctctctctctctctctccctctctctctaggatgaatcaggcaccgactgtgggctttgagaaggatgttggcagccgaacaactcaccatttcatgtacccagagagtgccaagaacctgcctgccaatgtcagcttcgtgctggtccccttcaaggccctggacctaatgtggattgccagcgccctctccacaggacagatccgattgtgagcctctttgctggctgagtagcacacgggtgtcaggagttctatgggagggcttgtctctgagttcaaaaggttctctaattgaattagtgcgaagtaggagctcaaaaatggagttgattctatgtcacttcccttgtggtgcagctcagggtacagctctgggctgtggggttttttttctctggtaactgtctttgagatggcagttctatcacagctggcaaccctgacaattcatttcactgagggtttgttgttgttcttttttaagatttatgtatgtattgtatgtatatgagtactcagtcttaatgcaacccagaagagggcatcagatcccattactgatggttgtgagccaccatgtggttgctgggaattgaactcaggacctctggaagagcagccagtgttcttaaccactgagccatctctccatccctggttgccttttctatttattgctgtttgtttgttttatttctgagacaagctcttgataagctgctgaaactggccttaaattttctctgcagctgaagcaggccttgaacttgtgatcctcatgtctcagctcccctactgactgggatcacaggtctgtgtcacaaggcctggtttaccaaaagtttgtcaggttttgttggcttacatttaaaaaaaaaagcatttatgtgaatgtgactgagtgtatatatgtgcactgtatgtgtgcaagagcccaaggaggttggaagaggacatcggattctcaggaactggggttatacaggtgtttgtgagcttccatgtgggtgctgagaactaaatctgattcctctgcaagagcagcaaatgctggtaaccactgaaccatctccccagctttatttgatttgttttgtttttgtttttttttcttcgagacagggtttctctgtatagccctggctgtcctggaactcactttgtagaccaggctggccttgaactcagagatccacctgcctctgcctcccaagtgctgggattaaagtaaaaaaaaattttttttaaagtagtaagaaggccaaaagtggtttagcaatggcttactccttatgccttgctcagtctactttcttatagaagccagagccaccggcctaggggtggctccacctacaatggactggaccctcctatcagtcactaattaagaaaatgcctcacagctagatcttatggaggcatcttcttaattgaggttctcccctctcagatgccgctagcttgcgtcaggttgacataaaaagtaggcacacacacacacacacacacacacacacacacacacacacacggcgagtttgagatcagctattccaaatgctgagtttcccaacagagagcttaggggagaaagggtgaaactgcaagttcctaggcttgactagaggatcccaattttatcccgaaagccactgaaggtttttatcatggccctgcagtggcgaacatgcaacgggaataggtcagtctagaaattgtgagggtgtcactatttggtcatcaggagcaaatgtgttgccatctgaaaggttttttttcctgttttcttgcagcacctatgccccagtgaagtccttccttcgagtggacaaagagaaggtaagttctctaccccctgtcttttgactctcaccaccatggaaattatgctggcttattcaagcgatgccaagagagtgagtgagttttaggatggccagagctacccaagagaaatcctgtcctgggggtgcagggggagggggcaggtgtgggatctgcatctgctggtatgcctgacccctacaatgaacacaagaacctaggaatacccatgtgctgcattcccgaggaactgctagaagctgttcagagcctggcccaaatctccagacctccaagcccttcatgtacctttctctccttgcaggtccagatttacaacccagccttcttcaagtacattcacgacaggtggaccgagcaccacgggcgctacccttccacaggaatgctggtgctcttctttgcactacatgtgtgtgatgaggtaggcagtcggtgttgtctagagcagaattaggagaaccataaacagaggaaacagccctttccccatcttagctgtggttcccgggaagtagtttttgtaaacagaaaccatgttttttcatatctgttattcctataaacaatatttttgcatttcccatcgtcattaccttttaagatttactaacaaaactacttcatttaaaaggcacatttttagcagggtcatggtggcacctgtaatcagatacggagagtttgagacaggagcagcgtttgaggccaacctgggctacataagacccagtcgtgaaaaagcgaaacacaaatgagaaagagacagaagtcccctctgagtcagtgcccttatgtcaggcctgggtgtccccaaccacgcccccgactcccagtgacccctgtgccaccctcctcacaggtgaacgtgtatgggttcggggccgacagtcgaggcaactggcaccactactgggagaacaaccggtacgcgggcgagttccggaagacaggcgtgcatgacgccgacttcgaagcccacatcatcgacatgctggccaaggccagcaagatcgaggtctaccgagggaactgagcggccctgagcgccttcagaaccagtcacttctgggtccggcaagcgccggttgcagcccaccaatcagactgcgccgtccccagcaaccaatcagtgctgcagttgggaggagcttctttcttagccaatcacgcaactcaaggagaatttccggcgccgccgtctccaccaatcatggccttgggaggcggcgggcctcgaccccctcccctaaacctgctttggataagaattttgatgctttttaagaggcgggtctggggctgggcaggagcgccttgaactgctcatttccagcttaagccgggtgggtgagtgaagccatccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaaaggtggccgagaaaagcagcatctggcagtttctgggcagcatcctgcaagtggaggcccgggcactttgcaacattccaaggcggtagagccagagggaaggctcacaagctcagcctcccccattctagatgggctgcagccgcagcaggctgaggtgagcagagagcatcctggcacggaggagcagacccagcagggcactggggctgagtgagggacccagggcctctctccccaacccacgctggcagtatggtgacagctgctgtgcaaatggcccaccagaccaatgcagctgcacagagcagagcaaagaactcaaagatgcaagaggagctctggccagttcctcctggctctctctagttcctacctctggatgcggatgctctggtcttggtggccctgagtcgctatcatcacatcagcctcgtccagaacaaacaccttgatcttcttggggtcaatgaacttcagcttggagcaccagtccaagacggtcccgggggtgccaatgacaatctgctcactcaccttctgacctctctccactgtggaaaaggtaagttttctttacatgttccaaagagaaagccagttctggaaataaaaatcttctacattgtcttagaagtgtcagaacaagtcactttcagatttcacatcacatgggatagctggtaagatggcttagtgtgctaaggctcctgtcagatcctaagaactatgttcactctctgaaaaccacatagtgaaaagaactgacctgagattaccctctcacccccacagcccaataaataacccacgagggtcgtcctcaagcctcgcttcttcaacagtgacgtgaacactgtgtgctgcactgtggacacaaaacgtgcatgtttctactttctcctaaaaacctaaaaaagttcattcgtttatctgtggataaagggtagagttctgtgcctgcagagtctagacggcattggcagatcctctgattggagttaccaagttatgagctgccatgtggacactagaaaattgaacctgggtccttctagaagagcagtgagtgctcttaaccactgccccatctctccagccctctccacagttgatgtcatgaaacttctctttaactgtgttttttcattcatatatatatgaaaagacatatatatatatatacacatatacatatatgtgagtgtgtaaatacacatacaggtgtgtatgtatgtatacatatataacacatacatacacacacatatggctgtcctctctgtagaccaggctggcctcacactcagaaatctgcctgcctctgcctcccaagggctgggagtaaaggcgtgtgccaccaccacccggttatatgtatgtttttaaaaaaagattcacttattttatgtatgtgagtatactgtagctgtcttcagacacaccacaaaagggaatcagatcccattacagatggttgtgagccaccatgtggttgctgggatttgaacccaggacctctggaagagcagtcagtgctcttaaccgctgagccatctctctggcccctgtgtgtcttttcatatcatctattctctcatgtagttcactcaattcctcctatgctggtagttgagtcaaggatcctggccacgtttttgttctgttttctggtctatgaagattctacttgtataggtagttttcctaggataaatctctttagtttacaacacacaagcccatgacacacagtctctgaaatttaagctaggtcaagtttattcatgttcactttaacattccattgtaagaaattaagccagtggtggtcaggcatgagcccaagtttacaaattccatctctgtttaggcctcctcccttatacttacatttattgcctcgaacagcataagctagcttcaattctgggtgaaacttgcccatctgctcaatcacttttccagtttgtaatgccagctcatatgttggggacaggcacaaacactagcagagaaatcacaaaaggcgagttcagtgacagacaacgggcctcctgaaatactgcagggacctactcctcaagcaggacctgttgaacaaatgccatcagtaagggacccggcatcagtggttcagtattggtggaggccatagaaatcactgcctaaagccgaggtctccaaaagaatcctcccctgtcaaggcatggcgcactaactgctttgagatgtcaaagactaaggtgccaacacaagttacacctcatcagatggctctactgggactcagggcaggcaagcaacagcccccaggcttctaacactcacctgaggatatctgtctgctggttccactctgctgagcatagctaggacaaaggcagctgttttcccagtaccagactgggactgtgcaatcaggttctgtgggctgcaatgacaaagaacagaaataaaatattggagcaaggtgtggtgatctacacttttaatcccagcacttagaaggcagacacaggcagatctaagtgtgagagcagtctggtttacataccaaattcctggacagtcaattctacatgatgagatcttgtctcaaaaaaaaaaaaaaaaaatccacttatgtttctttttattacctatgtttctgcactgaacagaaaataactttcacacagtatttcatttggtaatgtgccaccagcttcatttcaacccctacattttaaaaatgctttgattcatttatgtatgcacgcctatatatctgtgtatagaatgccatgtatgtgcagctgagtacacacagagaccagaagagggaatcagatgtcagatctcctagaacttgagtcacaggaagttgtggtccacctgacagggtaataggaacccaagctgggtcctgtggaagagcaggaagtgcttatcaccactgaggcatctctccagctcctttcaaagatttacaaattatgtttctgtgctttgtgctttggggagtggagctaagtgagtgtgaacgaagaggacagtctttaggagttggttttttccttttaccacacggtcccagggatccatctaacaggtgtcaattattggaatgtgcatttactctgagctacctcatagctccattttattctatgttagttttttcttaaaggatattattatttagtattattattagatgggttcacactaacaaaatcctcattccagattctgaaatattctaatttaaatgcccaaagtatcccagagagatcaagactgcggagtaagatctaggccacagaagccctcatggtgttctctgctgagctataccatgcccgagtgcagctctctggatattctctcttcccacctacacagctgacttaagactcttattcagttggctaattctcctttctttcttcaaggtcttattatgtatgtagctcagggtgttggcctcaaattcatgatccatgaccttacttctgcatactgagtttataactaggtctactgggtattttagaaggaacctttacaatctacatcacctgacccaataccatggtgttttgtcactaaaaatagttgaagccaggtgtggtggttgcatgcctttaatttcagtactcaggaggcagaagcaagtggatttctgtgatttcaggcttctctatagagtgagttccagaacaaccaaagctacatagtgatatctatttcaaaaaaacaaaaatcaaaagcagacaaacaagcaaaaataaaagttgagattaaaaaaacttctacagccaggcagtggtggcgcatgcttttaatcccagcacttgggaggcagaggcaggcggatttctgagttccaggccagcctggtctacagaggaaaaggaaaagaaatgaaaggaaggaagaaagaaaaaaaaaattctacaaaatgcaatatcacttatctaggttttaaaaatatgcaagctacccttcagagcattagacacctatgaacacagcgaaagtatttaaagacacacaggagataacccatgtcaggaaggcatttgcttcaagtggggtagacaagggatgggaagagcctatgggaggttccacttgcaaatagattaatgttatatctttatttttttttttccccgagacagggtttctctgtataaccctggctgtcctggaacttactttgtagaccaggctagcctcgaactcagaaatctacctgcctctgcctcccgagtgctgggattaaaggcgtgcgacaccacgcccggctttaatgttatatcttacatgctgaacaaagctagagagatattcctggttatctctctgtatacttttttgttgtagagctaaaaaatttcaatgtattatttttaaaaaattattttatgtgcgtggatctttagcctacgcatctgtgaagcatttgtatgcctggtgccctcagaggttagaagagggcatcagatcctctagaactagagttagatacatggttgtgaacccatgatgtggttactgggaattaaacctgggtcttctggcagagtgctcttaactgctgagcccatgtgaaggccaggagtgttagttagcacatgcctttaacccctccactgggaggcagaggcaggcagatctgagtttgagactatcctggtctatagatcaagtttaaggatagccagaactacacaagaaaccctgtctcaacgttcctctcccccaagaagtatgttcaaatccccctgattctctttgcacatttgaagctctttttctgaggaagcaggatgtcccagacagcccattttgtgcccagcaacaatgacagtcatttgtgaaacacttagctaagccacctgtgaagaggtgcagccgggtcggtactcacggttcagcaagcatcatgggcagagcattctcctggatcttggacggtcgattgaagcccatggcgtagactccttggagaagctgaggtttcctagggggaagggtagagataagatggctttccagcaattaaaatgtttttagagacttatcaccttccctagatatatctacctaggtatgatgctcatctcagtcaaactactattctaaaattcacatttggttattctctatgtatgtctgtatgtgagcatgtgccatgggtgtacaggtggaggtcagagggcaacttgcacaggtcagcgttctcccttcactatgaaggtactagggtttgaactcagcttattgggcttggtggcaagtgcctttacccaattaaccacctcaccacctccaactatggtttgtttgttttttgagacaggatttctctgtatagccctggttgtcctggaactcactctgtagaccagaaatctgcctgcctctgccctccaaatgttgggattaaaggcatgtgccaccactgcccgactcaaactattttttaagaagatttatttttatctatgtgtatgaattcatatgtgtatgcataggggtgtgtgtgtatgtgtgtgtttgcacacacatacatgcgcctatagaagacaggaaactcgaagctagagttacaagcagccatgcactgctggccgtgggtgcggggaatcaagctgcagtctaatgcaccagcagcaaccagttttaatccacagccatttccagctctcacaccacccatacccacctaaaaacaaagtctcatcttaccctattaaatgctactctgagactactacagtttctcagataaatggaagaatccacgctttcagcaggcccacctatgtgttcagacagatctggatgacaagtgttccatggatgcagcaaaagtgataaattcataccatgaaataagttataaaggaaatttctaaaataaacactgctttttttttaaaggatttatttttatgtatacgagtacacttttgctatctccagaaacaccagaagagggtatcagatctagttacagatggctgtgagccaccatgtggttgctgagaattgaactcaggacctctggaagagcagtcagtgccacctctccaggccccaaataaacactgcttgttatactgttgcaatgtagaatttctttagaaaaatggaattttcagaggtttttttttttgccagtgtctcaggtatccaaagttatccttaattctgatcatctatattttgtgaaactgtttttctttctgagagatgaggtctctctatgaagccgagactgttctgaaacttggtagacctcacaccctgacttggcatactcccaagtg

SEQ ID NO: 1376 - DNA, 1176 bp, Mus musculus
gccaaaacaagcaggctgcgccgtggctggccccgcagcgggccgggaaaggattggccacggtgacagccaccccgtggccagcacgatgaagtgctctcttcgggtgtggttcctctctatggcattcctgctggtgttcattatgtccctgctcttcacctactcgcaccacagcatggctaccttgccctacctggactcgggggctctgggcggcacacaccgggtgaagctggtaccaggctattcaggactacagcgcctcggcaaggaggggcttttggggagaaattgtgcctgcagtcgctgcatgggtgacgccagcacctctgaatggtttgacagccactttgacggcaacatctcacccgtctggaccagagataacatgaacctccccccggatgtccagcggtggtggatgatgctacaaccccaattcaagtcacacaacaccaacgaagtgctggaaaaactgttccagatcgtgcctggcgagaacccctaccgcttccgggacccccaacagtgccggcgctgtgctgtggtcgggaactcaggcaaccttcggggctctggctatggacaagaagtggacagccacaactttatcatgaggatgaatcaggcaccgactgtgggctttgagaaggatgttggcagccgaacaactcaccatttcatgtacccagagagtgccaagaacctgcctgccaatgtcagcttcgtgctggtccccttcaaggccctggacctaatgtggattgccagcgccctctccacaggacagatccgattcacctatgccccagtgaagtccttccttcgagtggacaaagagaaggtccagatttacaacccagccttcttcaagtacattcacgacaggtggaccgagcaccacgggcgctacccttccacaggaatgctggtgctcttctttgcactacatgtgtgtgatgaggtgaacgtgtatgggttcggggccgacagtcgaggcaactggcaccactactgggagaacaaccggtacgcgggcgagttccggaagacaggcgtgcatgacgccgacttcgaagcccacatcatcgacatgctggccaaggccagcaagatcgaggtctaccgagggaactgagcggccctgagcgccttcagaaccagtcacttctg

SEQ ID NO: 1377 - protein, 379 aa, Mus musculus
PKQAGCAVAGPAAGRERIGHGDSHPVASTMKCSLRVWFLSMAFLLVFIMSLLFTYSHHSMATLPYLDSGALGGTHRVKLVPGYSGLQRLGKEGLLGRNCACSRCMGDASTSEWFDSHFDGNISPVWTRDNMNLPPDVQRWWMMLQPQFKSHNTNEVLEKLFQIVPGENPYRFRDPQQCRRCAVVGNSGNLRGSGYGQEVDSHNFIMRMNQAPTVGFEKDVGSRTTHHFMYPESAKNLPANVSFVLVPFKALDLMWIASALSTGQIRFTYAPVKSFLRVDKEKVQIYNPAFFKYIHDRWTEHHGRYPSTGMLVLFFALHVCDEVNVYGFGADSRGNWHHYWENNRYAGEFRKTGVHDADFEAHIIDMLAKASKIEVYRGN

SEQ ID NO: 1378 - DNA, 77478 bp, Homo sapiens
  misc_feature (1)...(77478): n = A,T,C or G
tgaagccctcagtgcagcagcagacccaaaaatctgtacgtggcctcaccatctggggtacacagagccattacacacacatacacacaaactgttataaaataaagcacagtcggccaggcatggtggctcatgcctgtaatcccagcactttgagaggctgaggcggtaggatcacgaggtcaggagttcgagaccagcctggccgacacgtaaaacccatctctactaaaaatacaaaaacttagcagggcatggtggtgggcatctataatcccagctactcaggaggctgaggcaggagaattgcttgaaaccacgtggtggaggttgcagtgagccgagatcatgccactgcattccagctttggcaacaagagtgaaactccatctcaaaaaaataacaataaaatagagcacagtcggacgggcatggtggctcatgcctgtaatcccagtactttgggaggccgaggtgggcatatcatttgaggtcaggagtttgagaccagcctggccaacatggtgaaaccctgtctctactaaaaatacaaaaattagctgggcgtgctggcgcgtgcctgtaatcccagccactcaggaggctgaggcaggagaattgcttgaatccaggaggcaggagatgcagtgagtcaagatcatgccactacactccagcctgggtgacacagcgagactccatctcaaaaaataaaaaagaacagagtctagtgattaaatccaaggattaaacttagacaaatccgctcagctgccacgactttcttttttttttctttttctttttttctctcttttgagacagggtctcactctgttgcccagtttggagtgcagtggtgcaatcacggctcacagcagcctccaacccctgggctcaagtgatcctcccaagtagctgggactataggtgtgtgcaaccacacagggtcttgccatgttgccaaagctggtctcgaacagctgggttcaagcaatcctcctgccgtggcttcccaaagtactgggattacaggcatgagccaccacactcagccctttaaaaacaatattttttttcttatagcatagagactgggtctcactacgttgctcaggctgggtttttgtttttttcttgttgttgtttttttattttatttgagatggagtctcgctctgtctcccaggctgcagtgcagtggcccaatctcggctcactgcagcctctgcctcccgggttcaagtgattctcctgcctcagcctcctgaggattacaggcacataccaccacacttggctaattttttttttttttgagacggagtctcactctgtcgcccaggctggagtgcggtggcatgatcttggctcactgcaagctccgcctcccgggttcatgccattctcctgcctcagcctcccgagtagctgggactacaagtgcctgccaccacgcctggctaattttttgtatttttagtagagacggggtttcaccgtgttagccaggatggtctcgatctcctgacctcatgatccgcccgcctcagcctcccaaagtgctgggattacaggcatgagccaccgcacctggccaaacacatggctaatttttgtatttttagtagagatggggtttcatcatactggccaggctggccttgaactcctgaactcaggtgatttgtctgcttcaccctcccaaaattctaggattataggcatgagccaccactcttggcctccagcctggtcttgaactccttggctcaagcgatcctcccaccttgggctccaaaagtgctgggattactggtgtgagccaccacacctggcctctcatcactttctaaccgtgcgagcaagccactcaacctgtttgagcccaacttccttatctgtgagattaaaatagaatttccaaattaggttgttgggagggtttcatgagctaatgcacataaagggtttagcgcagtgcctaatacaatgtaggcatccaaactccttattgttaaacaaatgacctactgccagaatgtgagggtccaggtctgggagggaggactttttggagaaggtgaaatcttcaggcccctgatgagatgtgtggctgttactggtagcagaaattccctctgggagccagaactgcccatagggatattttaggttgggtgcctagatgcagagcctgagacaggaattcttgtgtaagcgacttcctaggggagtggggaaagcaggatagggcagggaaagaaaccaagtaaagatgtaagttcacctaaattttgcctcaatctgattgaacagggagctctggagcataaaatgcaatccaggccaggtgcagtggctcacacctgtaatcccagcattttgggaggccgaggcaggcggatcatctgagggcaggagttccagatcagtctggctgatatggagaaaccccatctctacttaaaatacaaaaagtagccgagcatggtggcatgtgcctgtaatcccagctacgtgggaggctgaggcaaaagaatggcttgaacctggagggtgtacgatgcagtgagctgagatatcgctactgcacttcaacctgggtgacagagccagactctgtatccccccaccccgcaaaaaagccaattccttggcactggaggaagaaaactaaaaaagaaaaaaaaaggccgggcatggtgtctcccatctgtaatcccagaattttgggattaggtggcacagatttccagttacactagcagtggataagaatgccccacactcttgccaagatagttatcaagctttttgattgttgccaatctggtatgtgaaaaatgatatctcagtgtggtgattttcatctgcatttgttttattaagagtgatgtggctaggtacagtggctcacgcctgtaatccaaacactttgggaggccaaggcgggcggatcacgaggtcaggagttcgagaccagcttggccaacatggtgaaaccccgtgtctactaaaaatacaaaaattagctgggcatggtggcaggcacctgtaatcccagctactcgggaggctgaggcaggagaattgcttgaacctgggaggcggaggttgcagcgagcctagatcacaccactgcactccagcctgggcaaaagagcaagattctgtccaaaaaaaaaaaaaaaaaaagaaggaggaaggacaacgagaaggagaggaaagggaaggagaaggagaagggtaaggggaaacttgatgctccctttgcatcccattgaggtacagagggaaaaaaaaaaaaaaagaagagtgatgctctgagaaaataccaagtgttaggctgggtgcggtggctcacgcctgtaatcccagcactttgggaggctgaggcagggggatcacctgaggtcaggagttcaagaccagcctgaccaacatggagaaaccccgtctctactaaaaatgcaaaaattagcagagcatggtggtgcatgcctgtaatcccagctactcgggaggctaaggcaggataatcgcttgaacccaggaggtggaggttgcggtgagctgagatcgtgccattgtactccagccgggcaataagagcgaaactctgtctcaaataaataaataaataagtgttagtgaaggtgtggagaaattggaagcctgtccactgttggtgggagtggagaatggtgcagcagatacgggaaacagtatggtgctcttcaaaaaattaacactagagtgctcgcttcggcagcacatattctaaaattggaacgatacagagaagattagtatgacccctgcgcaaggatgacacgcaaattcatgaagcgttccatactaaaaaaaaaaaaaaaaaattgaaggccgggcgcggtggctcacacctgtaatcccagcactttgggaggccgaggtaggtggaccacgaggtctggagttcaagaccagcctgaccaatatggtgaaaccccatctctactaaaaatacaaaaattagccgggtgtggtggcatgtgcctgtaatcccagctactcaggaggctgaggcaggagaatcgcttgaacccgggagatggaagttgcagtgagctgagattgcaccattgcactccagcctgggcaaaagagcaagactccatctcaaaaacaaaacaaaacaaaaaaaacactagaattactagatctggactggacaggcagggcttgcgaaaggatcaagtctttggctacagatttattacatccgtctttggaagaggaaaagaaaaatcataaaagaaatggctagttcaaagtccaaattcttattttatggttgtaaaatgttgagattgtcccaagattaccatagttttcagccatgctcagacagtggttctttgtgtgggttgttcaacagtatcagcctacagaaggaaagcccagactcacagagggtgttcacttagaggaaagcaacacaaatggagtgatccacaccacttcctgaatctgtgttatctcacagaaagccttatcataagtctagcaattctaattcatctaccaagataatgtattcataattatgtttgattttgcaaagtatacaatagtgatctattttggtgtccattttccaataaagattatgagcaaaaaaaaaaattactatatgatccagcaatttcacttgatctgttgcccaggctagcgtgcagtggcacaatcatggttcactgcagcctggacctcccagactaaattgatcctcctgcttcagcctcacaaatagcagggactacaggcatgcatcaccacgcctgattagtttttacccagccaaaaaatcattttattatggaaacttcaaatatattcaaagatgaaaaattgttataattaattaacccagagaaactactcatcccctcttttttttttttttttttttggagatagagtctcgttctgttgcccaggctggagtgcagtggtacgatctctgctcactgcaacctctgcctcctgggttcaagccattctcctgcctcagcctcccaagtagctgggattacagccatgtgacactatgcccggctaatttttgtatttttagtagagacagggtttcgccttgttggccaggctggtctcaaactcatgacctcaagtgatctgcctgcttcggcctcccaaagtcctgggattatgggtgtgagccaccatgcgtggcctcatctcttctataattatcaatttaaccaaccttgttgtatctatacctatacctcaaacctggattattttgaagcaaaaattgagaacaagaccctgtctcgaagaaaaaaagaaaatagacaacacaattgaaagcaggagctcaaagagatatttgtacactcatgttcatagcagtagtatttaaagtagccaagagctacaaacaacccatcattgacagatgaatgaataaagaaaacgtggtatgtacatataatagagtattatccagctttacaaaggaaggaaattctgacatatgctacaatatggatgaaccttgtggacattatgctaagtagaatatgctggtcacaagaggacaagtactgtatgattgcacatttcctattagctacttggtacattttcttttattttttgagagacaagggtcttgctctgtcatgcaggctggagtgcagtggcacaatccagctactcgggaagctgaggcaggctgtcgcacaagctggggtgcagtggtgcgatcttggctcacggcaacctctgcccccagggttgaagtgattctcctgcctcagcctcccgagtagctgggattacagacacccgccaccatgtccggctaacttatgtatttttagtaaggagagggttttaccatgttggccaggctggtctcaaactcctgaccttaagtgatctgcctgcctcagccttccaaagtgctgggattacaggcatgagcctccttgcccagtcaaaaaagacattataaaaaaaaaaaaaaaaaggcccagagcagtggctcatgcctgtaatcccagcattttgggaggctgaggctggcggatcacaaggtcaacagatagagaccatcctggtcaacgaggtgaaaccctgtctctactaaaaatacaaaaattagctgggcatggtggtgcgtgccagtagttccagctcgggaggctgaggtggaaggatcccttgagcccaggagttcgaggatgcagtgagccatgatcacaccactgcactccagcctgggtgagacagcaaaacctagtctctaaaaagaaaaaaaaaaggtggtaagaacagattttaatttgtaatatactattgcaatagggaagagggtccagcgtgaacttggcccaactttgatttgtacagaagtgactgggaatttaaatttattttttagagatggggtcttgttacgctgcccaggctggtctcaaactcctgtcctcatgtgatcctgccacttcggcctctagagtagctgggattacaggcacaagccagtgagtctggcaagataacttgtgttttttgtttgttttgtgacagagtcttgctctgttgcccaggctggagtgcagtggtgcgatctcagctcattgcaacctcagctcattgcaacctctgcctcccaggttcaagtgattctcctgcgtcagccgcccaagcagctggaactacaggcacccaccactgcacctggctaattttttgtattttttgcattttttttttttttgagacggagtctcgctctgtcgtccaggctggagtgcagtggtgtgatctcagctcactgcaagctccacctcccgagttcacaccattctcctgcctcagcctcctgagtagctgggactacaggtgcccgccaccaggcccgactaattttttttgtatttttagtagagacagggtttcaccgtgttagccaggatggtctcgatctcctgacctcatgatctgcccgccttggcctcccaaagtgctgggattacaggcatgagccactgcgcccggccctaattttttgtatttttagtagagatgggctttcaacatgttggccaggctggtctcgaactcctgacctcaagtgctccgcctacctcggccttccaaaatgctgggattacacgtgtgagccactgttcctggcctagttgtgttttaaagtggatgaaggagtagggaaggtggcaagcaggggttcggtagagtcagggacatgaaaaattgcaaaggattggtcaatgtacagctctgtccactagctggcaattatcaaagttaggattctgtcctcccacaaagaggccttatccttcaggatgacgacattcaaggaatggctttcaggtccttgagaaagacactcttgagttgtagaagatacttacacatctcaaaggatcagataaggaattcacaattgtgagccctttttagtaaatgctctgagaaagtgtagtcagagcctatgattgggtgtcgcctggaacagtaaattctttcggcagtggtgcgccttctcaggcaggcactttaaggtgggtttgggtcatcccaggatgtgaccttgagctgttagaaactatattactgtttaagtctctttttttttttgagacggattcttgctctgttgtccaggctggagtgcagtggtgcaatctctgctcactgcaacctccacctcctgggttcaagcaattctctgcctcagcctccccagtagctaggattacaggcgcctgccaccacgccccgctaattttttgtattttcagtagagacggagtttcaccatcttggccaggctggaagagttcaggccacccctgaactccagaccttgtgatccacccgcctcggcctcccaaagtgctgggattacaggcatgagccatggcgcccagccttcttttcttttttataaagagagacagggtttttccacgttgcctaggctggtctcaaactcctaagctcagacaatctacatgcctaggcctcctaaagtgctgcgattacaggcgtgagccactgtgacccgcctctgtagaagccttttaatgtggagggaggagggtgggtaaaatcacttgtgttgagagtctgccggtgttttgtttgtttgtttgtttgtttgtttgtttttgagacggagtcttgctctgccggccaggctggagtgcagtggcgcgacgttggctcactgaaacctccatccccccggattcaagtgattctcctgcctcagcctcctgagtagctgggattacaggcgcctgccaccatgcccggctaatttttatatttttagtagagacggagtttcaccatcttggccaggctggtcttgaactcctgacctcatgatccacctgcctcagcctcccaaagtgctgggattacaggtgtgagccaccacgcctggcccttttttgtttaagacagagtctcactctgttgcccaggctggagtgcaatggcatgatctcagctcactgtaacctccaactcccagattcaagcaattctcgtgcctcagcctcccaagtagctgggattacaggcacgcactaccacacccagctaatttttgcatttttggtagagacagggttttgccatgttggtcaggctggtcttaactcctggcctcatgtgatccacctgcctcagcctcccaaagtgctggggtcgtgatgacatcactgcactccagcctgggcgacagtgagaccttgagcaaaaacaaagagcgttcctgtgctaaaggggactagactgggaccctgcctttccgggtttggctcttcagggccattattaattatcccacacaagggccatccttgaaagaggataccggtgtgttagcagcaaacaccaacagcagaggttatcaggttatcaaggtagtaaccggcagcatgagcaacacctggagacggggtagcaatgccaattctggggcctgccctagagctaaaagaaccagaagctgagggtgggggcagcaatctgcgtttaaacaagctggccaagaggatcccatacacaccaaaaattcagaaccacttcagcctcacttcagcctgttggagggcgaaactgcagtctacctggagtttcataaaggttttgaaataggtgcggaagttagggaaaggatgggctaataaaagacatggcaaatatttaaaatgcattcactttaccctcaacagcaggaagctacgggcatctaagagagagcctgcaagggggagatgccccggtggatgaggaaccaatagacactctgcccccttttcctcttttcctaggtggggaacacaaagtccagcgaggccaaacccccgctcgcaccgctgatggggtctctctcccctcaggccagggcgcagcggccccaccgcagctcgggctttcagagcccgggcgtgaagccaagctggcctcaggtcgcggctctttgagagcgcgagtgggaacagtgccctccggccgggctcgtcagcagctggccacagcagcatctgagaggcgtcctcggctagtgtgcacctccctaggaacccacgtatccaacccggctcggggccgtctgctccagccgctggagcccggccttctgagaatgaagacttcccatccccctccgtctcccctcctgcacggcggaccccctgagccctagcgaaactacaaagcccacaatccctgggatgcgcgcgctgtcttctgggagatgtagtcctggatgcggggcgcccctagcgacccagcgcccgctggactccatatcccagcatgccggcgcgcgtgcggggggcggagggagggagagacggggaggatgtgaatggggtgggggcagtcgcccctgtcccccacccttcccttcaagccgggcaggggtggggggaggggccgggctgaggcggcggcggcggcggcgctcggggagggttgggccaggcaagggcgggactagcccacggcgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgaggtgcgcgggtgggatgagggcgggcgggatgcagagcgccccgggcccccggctgcccagacctcccctgcgcgggcagctggcgcggcccagcggcccagaccggcccgttccagcccggcaacttcccccgggtcggggcgccgggctccctcgtgtgggcgggggtccgcgcgcgttggcctcattccggatccccgccttctgctttgcacgtccagccgctcccagcctcccagggctcccgctccgctcctttgccggcagcccccaaccccaaccccagccccagccccagccctcggaagagctctctgccctggtcccgacttccagtccactccctagttcgtaccgctaaccctgggtctcccggcctctgctccacctgggagaccccggccccactcttggccagagcctgtctgccccatcagctcctctttcctctctcccctgtgatctttcccctacctggcactgccccctaaccatcctcagtggcccagttctcacggctcgaccttcctactttggggaaactgaggcacggctgaagccagaaacttggccaaagcgccagtcccgtggaggctggtctgaacctcgtctctcctctctcctgttccttctctgccttggaatggaagtcatttcttacccccagtcattcccctgtgactggaccaaacttcccaccccctgctacagctctgggctgagctcacttgagtctccccttagcttcctgccgctcctgttggccttccctccttcgcataacccactccgggttccctctgcctgtagaggagtcagcaccaattgcttgcttgctcaagttagcctttcgatttatcttttgccaactgcatccatctcccgtctcccatcttccctcttgctttacagctgcgtaaaggagcggaggattgagtcaaaggtggtgttggagaaaggggctagagaggtgctgggggcaggcagggacctggggcctcttttcagtcaaagcctccgggggagtacagggcactctgggacctctggccagtaacacactcccgcctcgtctttgggacggatgtttggaagctggttggccaccccttccttgcctggtgggctctgaagcccttctcaggtggaaggtatcgctggtttttagagagatggtggcataagaggagtctgggagaccacacccctaagcttcatcttgcttctgctgctaactttggaggggttgccctttcagggagggatgcctgctggctgccctgatctctctgtggaggaaggcacagagtatgtgggcggtgatctcaagtttagtcgtgggactcaggatttagagggaacgagggctcagagaggtggcacagatttgcctgtattattcaggttttttgttttgtcctcttcagatttttttttttttgcggggggggcagagggggatagtcatccattctaccccaatccccagtttcccagtgggttgggtggaggaaaggagggacaggaggctctaggagttatgtgggttcctgaaggagcaatcttgatctgaaccagatggttcactgcttcagcaacccccttcccagccctcccccttggctgtgaattggatgcttttaaccttgtaacttgagaatggaggaagggaggccagggggccaactgtctgtgtgggtgtttatgtctgcctctgcacccttgcttgcaagtctggcaggggcctgtgggagtgaccctgcctgggagcgcattgttgtgatgtgctgtggcacgctgatggctcctgggaacttttggagtgcaaatcccagataaagccaagcttctgagagccactggctatggcctcaggggagcatttctactccggccaagcctcagggtaaggaccactcttctcgagaaggcacctgggattaaggagtctgcaataccaggattggggatttggggaggcttggtttttccatgtcttttcatggcaaaagaagacctgaggggtagggcctggggagaggggtgggaaatggattattttgcgttgtcctataccacatcctgccttattttggccatatttgtatacttcattttggctctcattagactgtggatgctcttcaaatgtgtcctcattttctgaaataccaccacctggcttggtccttagcacctagtgggtgttcagtaaatgaattacagcggaaggtctcatggttacaggtttagggaaggattcttcacatttgactgagagtcatagtctcctggagagctggttaaggcacagattgtgtgtgtgtgaggggactccagagttttatggtttaatcttggtggagcctatattttgcatctctctccagctccctagggctaacactttgagaaccactggtttggggtcatcacaatttcttgagagattaatccaagcagatgcgaagtctttttttttttttttttctttttttgagacgaagtctcactctgttgcccaggctggagtgcagtggcatgatctcggctcactgcagcctctgcctccagggttcaagcaattctcttgtctcggccttgttggccaccccttcctggggtgacaggaacctaggattacaggcatacgccacgacaccccgctactttttgtatttttagtagagacggggtttcaccatgtttgccagactggtttcgaactcctgacctcaggtgatccgcccgccttggcctcccaaagtgctgggattacaggcgtgagtcaccgctcctggccagatgtctttttttttttttgagatagagtcttgctctgtcacccaggctggagtgcagtggtgtgatctcagctcactgcaacctccgcctcccaggttcaggctattctcctgcctcagcctcccaagtagctgggattataggtatctgccaccatgcccggctgatttttgtatttgtagtagagatggggtttcttcatgttggccaggctggtctcgaactcctgacctcaggtgctccgcccgcctcagcttcccactgttgggattagaggcgtgagctactccgcccagctagatgtagtcttttttattttattttattttattttattttattttattttgagacgaggtttccctcttgttgcccaggctggagtgcaatggcgagatctcggctcactgcaacctctgcctcccaggttcaagcgattctcctgtctcagcctctggaatagctgggattacaggcatgcaccaccatgcccggctaatttttgtatttttttaaaatttattttattttttattttattttttgagatagagtttcactcttgttgcccaggctggaatgcaatggcacgatgtcggctcaccgcaacctccacctcccgggttcaagtaattctcctgactcagcctcccaagtagctgggattacaggcatgcgccaccacgcccatctaatttttttgtatttttagtagagatggagtttctccatgttggtcaggctggtctcaaactcctgacctcaggtgatccgcccgctggagcctccgaaagtgctgggattacaggcgtgaaccactgcgcccagccagctagatgtaaagtcttaagagggactttcttccaccttacttccccaccaggctgttctggcagctgtactggtttggcttttctttcattctgatgttgcccaggattggtaatgactggggggacactgccccacggttatttgaagcaaggccccacaaccaagcaggaaatttaggagccatggctttggaaaagggtggctgtgtgaagatatcgaagcaaattgctgaaccgggccctcgtctggcctgtgcctgtttccccaaccaagtgggttggggtgcctgccaagtaaagtcctgccatggctgcacactggacaggatacctgggagtctttgaaatttagaaatgcaggaggcatcacttacattgtgctttgcaaagcattttccaactgttgttttacaggtcagtggaacatttataaggcagatacagacccaggtagggttactgaggaacccagagatacactgtgggtcacacagtggccctgggactcctgattccagtgccaacggagtggctgctaaaccagttgctgctaatagcctgaattatggctgctgttcattgagtgcttgctgccagccaggcatggtgctagatgctctcaggtgttagtgaatcctcacagcagcactgcaaggtgggtgttgttgccgctgctttgtagatgaagaactgagacttacagaacttaccagatgtgcccaaacagacagcaggaggatctggggttgaaactcatgtctttctgatgcacagcccctgctcttagttcctgctccttgatgtgctcaacaaaccttaattgtcctttggggttgtctgcccccaaaagtctgaatttttttttttttgtttttgagatggagtctcgttctgttgccaggctggagtacagtggtgtgatctcggctcactgcaacctctgactcctgggttcaagcgactctcatgcctcagcctcccgagtagctgggattacaggcacgcaccaccacagccagctaatttttgtattgttactagagacggggttttgccatgttggccaggctggtctcgaactcctgacctcgtgatccgcctgcctcggcctcccaaactgctgggactataggtgtgagacactgtgcctggccaagtctgagtctttttgagctgagaactgtgctgagtgttgtggaggagacagtaatgtccaagttgctgttcctgggagggggataagacgagtccaccaatagatctacagtggaaatgtggccagttaaaggaggtcgaagtcatccccatagggagctcagaaaaggcatttgggatgggcctctaagggtaggtttccaagcagtgcctgtgggctggagggggtgtgcaggccaacaggtacaaagaaaggctatcacaaggcacatttagggagttgtcccttttttctagagcataggggatttatttagaaagtagtaaggaatcctatttggttgcaagcagcaacttggctgcctttggcaggaaagcatttccttggaaagctgtgggaactataaaatcagagtgatgactcaggacccaggtcccctccagggtcttggagtgggtgcagcaggaaccaaaggccagtctcttcagggaaccgctgttgccaggatgcatctgctccagctgtgctcactcattttgtcatcactgcttgggattcatatctgagggaggaagtgtctggttggcccagcctgggccgtgttcccttgttcccttccttggccagggaagggctggtggcatgttgggcagttccctcgcaaccctgcatccaaaagcaaaactctccagaaggagagaaaatacacactgcaaaaaatctgtccagacaggtgctggataaggacttgaactgacaggtggtgaagcagggggctttagtctgactagtttctgagcagaccgagggcaaactggcagcagggtatggctgggtcataaggggacagggagaggagggagggaggagatggagaactagatagagtccaattgaggtatgcaggccggcacttggcagtagaagtggaaaagaggggacggagtctagagagcttgcaaaagtagctgtcttcagagcagacactgatgggctggggcttggagtttcagtgcctggtgatgagagctggttcctttactgaaatggggcagtcaggaggaggaagagtttaggagaaggtgatgtggcctcgctttggaggagctgtgtgcttatgctgaccgcacacccggaatcctggtgagcttcctgaggttgggagccttgccctgaggcggtggggccgccgagccccagaggctctctatgtggtggacacagctggggctctctgccagctgggtgcttttgcatctcttctgtttccacatgcagcccgggatgggcttctcctccttccccttctgtgctttcagttcctgtgtcccagcttccgtcccacacacctgagtccttaccaactaaagggcctggccctgctttctgagaccgagttttccttcctctctgctcagagtgcttgttaatgataagtcctcattcagctattagggtagacatctccaagtgacatgtcgcaagaaggggggtctgaactttgcctgctatctgggggaaatcaggctttttcctccagttatgccatgctcatcagggacccctgcctatgtccctaaccagccattttagcgtacttcttgttgctatttataaatcattgttgtagttacaacatattgtcaggcttccatgttgccgttgtggaccttgtagggttccagggcacaggctgggctttgggcaatcctagctttctagctgagccctggtggtttcctgctgcagaaatgggtgggagggagggaacagagttgtcttgggtggaggcaggaggagctatgctgaagggtgccttatccctgcagattcttagagcaggtcatcttcctggagtgaagaggactttccctcaattcaaatatgtttgctgttttaccaactattaatgcagtggatactaccatgtacaataaggtgaacaagggccaaggtaaatctagaggaaaaaatgtaatttttaaaaattttaccaatcatgctaaatggggcctcgctgtgtcacccaggctggaatacagtggtgctgtcatagttcactgcagccttgaactcttgggctcaagtggtccttccacctcagcttcctgagtagctgcagcaactacaggtgtacactactttgtgcccagctaagttaaaaaaaaatatatatatatatattttttttaagacggagtctcgctctgttgcccaggctggagtgcagtggcgccatctcggctcactgcaagctctgcctcctgggttcatgccattctcctgcctcagcctcccgagtagctgggactacaggcacccgccaccacgcctggctaattttcttgtatttttagtagagacggggtttcactgtattagccaggatggtctcgatctcatgacctcgtgatctgcccgcctcggcctcccaaagtgctgggattacagaggtgagccactgcacctggccaatttttttttttttttttaaagagatgggagttttgctgtgtttcccaggctggtcttgaactcctggcttcaagtgatcctcccacctggctaaattttatttgcatgttggtgataattaacacaacacacatagttctggtatcagatgttgaaaacaacccagcttcttctttctgatgctattggtttctaggtgaaggggcccgtcctcctgggaggtggcattgcggggcccaggggcagagaggggaccctgaggtgttgcggcatgacccaaggacctgctctgtcttttctctcttgactgagcagtcctagccctgcgggcaggcagcagccccccagcctcagcaggtcagcagcctttggagggagaaaattggcaacaaatgttaatagctaattggtctacagggaactactttggtgtggaaaaatcaacaagatatttgtgtggctaaagggaacttagagggactagggctgacagtgaagaggggaagatgaggagaggcacacgtcaggagattgccccgccctgccacccccacctctccaccccctgctgcctgcctcccccacgccccctccttcctgtcttctttgcaggcttcctttttgtttgcaagggacattagtagaatatggaatctcccctgccctgtaagtcaggtttccccaacctttgttcctacccaagttcagttaaacacaaagcaccagcgatttgatgcaggcagtgaattggaacctgagtttcagggggaagtgaaagtttctgtgggcctgtgtggagtccctaggctacacaagaaaagatggcagcaaccaaagggaatgaggctgtgtgggaaagtaaagggagaggagagaaccccggcctcctcggttcccacctctcttgggtgctctagggagcagtgtgagtcctgggttcgggttgccagaccacaagggagtttctggggcctggccctctctctgctccttcctgtcccaaagggcttagtatttccctggatccaggcctgtttagtgtttggctggtttctggggcctccagcatggctcaggggagaccccaggtccatgggtaggaggagatggtgaggagaggaatggggatcccattcaggctcccctcgtgaagggggccaacactggtacttccttagacgggaagaggctgtggcatgggaagcaggtcaatagtttgtgtcaaggaggtgcagcccaagatcacagtggtggctgtttgatgaaggattttcctcagtgcctgaaaagcaatttactcttgtccttaaagcaacagtgggtaggcttctagaatgagtgtgagttttcatctcaagtggcagtgcccagctgtctgcatacctcagccccttcagacctggctgaggtattttagagggcattgtcttccacccatgctgccagtcctggcagttcctgcccagcctggatccctgggcataccctgccactaatgctgtgcagacaaagtgaggcctgctggccctctgttggcagcccagaggcccaggtggaggcctgggctggccgagggcccaggagcatcagggcaggtctgtttggctgtcctcaagggaaagcagcttgttattctcagggggcatgagggtgcagctgattttcacagtctagggcttggtctggttgaatgcatataggattcttgctgccttagctacccacagggttttggtgctgtgtgacccggggcaagtcattacccctctctaagcctgggaggccaaggcgggcagatcacctgaggtcaggagttcaagaccagcctggccaatatggcaaaaccctatctctactaacaatacaaaaaattagccgggtgtggtggagggcgcctgtaatcccagctactggggaggctgaggcaggagaatcacttgaacctgggaggtggaggttacagtgagccgtgatcaccccatttcactccagcctgggcaataagagcgaaactctgtctcaaaaaaaaaaaaaaaaaaaagaatttaaagccctgctcagggattcactcttttttttttttttttttttgagacagagtcttgctctgttgcccaggctggagtgcagtggcgcgatctcggctcactgcaagctccgcctcccgggttcatgccattctcctgcctcagcctgctagctgggactacaggcatctgccactacgcccggctaattttttgtatttttagtagagacggtgtttcaccgtgttagccaggatggtctcgatctcctgacctcgtgatctgcccacctcagcctcccaaagtgctgggattacaggcttgagccaccttacccggcctcagggattcattcttcagccatctggtcaacctgattgacagaagcccgccacagcctgagtggggaggtagtactgggggcccaggaggccatcataagggccagatgtctgtgggaattggcttgaactttctcctaacctgtttggatgcgttaagcagcagccagcctgctctggcatctccctggacaactcaggctcctgcagctgagggggctgtgctcagttcccctgcatccagtagttcctcacccccacttccaactcctgctctgtcctggattcaggcagaaaactccatctggtctctttcctcccttcttactctggccaccatttaggccctggggtgactgttaataggattcccatttttttatttgccaagttctcccccacccttttacatcctgtgctctgctctagccaggtttttccccaaagccagggtgggaggtggaatcagactgatctgggaggcgctgggtcagccgcacagccacgtggcagatctgtgaggagttgagaacccgcttggaaggggctgggtaggatctcactgtagagaagaggaggaaggtagtgaggaaaaggccacacataccaagatacaaaggcctgaactgagaaggcaggggacgtgtggggaccttgagaagtccagtttgagcagagcataaggtttcctggattgtgtccaagagggagggataggatagaggggtctggggagagatgggccccaagccccaccctagcagggaggaaggggcaggctttctggcagcctctggctgtcctgggctggtcacaaagaattgtgcttacaggaagcgggggaggggttgttaatggcagtttgttcacaggctgcaaggctgccaaaggtcagtctgataagagggaagagatagactccttgagttttgtaatcccagatagctgccttctcttagctggccccacagatactgacagttgagttggtgctgctgccgctctgtcacctcctcctgaaatacacagcccctggcttcggcccagctgggtttcccctgcctggccaccagctccctttcccatctgcggtcagctgtgcactgggggaggggacaaacctggcaagactgagctcattctgagcctgactcaggagtttgaagcctccccaggagtggtgccagggctgtggacagagcagtgacttccagacctttccgttccattttggtgtcagggttatcctgcagcccagccagccagacctggggcctttggggagttccgcctttaccccagagcattgggaggtctggctgttgtgatgagaggaattagagatggggatctaatgagatttgcttatgtgaagaccactttggctaccctatgaagaaggagttgaagggggtccgtttagtagatctggggcttaagtggttaggactgctggaggtgaagaatgacatttccttggatggagtgatggttgtagacagagcgagaaatagatctgagagacatttcagtggtaaaaattagttgagatttgtaatagattggctgtgagaggttgaggaaggagggctcacatatgactcttacatttcaggcttagatggatgggggttcctttcccagaaattgggaatacagaaagaatactgggtttggccaggcgcagtggctcacgcctgtaatcccagcactttgggaggctgaggcgggcggatcacgaggtcaggagatcgagaccatcctggctaacacggtgaaaccccatctctactaaaaatacaaaaattagccaggcatggtggcgggggcctgtagtcccagctacttgggaggctgaggcaggagaatggcttgaacccaggaggtggaggttgcagtgagccgagatcgcaccactgcactccagcctgggcgacagagtgagattcagtctcaaaaaaaaaaaaaaaaaagaagactgggtttgaggggcttgaggggcttggattatgcatgggtttggtttggggcaagttgagtttgagatactttttggatacctctactaaggtatactgtctaaaggatagcatccagaaattagtgggatagatgggtctggtgttcaggggcgtgactgtcaccatttgaaaagccagagatgctcaggtatggtggcttgtgtctgtaatctcagcactttgggatgctgaggtaagaggattgcctaagcccaggagttcgagaccagcctgggaaacatagggagaccatgtcggtaaaaagtattttaaaaagtagctgggaatggtggtacatacctgtggtcccggctactcgggaggctgaggtgggaggattgctggagcctgggaggtcaagactgcagtgaaccatttttgcgccactgcactccagcctgagcgacagagcgagaccctttgtcaaaaaagaaagagagaaaatccagagataattcttaaaggttgaaatacacttttgggccaggcgcggtggctcacgcctataattccaacactttgggaggccgaggtgggtggatcacctgaggttgggagttcaagaccagcctgaccaacatggagaaaccccgtctctactaaaaatacaaaattagccgggatggtggtgcatgcctgtaatcccagctactcaggaggctgaggcaggagaatcgcttgaacccgggaggcagaggttgtggtgagccgagattgcgccattgcactccagtctaggcaacaagagtgaaactctgtctcaaaaaaaaaaaaagaaaaacacttctgagggccgggtgtggtggctcacacctgtaatcccagcactttgggaggccgaggcaggcggattgcctgaggtcaggagttcaagaccagcctggccaatctggtgaaaccccgtgtctacgaaaaatataaagaattagctgggtgtggtggcattcacctcacctgtggtcccagctactcgggaggctgaggcaggagaatcgcttgaacctgggaggcggaggttgcagtgagccgagatcgcgccactgcactccagcctgggcgacagagtgagattcagtctcaaaaacaaaaaaaaaaaaaaaaaaaaaaaaggctttggcccccataatgcattgcaagatgagcaatggaacgtaggatcctaacttcctgttacgttctatattgacggtcatgttcttttttcctgaggacttcagctggttcaaggtatggctagacagcaaaaggcatggcaccctcccctgctgaggcttccctgtggttgggggactctgatggtgggcagtgtttactccaggccaccccagaaggccatgcagtcagggcctccctcaccatccgcacgtctgggcagttccctggctggagaaggacttcagtcctggccagaattgagccactgccaggaatccctgaacgtcagtacccggaccacttctgcccttgtgggcctctgagctgggtcgatttatcaagggtagggattttagaggcaggttcagggcagcccttctgcatcagatgtcaagtaagtagtttttttttttgagacagagtttcgctcttgttacccacccaggctggagtgaatggagcggtctcggttcactgcagcttccacctctcgggttcaagcgattctcctgtgtcagcttcccgagtagctggattaccattttacattctaacgttcaatttttaacaaggtaaattaacaaatggcagtagaactatggcaaagcatggtctccatgggtcaaaatggtacctggcactacctcaatatatcactgttttttttttgtcctgagacggagtctcactctgtcacccaggctggagtgcagtggcacgatctcagctcactgcaacctctgcctcctgggttcaagcaattctcctgcctcagcctcctgagtagctggaactacaggcgcacatcaccacgcccagctaatttttgtatctttatcagagacaggctttcaccatggtgaccaggctgatcttgaactcctgacctcaggtgatctgtccacctcggcctcctaaagtgctggaattacagacgtgagctgctgcgcctggcctatcactttttttttatgttgcccaggctgtacttgaactcttgggttcaagcaatccttccacctcagcttcctaagcagtggggactacaggcgtgcatcaccatgcccagctcaatacaagacatctttatcattaacaacaggtctttggggaaccatctctccccagctgccatctctgtgccctgtaacccaggcttggccaataagggcaccaaatgcacccagccacagtgcctggtccaggtttggacacagactccatatcagagtgaacccaggactccagcaggcatcttgaaaagagatgctgagacgaaggaggcctgtgccacgagcaggcaccttccatcatgtgggaaccaagagtggcatcattttccctgcatgtggccagtcatacccacaggcatctgagttaaaggtttcccttacatcaaagggcacttcaaattggatttttagccactgtaattaaagaagttcaaatgatacagtcttacaccatgtgcaaccattttccatttcattggcaagaactttattatttatttatttatttatttaatttttttgagacagagttttgctcttattgtcccaggctggagtgccatggcacatactcggctcaccgcgacctccaccgcccgggttcaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacatggagaaaccccgtctctactaaaagtacaaaaaaaaaaaaattagctgggcgtcatggcgcatgcctgtgatcccagctactcaggaggctgaggcaggagaatggctttttttgttttgttttgttttgtttttttgagacgaagtctcactctgtcacccaggctggagtgcagtggcacgatcttggctcactgccagctctgcctcccgagttcatgccattttcccgcctcagcctcctgagtagctgggactacaggcgcttgccaccacgcccggctaattttttgtacttttagtagagacggggtttcactgtggtctctgtctcctgacctcgtgatctgcccgcctcagcctcctaaagtgctgggattacaagcgtgagccactgcacccggccaggagaatcgctttaacccaggaggtggaggttgtggtgagccgagatcacaccattgcactccagcctgggcaaaaagagcgaaactccatctcaaaaaaaaaaaaaaaaaaatcattgagtcattccatttacagatcaggaagtggaagttgagaaatttgcccaagatccccaagccaggaggtagaagaactgaggcaagaacccaggttgtctgaattgcaggcagggggctttttccagtatggagtactgacttttttgtttgtttgttttgagatggagtctttctctgtcacccaggttggagtgcagtaacttggtcttggctcattgcagcctccgcctcccaggttcaagcgattcccctgcctcagcctccccagtagcagggatgacaggcatgtgccaccacgcccagctaattttttgtatttttagtagagacgggatttcaccatgttggccaggctggattcaaactcctgacctcaggtgatcttccggacgcagcctcccaaagtgctgggattacaggcgtgagccaccgcgcccagcctaaagtgttgatttttatggcaaatggtcccttcctcttaatggcccggggggagatctgtgtgatagctggtgttaggaaaggtctgagatggagacattcagtgacgtcagcttcctgaatgcccaccctcctgtgctgtttcttgctggcactgggatgaggacatggctctggtgtggctgtgttttctcaattctgttgagggatttggggtgagtcgtgctccccctctgtctcctcctttggaagagaatgcccaggacagtggtgccagtttcaggtacagaaaaacaaaaatagcgctcttttggactcagttctctgtcacttccagtttgtgaggggacaggtatttgactcagcttggcaaagccaggaatggagtgttgtagtaagagcttagcagcgtgctttgggctttgagcctctgacttaagaggagacctcagttcagtcttacacaggcttcttacctcaggtgagtcactttgctggggtctctgggccagaggtcaaggctgcccctatgagggctttggactctgagggtgtggcgttatgtgtgtattagcaaaatgctggtgtgcctgggagctttggggcaatgctcaccagctcctgagttctcgggagtgaagtttgggactggatgcctcttgcattctgagcctctcactcctgtgtctttcctcttgcccttcagatgtttgctgacagccatttctctcccgaactgtctgccagcccagactgacctgtctgcttctcctgctcagcgcccagagcaccctgtctgtttatgcctggggccggttttaactggtcccccagtcccatgtcacacacacctgttccctttggcttagctgcagtgtcacctctcgtccctgtttccttcctctctatgaggctgaaagtcaatgttacttggagatacagcactccacagcctacagtcattgctcatttaatctttgcagggagtgcgtgaggtcagtaggtaggcattatcgtgctcattttacaaatggaggacctgcagcccagagaggtgtgatttgcccaaagacacacagctgctctgctattgagcacagccagtcctggaatcaaggtcctccagcattggtccatcattccctgtgaaatgttagtgcaggctgggcttggtggctcaggcccgtaattccagcactttcgggggctgagacgggaggattggggtcaggagttcaagaccagcctgggcagcatagcaagatcctagctttacaaaaacaaacaataacaacaaacaaaatggtaattcataggcatgagttaaccacatatggggtggggatgccctagcctcacaatggccctatgagggctttggactctgaaagcgaagtcaggtgcggtgttgtgtgtacctgtggtcccagctgctcaggatgctgaggctgaggcaggaggccaagactgcagtgagccatgatcctagcactgcactccagcctgggctggagtaagaccttgtctcaaggaggggtggggcttgaaagcgggccctgggccccacctcctcacatccccagtccctgatagcaccatcatgtgggcgatgcctgtgtaaccccaagctgtatcataaagctggacaacaaagacagctccctggggtccactgtaatggaccaaggtctgtgcgtccttcctttccacatccccctaaagttgacaacagtagtacatggcacgatggatgttgtcttggcagggagcttataactcagcttaggccagatccaggagggcaggtcagtccttgaggatgggcagcagggaccgaggagggcccttggcgtcccccaaccttcgtttttctcaccccggggataaggctcagaggcggtgccagggaaaggcccactttgggcctactcacagcagcgatattgccactttccagaggtggtgaactgattccctagcaaccaggggccctgcctgagtaggtcacagcatgtcatcggctcctcaggaaagaggaagactgctcagctggagctcgggaccatgaaggcaggtgtgtgctgggctctcaggcactgtcctccccagcccacctcccagggctgaaccttagtgacagggaaaagcagggtgcaggacagcgatgcttcccaaagccacctgcagggttggtgctggaagttaccagatggcaccaggctggccgtgggctcacaatgacctctcttcctagctggaacttccagggtccctgttggaaaggaagtgtccagaggacacagcagctgagcaaggggcccacctctggttccctccatcttttactctgcatttctataccttcactctggagggctgggtgggaggacatggcttccttttagtcttctggtagaagcatggatgcaaacaccttccttgagtttccatgagcatagctgccacaggctgacctttccaaaagacattactaaatataaaaggagaacaaaagaaagctaaagatagggcgtgcaaagaataaaaacagcctggctcacaaagaacaagttactggtttgtttccaaagctttcggaccctgccctgttattccccttccaggagataaccacctccaaggccagcagacgtctgcaggccctttcgccaggctctctggcctcctagtgctggcttgtccactgtctaggttgtcttgtaggacccatgccaccaggaatcctctccagactacttgaccaccctgcagtcagatctctgttctgccctcttctctacccagggctcttggctgtggtggcggagggagggatgcctgtttccctaggtctcccaggtgattggcacctatgtgactggaccttttaggagtgcagccttgttccatgtaggccttgtaatatgacctacctcttgccatgctgctcaggccagtttagcccacgaactgccatacaaaaggctttctccaacatttgatcttggcagaaactatagaagtctccccacctggttccatcctcccactgggccacaagaatagaaactgataagaagttggcctagttgatggaagtttgaacccggggacagaggttgcagtgaaccgagatcatgccatttcactctagcttgggtgaaagagcaaaacttcatctcaaaaaaaaaaaaaaaaaaaagggaaggggggggtcaaatggtcagttgtggtgtccctaccccactgataacataggagccctttggagggatttgcctggtacaaagtaggcctccatacctgcagcctggactgttgctgtcatcatattgcctggccccagtggttctggcggacaccccaccttggtagcttggctgggcaggaggactgaaagattacaggcagaggtcataccagcccggtggaggaggcgaggtccatgactggggctgatgatgagaaagaaccatgttttcacctgtacctttgagtgtgatgccagcactagcgaggcgagcgagctgctctgacctctggccgccaggctgggacagggaagcctctgagacccgaggctgctgcacccagggcctcatgtcccagaagctctcacagcattctcaggggcttagcttgtcttgtgtgttggagctttgggctgagcctgtttcagtatgccagccaggtcactgtgccgctgccctctggtttgcagagggcctttgtgcctatgcagtgactccacagactgtcttgcagctttcctttccactgaagcagtcacttcccctgctgccggggcccctgtcttatggatttgcagtgctcgtggttggattgtgacctctttcctggtattctctcccctattctcacatccctaacaggatctggggatagatggtggatttttaagtccagtccttcaactctgggccgcaaagactgtggcctgaagttctggagcatatctcctctttcctttggtatgcatgggtgggacttgcaggcaccctagcttagccccttgccatcagcccctgctggggtctagcaggcctgagccttttccagggtggccagcctgctggagcttacagtgggggagggtaggacccagaccagagtccctcgccatggtccagccttgatgttgacatccaagagttgggagagggggagggaatgccctgccctccctgccactttgtgcgactcgcccgggttgggccctttaggagagcatttgtgtccctgccctggagtctcctcttcctgctgtgtgcccttgctcggggttgttccaggaagcctctggtgtggggggctctgttgccaccagctgatttcctgccccaggtgcgtgggtgggggaggagagggttgaagattacctggagaaatcgcccgctttgcttccgtttcacccctcttctagggaggacagcagagtgcacagaggttctcttctaatcctctcacccccaacctggtcctccacaaccaggctagagcgtatctatgtatctggggaagccagggcttggggaggagtggactgacccgtgttctgtgaaggtcaaggagggcccacttcgatgaggatgagtttggcagggagcgtggtcctgctcgccgagcggggctgtaagtggaggactgcacctgccttttcctccttgaagccccagctctggcctcagcagtagtgccctgctggtggttagtattcctgtcaccagctccgcctccttacagagggaaaagcctccagttgggaccctgggatgccagtctctgaggtcagctgcccctgatacctttggaagggacagccctcctggaggaaggatagctgtcaaagccaaggagccctgactttgtggtaggctggagggcttgcaggaagtcctcaaaacagaggagccccattgctgtgctccttgacagagcaggaagctggcctgattgtttccagagaggacccaccaggccgtaggaaaaagggcttggctaaggggtcagtgagggctcttcccagtctggctgccactgcctggtgtcgatcaataactgtgcagaacacacgcatcttgtgtttttctcttgtgattcaaagcattctccagacatgcagacgagtacagaaggaaaaagaggaccctgacagctcctcagtggctccttattatacatctacggtgtgaccaagatcagaatcataagcagtgatgagcagccaagctacctggcattctgaatcctatctttaaaagaaatcagagcggactgtcagcaccttagtcccttcaccccgggaggtagtgtggtccagtttaatggccccctggaggcagtcagagggcagcgttgggagatgaacttctaacattccccccgcccccccagccacgccatgccaccccatacactccagaccctctctggcttcccctggtccaccgtttattcatcccacttcccacttcctccagaagtctcccctggagacttgggttcatccccctctctcctaccttcagggtctgcaactcatcttctgcctctattaatgtctgaggcttttggccttgcagagaaactccttattataatagctttgtattctagaatcttgctcctggcttgtggctgtctggcctccagcctcagggagctgtttagagccagctcaggtcaggcctctgctctgcagggtgtgctaaagtgggggctggggaaggggttacggccgtgtcccataggatggacgcgcaccgtcctctgctgggtctaggggcaaggatcaaccaaggtagggctggccctgaaaccgcaaccttcctggaggccggtgcctgctgggagtggggccccagggaggagagttcctgtgggaagtgggggctgggaaggtggggtggggctggggcgctgtggagccagagtcagtgctgtgtgggaggggtttgtgccttccttgtgatgccatggggctcctgcagagctgtgaccctcaatctgcccaacccatgaccatagccatggaggtagagctttatgtgtgcctttatataatcctcatggaaccccttcgagatgggtgctattcccattgcacagatcaggaccatgagagaagttacatggtcaatagctgacaagtggcaaacccacaatgtgaatccaagtttttctacgcactttgttcatctggagatgctttgagccgaggtgaacgggtgagtgatctggaaagccccagctgggaggactgcagcttgcggtgcttaggggagtgagctgcaggagttccaggtcagcagccgtgccaggtgtttgttgctgggcccttaagagtagcacactcccactgtccctgccgtcgtccaggcacctgcttcagctttacacgcacacccctttcccacaggctcagatttgctcaatttggtttgtacctgaggtctcatgtttctgggtggtccaagagaagttagagaaagctctcacttctagaatgtcagagatggaaaagtgggggcagaatataattatcactttcatatgcatacttatataattcataataatggtttcaaagcattttttataaccatcatttcttttgatttttatagccctgggcttatgtagagagatgatactcagttgggcaaacatttattgatgcctcctatatgcaggacagtgctaggcgctacagtggtacagagatgaggaattaaatagcattgtctctgtaccctgagagttcttagggttcttttaagtgagagacacatacatgtctttttagtttcagtgtagaatcttaataaatgtgggccagttctggcttgggatccaaattagtttgtaaaccttagagaatagggtctgataagagatgaggctggggaggcctggtttgggcatctctgaatgctatttatgttaagatcttgacctcgctgcatgaataagggcaccccatctcatgcttttgaaatacattagcagctgaaagaaataggtaaaactggaaatcacagtggtggtcagcagtaaccaacactgcgatcatccgggaggaagagagtggaggtaggattgcttccttttgattgttaaagaatcttggaagctgggctcggtggctcactcctgtaatcacagcactttgggaggccgaggtgggtggatcacttgaagtcaggaattgaagaccagcctaggcaacatggtgaaaccccatctctactaaaaatacaaaaattagctgggcgtggtggcgcgtgcctgtagtcccagctactcaggaggctgaggcaggagaatcgcttgaacccgggaggcggaggttgcggtgagccaagatcccaagattgtgccactgcactccaggctgggtgactgagactctgtttcagaaaagaaaaaaaaaaaaaaaaaaaagaatcttggaagctgggcacggtggatcaacgcctgtaatcctagcactttgggaggccgaggtgggtagatcacttgaagtcaggaatttgagaccagcctagccaacatggtgaaaccccatctctactaaaaatagaaaagttagccaggtgtggtggcacactccggtagtcccagctactcaggaggctgaggcaggagaatcgcttgaacccgggagatggagagagagagaaacaccctggggttgtttgtccgttaactttacgaatatcttctcctgactggcttgcaatatattatcttgtgaaaataggaatttacaagagggtgtatccctcttaggtttatccgtttcttgtgaccttccccgtgccgcccggagggctgtaatctagtaagtttgatgacttgctgtggtgcctagataagggttcaggaatgcagctgcagagtattcacggtaagggtcagctgcattgtggcgggggggtggtcctggggcagctcatccctaacagtcaggagtttgagaccagcctgaccaacatggcgaaagcccatctctgctaataatagaaaaattggctgggcgtgatggctcatgcctgtaatcccagcactttgggaggccgaggcaggtggatcacgaggtaaggagatcgagaccatcctggctaacacggtgaaaccccgtctctactaaaaaatacaaaaagttagccaggtttggtggcggacgcctgtagtcccagatactcgggaggctgacgcaggagaatggcatgaacccgggaggtggagcttgcagtgagccgagatcgtgccactgcactccagcctgggtgacagagtgagactccgtctcaaaaaaataaataaataataaataaataaataaataaataataatagaaaaattatctgggcgtggtggcaggcgcctgtagtcccagctacttgggaggctgagtcaggagtatcacttgaacccaggaggcggaggttgcagtgagctgagatcacactaccgcactacagcctggatgacagagtgagactctatctcaaaaataaacaaacagaatcttggcctggaaatgaaaagtaacctgcttggctgcttggtaacagtctagactagaatttggctcctgaatcaattgttccgattttcagtggaacttcaggctgggcctgtgctggcagactggggacttgaagagagtcagatgggccttccatcaggggtgtttgtatggccagtgtgcagttttcactagtcaggtgaaagactgaaatgggcaaatggtgtggaagagactgaaggcccgtgttacctgggtcagtgaaggcctgcccaggccacatctgaaagatcccgtttgcatgtctgcacgccctgccctatccctctgtggactggaatgaaggtggcagtgggaatgggagagcagtttcaattgggcctttcttcagttgaccccagggtatctcagtctcctgccctcattgtgttggctagagttctatgaatcttgttagagatggtttgatacctgttcccaagagattagtattggcagggatgcccagtttcctggtatgaatagttaaatccaattcatccagtcaggatggcactgtaaatttatactctaaacacatagcagtaatacataaaaagataaaattctaaaaatatattcatgtacgcctccacttttctaccccccaccacactcaacatgataaatatccctgtggatgagaaatagacaagaacacaaggaagaaagccaggctgaagctgcaggcctgctggtctctgagtctggaagcagaaatttgggataacagagccataaagtgttccatttggagcatggaattgagctaggaaattgcttgaatccacagctggacagtagcctgagaaaagttgttaccatttcctggggctaaagcttttatttatttatttatttatttatttatttatttatttattattttcttttttgagatggagtttcgcttttgttgcccaggctggagtgcaatggcatgatctctactcactgcaacctccgcttcctgggctcaagcaattctcctgcctcagcctccggagtagctgggatcacaggcatgcgcaaccacgcctggctaattttttttttttttttttttttttttgtatttttgatagagacgggtttctccatgttggtcaggctggtctcgaactcctgacctcaggtgatctggctgcttcggcctcccaaagtgctgggattataggcgcgagccaccgcgcccggccagctttttattttttatagagacagagtctcactctgttgcccaggctggtgtgcagtggcatgatcatggctcaatgcagccttgacttccctggttcaaatgatcctgccccctcagcttcccgagtagctagggctgtaggcacttgccaccatgcccagctaactttttttttttttttgagacagagtttcactcttgttgcccaggctggagtgcagtggcccgatcttagctcactgcaacctccgccttccaggttcaagtgagtctcctgtctcagcctcccgagtagctaggattacaggcatccgccaccatgcccggcttattttttgtattattagtagatacggggtttcaccatgttggccaggctggtcgtgaactcctgacctcagctgatccacctgcctccgcctcccaaagtactgggattacaggtgtgtgccaccgtgcccagcctcaagccaacctttcgccttagcgtcttgactttctgggaccacaggcatgcgctaccacgcttaatttttttattttttattatagagacgcggttttgccatgttgcctaagctggtctcgaactcctgagctcaagtgatccgcctgcttaggcctccaaaaatgctgggattacaggtatgagccaccatgcccagcctagaaataatatttaaagagataatggcttgaaatttcagattcgaaaaaacagcatgaacatcaaacaggataaataatatgtcactagatataatacagccaaactgcagataataatataactttattttgctttttgaggccaggttgggcggcagtggcgtaatcacggttcactgtggccttgacctgccaggctcaggtgatcctcccacctcagcctcctgagtagctgggcctacagaaacatgccaccacgcccggctaatttttgtattttttgtagagatagggtgttgtcgtgttgcccaggttggtctcaaactcctgggctcaagcaacctgcccaccgtggtctcccaaagtgctgggattacaggcatgagctgccatacctgaccagaccaagagagttaaaaactactggaggtaagaaagaattcaaagaattgacaattagatcacaaataatatcttatcaacattggatgccagaaaacaacagaagaatgtcttagagaagctccttgtcaacctggaattccatagccagctatcattcaagaatgaggtaaaataaaggtatttttggacaggctaagacagttttatcacctacagacctttgctgaaagaatggttacagatgtacttcagtaagaagaaaagtaaacccctgaagaaagagcaggttgttggtgccaacagtgagcacagaagtggatgcattatgttggtaaattgaattaactatttttttttttttttgagacggagtttcgctcttgttgcccaggctggagtgcaatggggtgatctcggctcaccgcaacctctgcctcccgggttcaagcgattctcccacctcaccctcctgagtagctgggattacagacatccgccaccacacccagctaattttgtattttcagtagagacggggtttctccatgttggtcaggctgctctcgaactcccaacctcaggtgatccgcctgcctcagcctcctgaagtgctgggattacaggtgtgagccaccgtgcctggcctgaattaactattaacaatatattaggatgcaagtagcagagtaacccacaatgacttaaactggaaaacactggattagtttataacaagaagtgtggaggtcagtagttccagggttggggcagtaggtcacataggaacatgaaggaccctcgatctttctactctgccatacgagggtgcaagatgtctctcatggtcgtgagatggctgccatagctccagacattatatcatcaccctgtaacatcccaggcaggaaggcacagagatcctaggagaaaggaagctttttcttcatgtgctgctgctgctttttttttttttattttttattgcaatcactgtcatccaggctggaaggtgtgatctccgctccgcccacttcaacttccacctcgtgggttcaagtgattcttgtgccttagcctcctgagtagctggaaatacaagcacttgaccccacgcccagctaatttttgtatttttagtagagatggggtttcaccatgttgcccaggctggtctcgaactcctgacctcaggtgatctgcctgcctcagtctcccaaagcgctgggattacagttgtgagccactgcgcccggctgcttatttggaaaggaaaatctttccaagatggccctaacacatactcccttgggtctcattgacctgagctggtccatcctcaaaccaattcctggtgaaaaagggacaggcttgctgtggttggcgctggttggctttggccagtcttgcatcatctgccaggactgggtccttagctgcccaaacaaatcaggattctgttggcaagcgaaaaagagagtggccgctggtagacagccaacagtgtctgctacagacggcaaaacacagagacaaaaaaaaaaaaaaaaaacaggatctaaatgggcttttaatttttttttttaagagaaaactagaattgttgaccacattaccaaggaagaataagaatagagaattttattgttaagccacaccaaatttctgccttgttaagagaatggcattactgaaaaactgaagacttcatcaagaaaatgtacataagctaacaatataagattaatcactaaaaaaaaagtaatataatttccagaccaggagggggaaaaaaagtggtgagggttggccgggcgtgttggctctcgcctgtaatcccagcactttgggaggccgacgcaggcagatcacgaggtcaggagatcaagaccatcctggctaacatggtgaagccctgtctctactaaaaatacaaaaaaaaattagccgggcatggtggtgggcacctgtggtcccagctacgggggaggctgaggcaggagaatggcataaacctgggaggcagagcttgcagtgagccgagatcaagccactgcactccagcctgggtgacagggtgagactccgtctcaaaaaaaaaaaaaaaaaaaaaaaaaaaaggtgagggtggagataatatgtcaacccaagtcaggaaaagaaaaaaaaatacagaaaaaatagtagacaaaatactgaataagatagtaacataactccaagtgaaatggattaaactcatctatttgaaaacaacaacagcatcaggtgaaataaaaagcaaagaagtctgaggactgagcaaggtggctcatatctgcaatctcagctctttgggaggccacgttgggaggatcatttgagaacaggagttggagatcagcctgggcaacatagcaagacatcatctctacaacaacaaaaaaaacaacaaaagtagtgcacacctgtagtcccagctacttgggaggctgaggcaggagtctgagagttcaagtccagcctggggaacatagcaagaccctgtctttatgaaaaaaaaaaaaaaaaaaaaaatttagccaggtctggtggcgtatgcctatggtcctagctactcgggggcctgaggtaggatcatttgagcccaggtggtcgagtctacagtcaactgtgattgcgccaccggcattccagtctgggcagcagagtgagatcctgtctcaaaaagggggaaaaagcctgggcgcagtggctgacacctgtaatcccaacactttgggaggcggaggtgggcggaacacctgaggctgggagttcgagaccagcctggccaacacggttaaaccccatctcgactaaaaatacaaaattagccaggcatggtggcgcatgcctgtaatcccagctactcaggagaccgaggcaggaaaattgcttgaacctgggaagtggaggttgcggtgagccaagatcacgccattgtactccagtctgggcaataagagcaaaactccgtctcaaaaaaaaaaagccgccagaggcgggaagctagctagaatgtggagagacctggtcttccccacacaggtggtttgaacttttttcataaaatagagatgaggtctcactctgttgcccaggctccaacccctggactgaagcgatcatccagcctcagtctcccaaagtgctgggattataggtgtgagccaccacaaccagccgagaactgtttttctagacgttacttcatgccttagtgtagataggtacagcaagatactggatttccccctgcccactccgactcaaaacacagtggggctccctcctgaggtagcaggtggtggatctgaagggacccttcaccccaactcccctgccgcaccctctccccgtgcctcagggcccagcttcctcctcttagaggccgtttctttattttttctttcttttttttttttttttttttttttttttttttttttgtttctttgagctgtctcctacaggaagaggctgttagggtgcagcctcgatctttgtccagagaagactgacagtttatttctctaggacttcattgaaagccaaagttatgctcttggtttgaagaagtgtgttagctcttgccttctgggtttctggctacaaactctgggcggcatcaagaggtaccagagctgagatttcagatggatataaagtcaaagttggatgtcctgcaggaagggaggggctgcccgagggtttggtgctgcggagtggaaagggcctgagtccctagggtagcactgaggggtctgtgccagaggctgataccagggtgttgcagtgcgggtgacttcagttaaccaagcagggtggtgaagcggcccattctcagacaggtcaaggacaggcctcgctgcttttgagttgttggggagggaggggctttcggtaactggccacctgcgcccacccccacccctccgccccagctccttctgcctggtttgggtgctgccccccacccaggaggcagggagtgttctgggttgctaggctggcagggatctggggcacagcgaatgttttgatggttgtaccccagttagtggaagagtgctttgggaaggcagtgggggctgtggaaggagctctgggcttgaagtcatcagacctggcatggcgttaaagcatcttcacttccgcctggctgaccttgttcagctggtcctgggactcctgcgcatactaaatgagaggctatcccccgaaaatgctcagaggttcataaagcatcggtccattggagcagtaggctgtggcttcatgcctttagaatgagctttgggacacgtcctcaggctgtgtgtaagtgggtggagaggggctttatctttcgtctttctcctctccctcccagaggcaagcagcacccatccccccaggctccgtgccttattttgacgtttcttttctctgcatgccaagaaggttgtattcagctgtgctggtctgaggtggtgcttatcctgtgcttcattaggttaagtcgttgatggctgtctcctgggatctgaccgagaattggctctaaagctgctacagcctccaaaacagtccctgctgttctcgttttggggcactctttgctttgctcctcaatcaggtgcttttgttttttccttccatttacctgcgtgctggtgagggtctcctttgaggttccttgtactgggaggtggaagtagcccttcggctgcatctcctgaggatggaaggcggggtcttcaaggcccttgctgcccctgacctctggatcctggctgccagttcctctggacagcctcagcaacttggacatggaccagccattcaggggacatttattgataaatggtctccccaaatttgccaaatttgtgaccacaaacttcttagaagactgtagtattggcacagtggctcacacctgtaattccagcacctggggaggccgaggcaggcggatcacttgaggtcaggagtttgagaccagcctagccaacatggcgaaacctcatctctgttgaaaatacaaaaattagctgggcgtggtggcacgggcctatagtgccagctgcttgggaggctggggcaggagaattgcttgaacccaggaggtggaggttgcagtgagccaatattgcgccactgcactccagcctgggcaaccgagtgagactccataaaaaaaaaaaaaaaggccatagtgttgtcttgccacctcctaaatttccctagttactccctttctcttttagaagactatttcacatctggtctctctgtaaatctccaaccccaacaataaagggacactcctcactgtctgtgccgcttgctcggctttgccacctgtcccacaggtagcccccctccaggacgacactcgatgccatcatctcgtgctgctcccggcctttgttcctctgttcacttctttttcctggatcataaatttcccctctaataattcattcccatcagtgtacacacattctagaccatctctcagctgaatcccattccacattccactctcttacatcccattccttttttttttttgagacagagtctcactctgtcacccaggctggagtgcggtggcacgatcttggctcaccgcaacctccacctcccaggttcaagcgagtctcctgcctcagcctccgaagtagcgggattacaggcgcatgccaccacacccagctaatttttgtatttttagtagagatggggttttgccatgttggccaagctggtctcaaactcctaacctcaggagatccgccaccctcggcatcccaaagtgctgggatcacagctgtgagccactgtgcctggccccccactccagcccaggctggagtgcagtggcataatctcggctcattgcaacctccacctcctgggttcaagcatttctcctgcctcagcctccctagtagctgggactacaggtgcctctgccaccaccccccggctaatttttgttatttttagtagagatggggtttcaccatgttggccctgccaccacccacagctaagttttgttatttttagtagagatggggtttcaccatgttggccaggccgatcttgaactcctgaccccaggtgatctgcccacctcggcctgccagagtgctgggattacaggggtgagccaccacgcccagcaccattctctctttttgttgtaacacctttattgagctataattcacacaccatgcagttcatctctttgaaacatacaagtcagtggctttttttttttttgagacggagtcctgctctgttgcccaggccggagtgcagtggcatgatctcggctcactgcaagctctgcctcccgggttcacgccattctcctgcctcagcctcctgagtagctgggaccacaggcgcccgccaccatgcctggctaatttttttgtgtttttagtagagacggggtttcaccatgttagccaggatggtcttgatctcctgacctcgtgatccacctgcctcggcctcccaaagtgctgggattacaggcgtgagccaccgcgcctggctgtcagtggcttttaacctattcaccacaaacaattttggaacatcaccccagaagaaaactccaacccactggcagtcattccccattcttctctatcctccagcccctggcaactggtaatctactgtctgtctctatggatttgcctattctgtacattttacataaatcatctggcatggggccttttgtgccttattcctttttttccttttttttttttttttttttttttttaagacggagtctcactgtgtcacccaggctggagtgcagtggcgcaatctcggctcactgcaagctccgcctcccgggttcatgccattctcctgcctcagccttccgagtatctggtactacaggctcccgccaccatgcccggctaattttttgtgtttttagtagagatggggtttcaccatgttaaccaggatggtctcgatctcctgacctcgtgatccgtctgcctcggcctcccaaagtgctgggattacaggcgtgagccaccgcaccaggctgtgcctggctcctttcacttagcacagggttttcaagttcatccatgctgtagcagtgccagaacttgattcctttttatatctgaataatactcccttgtatggatataccacattttgtttatttatgtattggttgatggaactttgagttgtttccatgttggcactcttatgaataatgctgctataaatcatttgtgtatgaggtgttttttttttttttttgagatggagtctcactctgtcgccaggctggagtgcagtggtgcgatctcggctcactgcaacctctgcctcccaagttcaagcgattctcctgcctcagcctcctgagtagctgggactacaggcgcacgccagccatgcccagctaatttttgtatttttaacagagatggggtttcaccaagttggccagatggtcttgatctcttgacctcgtgatctgcccatcttggcctcccaaagtgctgggattacaggtgtgagccaccgtgcccggccatgtgtacaagtttttatgtgaacctaagttttcatttctcttgagtatatacctagaagtggaattgctgagtcatatattatggtgactgtatatttaatcttttgaggaactgccagactgttgcccaaagcgactgcaccatttcacattcccaatagcaaagtctgagggttccaatgtctctgcgtcctcactaacactggttattatctgtcttgttggttacagccaccctgatgggcaggaagtggtatctgattgtggttttgatttgcatttccctgatgattaatgacgttgagcatcttttcctgtgcttgagcctcgcaatacccctggatcagtcattgtgaaggtcaccactgccctccatccagtggtcagttctcagtcctcgccttactttttcaaacacttgacactgttaattcctccttcattctcgaaactttcttctcttggcttcccagatgcagggctgtttttccccctgcctcattggctgtttctttcctggcttctctttcagacagcagagtaccccaggctttgtcctgagccgcctactcttgtctgtggtagaccctccctagatcttttcttctggtcctgtagttttaagaatgaactgtactctgatgactctcagatatatccctctaactctgacctcacccatgagcttcaaacaggtgtgttcaactgcctgtttccaactgcatgtggatgtctaaaaaactttcttttttttttcgagttgtggtatcactctgtcacccatcctggagtgccatggcatgatcacggctcactgcaaccttgaactcctgggctcaagtgatccttatgcctaagcctcctgagtaggtaggactgactacaggcacctgccaccatgcccagctaatgtttttacttttttgtttgtttgtttgcttgagacagtgtctcactctgtcaccaggctggagtgctgtggtgcaatctcagctcacacaacctctgactccctggttcaagcaattctcctgcctcagcctcccgagtagctgggattacaggcacccaccaccacgcccagctaatattttgtatttttagtagagatggggtttcgccatgttggccaggaaggtctcaatctcccgacctcatgatccgcccgcctcggcctcccaaagtgttgggattacaggcatgagccttcatgcccaacgtttttacttttttgtggagatggggtcttgctgtgttgcccaggctggtctcaaactcctgacctcaagtgatcctcccgccttggcctcccaaaatgttgggattacagacatgagccaccacagctggcctaaaagacatcttaaatttaaccagaacttttgttttttctcagccaaacccattaattttctgtcttttctgtatagtgaatgacagccccatccacaaggttgctcaggccacagcctccatatctccctgattcctgtcttcctcttcccaccctgctcccctcttcccttccccatgggccccctccttgtaccctccaactaccctactagttaagcccttcagagtacatccagccatttctcaccacctccaccacctgggatattgcaacagttcctttctggtctccctgctagtcttacgcaacagccagagtagtgctttaataaaacatgttttaacctaaaagcattttagattttactacgaaatgcatcatagactcaaagtagtatatatcgtatttgtgctctttacagaataaacataagaaatactccatggctaggcgcagtggctcatgcctgtaatcccagcactttgggaggctgaggcgggtggatcacctgaggtcaggagttaaagaccagcctggccaacatggtgaaaccccatctctactaaaaatacaaaaaattagctgggtgtggtggcacatgcctgtaatcccagctactcaggaggctgagacaggagaatcgtttgaacccaggaggcggaggctgcagtgagccaagatcacgccactgcactccagcctggtgacagagcaagactccgtctcaaaagaaaaaaaaatacttctgtacccaccacctggattacaaggtacccagtactcctgaagcctcttcagccctccttatttcatctacctctcttccccctccagaggaattccctgaattttgtgttgtttccttgattttctctattattatctttatagagaggcatagaaaatgtcttgcttagctttgcgtattttttagcttttcatggattcatgctgtgatcatttatccatgactactctttttgctcgatataatgttttttggccatattcatccctgttaatgtctgaaaccggagttcattcattttactatatggtacaaaatgcaccacaatttatccattctttttttttttttttttttttttttgagaaatagtttcgctcttgttgcccaggctagagtgcattggcacgatctcccactcctgggttcaagcgattctcctgcctcagcctcccaagtaggtgggattacaggcatgtgccaccatgcccggctaattttgtatttttagtagagatggggtttcttcacgttggtcaggctggtctcgaactcccaacctcaggtgatccacccgcctcggcctccgaaagtgctgggattacaggtgtaagccaccatgcctggtctttttttttttttttttttttttgaggcagagttttgctcttgtcgcccaggctggagtacaatggcgtgatcttggcgcactgcaacctccgcctcctgggttcaagtgattctcctgcctaagcctcctgcatagctggaattataggtggccaccacaacgcctggctgattttttgtatttttagtagagatggggtttcaccatgttggccaggctggtcttgaaatcctgacctcaggtgatacacccacctcaggctcccaaagtggtgggattataggcatgagccattgggcctgcctcctccgagctctttatattgaggtgtgcatgggcttaacaaaatgatctgagtagctgtgaaggggagcaagcccatgacgtggtgggcagctgaggggcacaggtagaaatgaactgtgagagggtcattgccaggtcatttttgggatttttagtgcatgtttgggggcctttgattttttttttagctcctccccatggctccatttgccctcaccacaacaagctgagcatcctgtatttgcagtaacacctggacctggggttcccaaagcaagggcctttgccagatgctctacttctctgctctttcctctacttctctgctctttccagacatgtcaaaaccagggattttcccctccctaacaggcagtgcagttccttcgcgtgccccctgcgttgatctagaatcccaaggagttaatgacttccctgattgagttgcttcctttggaagcctcctgtgccagctctgcccagcccccgccttcagtggccactgcggggctgcccagccagaaaccaggtctccccaggcaggacctctcgctcccatcagctgcaaagtcactgtcttccagggccacctgcctcatgactggctctcctcaggtcacaggaagctgggagcgggaccctgaaagaactcgagttctgtccttagatgttgggcatgcagcaggcaaagggagaatgagaggagacaaggacctggcttcccatctacagactgttcagccaaggccatgcctagagtgggatctgctaaatgggcacagcagaacattggaagaagcacctttgagccagtgctgctggggtctccgtggattagagccaggagccctgatgaggcctgtgggcggggcttcactttcgaccctgagaagccaactccacatctccttccctctcacccttgagccgtgggtagttcagggaggccacagccttctttctgtgccatggcctatcccaaagtcacctccactcacaacgtcgtgaccttaggtaagttcttgtacttttgtgaacatcatttctcacccagaataatgtccttactgcaatatgctcgttccattccctgctggctttgtggccacaaatggaggggcagctacgtttcttgaacacagagcctgagaggccttgtatgcagctgctggaagcagccaggagaccccaaaagtgggctggagacttcaacaaggacagggaacagggctgcactgagaggcccaggggctaggtcagcagcaccgctaggcagatttggaggggagctggggagaggcgaggcagccagctttgcaagattcccacggcacacagccagtgctcaggggttcccttctcagcgttcctctcacctggtgtggctccctcacgcttggcatggatctgagctcctttccttatggctgagacccaaactgcctacaagtggccttttctccctgttcttgcctgcaagggcagcatggggcctcaggctgtcagtgctaccagggacgctggcattcactttgtccataatgtacagatggatgtagacaactgccctcagggctgtccgggggcaggaccaagcccagcaaccacacctcctgacacagccaggttctcccccaacggcggagctgacaggactgttcatggttcattgagtggacccagcaatacctcatcgataatccacagtcgagagaagaggggcggtcagagaccggccagccctcccttctgattgggagaggcctctgcaggcactgacaggctccagagagtgctgtggggggcagtcagtgtccatagtcccctggaatcttctctgggctgttttctctgacttttcacctgaaattaactgtacatagctgggctaggaactctctaaatctgaaagcatgtggcttagggaaaatcacttgactcgtttaccttctggctaagaagtgaagactctgggctaatctagtcctccaggccctggagtcccacacagtgatgctatctgtgcagctagagggcagagcccttggtcatgtccaccctctgattaagtgggcatctcctctcctgctagctttggggcttggggtggggctgggacaaagcctggtgcccgtgtgattcatccgcacattatttctcctctctgccattctagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatggtaagagctgctgctcccttccagggatctgtcccccagttttagagccactcagagccccctcttggatttctggcccccagagccttgacaaaatgcctgtttgaccaagccatttataggatcacagattactgaagggcagagcaagcactgacctgatggagggggctagtattttctagtgcctgtaggacccgagcataggccagaaatgcctcctggaccaggcaggcagcagggacacagggagcaggtggcagtgaggagtacagccatggggggcctgccccagaggaaggaggcagccgcccctcggccccagcagttgttgctgcacaaggctggatctgggttttttgttttttttttaagaaaacctagaaatccagattttaaaactaaatatcctaatttatgaacattggctcaaaataattgttttttatttgtttgtttgttttttgagatggagtctcattctgtcgcccaggctggagtgcagtggcacagtgatggctcactgtaacttctgcctcccaggttcaagtgattctcctgcctcagcctcccaagtagctggaattataggcatgcaccacccctctcagctaatttttttgtatttttagtacagacggggtttcaccatgttggccaggctgatctcaaactcctgacctcagatgatctgcccgcctcagcttcccaaagtgctgggattacaggcgtgagccaccatgcccagccaaaataattgtaaataccatgagaacagagcccctttcttggttctttacaactgctagaagactttttactgggctgggataagaaagccttgtgggaaggccggtcatggtggctcacgcctgtaatctcagcactttgagagcacagggcggacggatcatgaggtcaggagttcgagaccagcctgaccaacgtggtgaaaccccgtctctactaaaaatgaaaaaaaattagccaggcatggtggtgcgtgcctgtaatcccaactactcaggaggctgaggcaggagaatcgcttgaacctgggaggcggaggttgcagtgagccgagattgcaccattgcactccagctgggcaacaaagtgagactccgtctcaaaaaaaaaaaaaaaaagaaagaaaagaaagccgtgcagggactacttaatctattttatgaaataatgtgttgtctgattctagagttaaaaaaaaacaagcaatgaaaagaaccctcaggggctaagggaggtgaaggggtggggctgggggggtcctccctgtctttccagtcatcacttttctgctacttttaattccttctaccttgccccaaggctctggagtgtcactccccaggctctgcaggccatctggttgccacacatgtcatgggtggagccatgtcagcactgagtccctgcaggctcccaagctgcaagggatgagctcatgtgatcaggcttatcagaatgatgtcacagaacctgccttccagcctagactgtcaagagtgcccgaggaccagggtctgcagagctggggccactaggagccccgtgggctcttactgtgacagcttttttttgatacaggttctcactgtctttgcagtggcacagtcttggctcactgcatccttgatccccaaggctcgagcgatcctcccacctcagcttcagagtagctgggactacaggcacgtgccaccacgcctggctaatttttatataggaattctcatcttggagccaagctccctctacagatcaatctcccatcccctgagcaggccctgctcacccacaaacccatcaagttatggctccatccacataatgttttattttatttttatgtgggtttttttttttttttttgagtaaaaataattccagcactttgagtaaaagtaatttacttttgagtaaaagtaatcccaccaccttgggaggccaaggcggtagatcacctgaggttgggagttcgagaccagcctgaccaacatgaagaaaccccatatctactaaaaatacaaaattagtagggtatggtgaagcatgcctgtaattgcagctactcgggaggctgaggcaggagaatcccttgaacccgggaggcggaggttgcggtgagccaagatcgcgccattgcactccagcctgggcgacaagagtgaaactctatctcaaaaaaaaaaaaaaaagagtatttcatttttcttgtttcatatgaaatccttattttcagtgtgtcttgaaaaatgggaaactttggcccttctgggctcatgatcccacgtggcagcaattggctgaagttgcctctctttgccggggctcagatctgttggctgtggaccttacctgccatgtcactcctgtgtggcacttgctgggcctgtaagcatctggttggtgctgcctcgtttcatggtctttgaccattagttggttggtacaggtctcgctggtaggaggggacaccagttttattccagccattctggctctgaaagaatttatcagcctctctgcccttccctggggctcagggagtggctggactgtcaccctggacgtggcttctgcaaccccagtcctcagcctgagtgccaggggcgccccctgtaggctgaccaggaaggatcccctgaaggaggctgctctgctccgtggcccaggcctgcaggttcccagagaatgtgtgaaaggcaccttgatccctgagccccttctagtgcatcagagctaactgtgactagcagggcacccaatctctggacattgagactcactcacaaccggggactttgctgttgttgagagagggagagaccctcactgcccagaggaaagaacccctgttccctggcagagccctggataaagaggcctgtgcccagacacaggatagtgagggcagaggaggggaggccggggcccctccttcttcacacacctctccccttcctcgtttcccatcttcccctcccttccacagatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggtgagcccctgtggagcccaagggtgggctcaggatgggcctccgggaaggggactgccctcctctgccttgtctggcagggtgcatgctgccagctaccggtgtgctgtggggccctgcctcccagagtctttcacagcaggcttggagctctctcctttacctgtttggggtggatggggagacagaatcccaaatctaagctttgcttgaggcctgcactctgtttccaaggctctgaattcctctggaaagagctgacattagattcctggctgattgtttggtgaaaaatcccatcagaggcagggcatggtggttcacacctgtaattccagcgctttgagaggctgaggtgggaggatcgcttgagcccaggagttagagaccagcctaggtaacatggcgaaaccctgtgtctacaaaaaatttttaaagattagctgggcattgtggcgtgtctgtatttccagctactggggtggctgaggcaggaggattgcttgaacccaggagtttgaggctacagtgagctatgattgcaccagttcactccagcctgggcaatagactgagaccctgtctcaaaaacaaaaattcccatcagaagccggccctgtcctcctcatcccctcagcagctgggcaaggagtgagggccccaagcccagctagcatcctgcttcatagcagcaggtgattctcgctggcagatgcatagaaggcagatgttgtgggtgctgaaaggagctgttcggtatttgctctagggctcattcattcccaagacctctatgcccagccgtgaggaagggagaagagttgggagggcgttcagtcttgaccgagactctgcaatgaaggcctgggcgtgaacagggaatagggggcaggctcacgacctgaacgtgggctgcttgctctgctccagagcctgcgttttctgacatccccccttgacttggctggggacaagaaatgcctcctacccgactccttggtagaggaagagcctgaagaacagagctcctgccaatgcccagttttcacgcatctcttaggatgagcattgcagttaagaccaggtttcccaggaggcagaaggaagggctttgtcttagaaactgttgctgtctccatagcaacacgaaggcagcaatatgtctcggaggcattcagcattccatgtaagaccttcctcatgttgggaaatggtgcaagtgggagggtgagcaggttggagtggaccctgtccaggaccccggagccacctgagggtatccatatcctccaactgctgataccccaatgggagggagatgggatgggagctggtcttagaggggcctctcccctccccagacaccatggccaggttgggaattgaggcatctgtcacttccatgcagctctgcgcactcgggaagcccaggacaatgctcttaggtgcccaaagcacctgcatcaagtttgagctttcactggtcaggcacctcagtgatggtcaggaagctcctgggtggaagccctgcaggtccaaaaggactgcctctaagtcatctggccggtactgtcaggtggggctgcagaaagaaatttataaggctgcacatgctgtggctcatgcctgtaatcccagcactttaggaggctgaggcaggcagattacctgaggtcgggagttcgagactagcctggacaacattgtgaaaccctgtctctactaaaaatacaaaaattagctgggcgtggtggtgggtaactataatcccagctactcgggaggctgaggttgcctgaacccaggaggcggaggttgcagtgagccaagatcatgccattgcacttcagcctgggcaacaagagagaaactctgtctcaaaaaaaaaaaaaaaatttatagatgcttcctcacaggggccaggtaaggaaggggggtggtatagagtggaccccagaatcactttctggaaggggtgacctgggtagtaattggccgtctgctggtctgaggaactggatggcagtggataagctgggcttgttggtgtgagcctgtagtcctagctaattgggaggctaaggcaggaggatcgtgtgagcccaagagtttgaggctgtggtgagctatgatggcaccactgcactccagcctgggcaacagagcaagaccctatctcaaaaacaaaaacaacagatggcactgggggtgactccaattgtagacatatccaagtttggaaccaatggccctggaagcaagacccactggagggctgagctgagttacagcgagatgatggcctgatccacctgtgccccacccacctcgctgccactcactcctcctatttgtcctctgagccctgtggaccacttcaagtccagttgagctggtcttgcctcagttggccagcagatccatccacaactccaagaacagtgcccgctagacagtaggcacgccgcagatacatgcaggagtgaaggggactaggcagccaacatcaggtcctaaccagggggcacacaccccacttgcgcccctgtccctgaatacttctttagctgctggaggcagccaaggacagatagatttctagaatgctgtgttcccgagtgccagagatgcagctcatcctcctcgtcctgctctggcccctttccagggcgtggcttctccaggatgaatcagagccttgaaacaaaaccttgtccctgttagagtgccatgttccttccctttcccttggaggctgtgaaacatattttgggacctcttgctcccttcattcccagatgtttggaagctggtatctggccaaccatggggaaatgagggagggccaggctctgcagcatggccagccacaggcgctggaggcagggtgaccctggctgacaggtcccatggggacttcatgacagctcaggctgccaagtcagtgcagaagacagatggtgggtcttcagaaaccagcctgggctggctgcagccctgtgctctgcaggatctcttggcctcaccatctctggtgagatgaagtttgtttcttaggtcaagtgtacaccttggctgggcgcagtggctcacgcctgtaatcccactacattgggaggctgaggcgagagaactgattgagcccaggagctcgaaaccagcttgggcaacatggcaaaaccccatctctatttaaaaaaggagaagaaaaagagcataccttgatcctagctcctgccccgcccaggccccggccagcctgtgtcaccagcccaattcctctaccccctgcttacccctgccataccctgggcagctgagacacacttctggctctgacatcccctgttaaggcttcctctccaactgatctgttcctcacaggccccagggtgcttggcaggaggcagatacagactgtgtcagtgtgaccataggacaccaatacctgcatggggagtttagcagcccacaagctattaagagttattcaggggtgggaaggatacttcttggctcttctaggagacaggatctctaaaccctaaagaccgggctcaaaggggcagttcactgaaggacatgaatttgggagagggaggctggaagtagatccctgttctggagacagagcatgttagtttctctggaggaaattctgggcatctgcttgaagccagctagaacggaagtggttaggaacacagaggttctctaggttttgagacctcccaccccaaagcaccctccagaccctcaagggaagggaaaatgagaggtagggggcacagtgatcctggacagcacagcccatggtccttcccagtcccgtccctgaggaagacagcttgggagcccctggaacacagcaagtcctcacccagcccagctagctggtgccagccactctaaggacagggaatgtttgtgctggttttacagaactggcataaaaagcaaggagagccacctagagactgcgctccctgcttccctggctccctgtgttcctagtggagggccaggttacggtcaccctgctttggtagtcatgattccacaaggtgtggtccacgtgagacaggaatgtgcttgtaaacagtcataacagaaaaaaaaagaccaacaggtttgtgtttaaacctggttcacctgttacgtaagatgcatactaaaaaggggagctttggtttttacttgtcttgtattttgcacaaattgaaaggaagtggaagccttcttggcttattatagccacagagaaggtttccagacaggagctacagcaatgtcccctctgtccagacagcagcaggagagaggggacattgcacatcaccagaaagatagcaagggcagaccgtcagaacttggggcatttctcttggccttggagtggaagggcagacagggtcttaaagcggcagacaggaatagggtggtagtgggtggcaggacagaggcttccatccggcccagggcctgagggaaggcttgaacttcctatcttactttcaccatcttataggaaggagggcagaacagccaagtgaagtggaagctgcggaaggctgttctttataagttgtttctttaaaaaattataaaaggccaggcctggtgtcatctgcctgtagttatggctactcaggaggctgaggcaggagggttgcttgagttcaggagattgagaccagcctggacaacgcagtgagacccctatctctacaaaacagaaaacaaaacaggcgtggtgatgcagacctgtggtcccagctactcgggaggctgaagctggaggattgattgaacccaggaggtcgaggctgcagtgagccatgatggtgccactgcactccagcctgggtgacagagtgagacttaaaagacaaacagggccgagcgtggtggctcacgcctgtaatcccagcactttgggagactgaggtgggcggatcacgaggtcaggagatccagactatcctggctaacacggtgaaaccctgtctctactaaaaatgcaaacaattagccgggcgtgatggcgggcgcctgtagtcccagctacttgggaggctgaggcaggagaatggcgtgaacccaggaggcggagcttccagtgagccgagattgtgacactgcactccagcctgggcgacagagcaagactccgtctcaaaaaacaaacaaacaaacaaaaaacccaaacaaacaaaatggctgggctcggtggctcacgcctgtaatcccagcactttgggaggccgaggccggcgcatcacgaggtcagtagatggagaccatcctggctatcagggtgaaaccccgtctctactgaaaatacaaaaaattagctggacgtagcggctaacgcctgtaatcccagctacttgggaggctgaggcaggagaatcccttgaacccaggaggtggaggttgcagtgaggtgagattgcaccactggactccagcctgggcgacagggcgatccgtctcaaccaaaaacttagctgggaatgctggcacatgttgtagtcccgtctactgaggaagctgaggcaggagaatcgcttgaacctgggaggcggaggcggggattgcagtgagccgagatagcaccactgcactccagcctgggtgacagagtgagaccttgtctcaaaactaataataattaaaagtaaataaataaaaatgtatccagtaaaaatgagttaagcccccaatgttagtaacctttttttttttttttttttttttttttttttttttttttgtagagatggggtttcaccgtggtctcgatctcctgacctcgtgatccgcccacctcggcctcccaaagtgctgggattacaggtgtgagccaccgcgcccggccaaccttttttttttttttttttggagacaagagtcttgttctgtcacccaggctggagtgcggtggtgcgatgtcggctcactgcaatctctgcctccaggttcaaacacatcacctgcctcagtctcccaggttgctgggattacaggtacatgccaccacgcccagctaattttatatttgtttttttttttttagtaaagatggggttttgccatgttggctaaggctggtctcgaactcctgacctcaaagcagtccatccaccttggcctcccaaagtgcctggattacatgtgtgagccaccacacctggcctgtttgattgattctggtgttactattgtaaataattctgcagtgaatatcctcatacacatctttgcacacctttgtaaccatttttatagggcagatttctagcaatggaattgctaggttggagtatacacccgtttgcatttttgatggatggcttcgaactgtcctctaagaatcttgtatcagtttccatggcagttgattctcatgtcaccctcttgtccctgcaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattgtgagcttcttgctggcctgggtagaatatgggtgacaggaccatcttgggcagagtcttctaggggccagattgtaggattcctttcattgaacattttggccaagaggggctggtgagaagggagggcctaagttggtgggtgagctgaaggcacagcttgctctgtgtcacctcctgtgtggtgacacagcatattgatggtggaaagatgaggaaggatctgtttttttgtttgtttttttttttttttggagacagaatttcgctcttgttgcccaggccggggtgcaatggcgcgatcttggctcactgcaacatccgcctcccgggttcaagcgattctcttgcctcagcctcctgagtagctgggattatagggatgcaccaccacgcccggctaattttgtattttagtagagacaggtttcttcatgttggtcaggctgatctggaactcctgacctcagatgatccagctacctcgggctcccaaagtgctgggattataggtgtgagccaccgcacccggccagaccatctggttttggtctcctttctgggtgatggctcctgactgagggagctctgccttctgaggactttctttgggggtagttgtcccatcatagccgggaaccatgggaaatctagttcaccaagtatattttttaacagctttatcaagatatgattcatatcccatacatctcacctatttaatgtgtataatccagtaacttcttatatattcagagttgtataaccatgactacaattaattttaattttttttaattttatttttttttgagatggagtctcactctcttacccaggttggagtgcagtggcgcaatcttggctcactgaaacctctacctcccgagtttaagagattctcgtgcctcagcctcccgagtagctgggattacaggcacatgtcaccatgcctggctaatttttgtatttttagtagagacggtgttttgccatgctggccaggctggtctcaaactcctgacatcaagtgatccacctgcctcaggctcccatcgtgttgagattacaggcatgagccaccacatccggcccacaattaatttcttttgaaacggagtctcattccgttgcccagactggagtgcagtggcagaatctcagctcactgtaacctccgcctcccaggttcaagtgattatcctgcctcggccttctgagtagctgggatcacaggcatgtgtcaccacagacctggctaatttttgtatttttagtagagatggggtttcgctatgttggccaggctggtctcaaacttctgagctcagatgatctgctcaccttggcctcccgaagtgctgggattatacggcatgagccaccacacccggccccacaattaattttaaaacattttcatggccgggcactgcggctcacgcatgtaatcccagcaccttgggaggccaaggcgggtggatcacaaggtcaggagttagagaccagcctggccaacatggtgaaacctcatctgtactaaaaataaaacaattagctaggcgtggtggcatgcgcctgtaatctcagctactcaggacgctgagacaggagaatcgcttgagctcaggaggtggaggttgcagtgagccaagaccacaccattgcactctagcctgggcaacaagagcaaaactctgtctcaaaaaaaataaaaaataaaaatttttggccgggcatggtggttcatgcctgtaatcccagccctttgggaggccgatgtgggcgatcatgaggtcaagagatcaagaccatcctggccaacatggtgaaaccttgtctctactaaaaatacaaaaattagctgggtgtggccggccaggcgtggtgagtcacgcctgtaatcctagcactttgagagaccaggcgggcggatcacaaggtaaggagatggagaccatcctggctaacaccgtgaaaccccatctctactaaaaaataataaaaaaaaattagccggccgtggtggcaggcacctgtagtcccagctactggggaggctgaggcaggagaatggcgtgaacccgggaggcggagcttgcagtgagccgagatcgcgccactgcactccagcctgggtgacagagcgagactccgtctcaggaagaaaaaaaaaaaactagctgggtgtggtggcgcacgtctgtagtcccagctacttgggaggctgaggcaggagaatcgcttgaacctgggaggcagaggttacagtgagacgagattgtgccactgcattcaagcctgacgacagagattccgtctcaaaaaaacaaaacaaaacaaaaaaaattttcatgttctgccgggtgcagtggctcacacctgtaatcccagcactctaggaggccaaggagggtagattgtttgagtccaagagtttgagaccaccttgggcaacatggcgaaactctgtctctgcaaaaaatacaaaaattagccagacatggtggcatgctcctgtagtcctagccactcaaggatgaggtgggaggatcggatcacttgaacccgggaggcagaggttgcagtgagctcagatcgcgccactgcactccagcctgggcaacaaagcagggctctgcctcaaaaaaaaaaaaaaaaaaaaaaagaaccaaaaaaggaacattttcatgttctaagggtctttaatctaaagatacccccggatccctaagccatcacccccactcctcccaccccgagccctaggcaaccattaatctactctgtctcaccatatatttttgttgtgtggtaaaatatacacaatataacatttgccattttaactatttttaagtgtaaagctcagtaacattaagtatattcacattattgtatagccatcaccactctccatttccagaacgttttcattatcccaaatggaaactgtacaccttaaacactaactctccattctcccctcaaccccaggtaaccttattctactttctgtctctatgatttaactattcttttttgtttgtttgtttgtttgtttgtttttggagacagagtctcactctgtcacccaggctggagtgcaatggcgccttctcggctcactgcaacctgggttcaagcgattctcctgcctcagcctcccgagtagctgagactacaggcaagcaccaccacgcccagctgattttttgtatttttagtagagacggggtttcaccgtgttagctaggatggtctcgatctcctgaccttgtgatctgcccgcctcagcctcccaaagtgctgggattacaggcaggagccaccgcacccggcctgtttgtttgtttttgagcctgagtcttgctctgttgcccagcatgtagtgcaatggcatgatcttggctcactgcaacctctgcctcctgggttcaagcgattctcgtgcctcagcctcccgagtagctgggactacaggcatgggccaccatacccggctaatttttgtatttttagtacagatggccaggctggtgttgaacccctgacctcaggtgatcggcccaacttggcctctcaaagtgctgggattacaggcatgagccaccacacccagcctgatttgactattgtgtttttttttttttttttttttgagacagagtttcgctctgtcgccaggctggagtacagtgtggcacaatgtcggctcactgcaacctcagactccctggtccaagcgattctcctgcctcagtctcccaagtagctgggactacaggcgtgtgccaccacacccagctaatttttgtatttttagtagagacagggttttaccatgttggccaggatggtctccatctcttgaccttgtgatctggccccctcggcctcccaaagtgctgggattacaggcgtgagccaccgcacccggccctgatttgactattctttatgcctcatgtaagtgggatcataacagtatttgtccttttgtctgacttactttacttagcataatgtcctcatagttcatccgtgttgtagcatgtgtcagaatttcctgtgttttttttaaaggctgaatactatgccaatgtagggatatacccattttgtttatccgtttatccttcaaggatgcttggtttgtgttctaccttttgggtatcatcaccatgtattttataaacacaaaagtaatgagttacagtttcctgacttaggatgttcattatctcatgtttgggagacctgagggctaaaatggatgcagtagagttgaagtaccatagacactcagagaagggcatgtaggttacgggggccgtggctggctacagggaggtgtggtctgggaagcctgaggggagtggatcgagggcaggggtgagagcagagacatggtggatttgagatgattgccacctctaatggagcagagagctaggggaggaaggttggggctggtctagggaaggccccatcgcttgctgaaaacattcccattttatcttggatgccatggggaccgttgaaggctttagagtaaggcatggcaatgatgaacaagccacgggagagcagtccagaagcagagcagtctggaagttgtggggctgacattgctcaggcctggcgtggggggcatccctaggtcccatggggccacctgaaatgttatcttttcttcctttcctttctcctttcctttctcctttcccttcttttcctttctcctttcccttccttccctttcccttcccctccccacccctctcctttcctttcctttcctttcctttttttttttgacagtctcactctgtcacccaggctggagtgcagtggtgtgatctcggcgcactgaaacctcagcctcccaagtagctgggataacagctgtgctccaccacacccagctaatttttgtttttttagtagagatggggtttcactatgttggtcaggctggcctcaaactcctggcctcaggtgatccggctggcctcgaactcctggcctcaggtgatccacctgcctcagcctcccaaagtgctgggattacaggtgtgagccaccgtgcccagcctgaaatgttatctttctttctttttgcttacagcacctacgccccagtgaagtccttccttcgagtggataaagaaaaggtaagctccccacttcttccccacctcagtggaaacagtgctggcccagcctgtgtgcctggtcctgtagctcaggtgttccatttcccctgcagaacctcagggtccccatctgccgagatgcctgaccctagcaggtgccacacgattcaggagacacagacgcacaggtctctgacaggcatagacaagtagaagctgctcagtctagcctgaatctctgcccctaaacccctcatatacctgtcatcccttctcctcccaggtccagatctacaacccagccttcttcaagtatatccacgacaggtggacagagcatcacgggcggtacccttccacggggatgctggtgcttttctttgccctgcatgtgtgtgatgaggtgggtaggcccgtggtgtgggtggtgggaacccatggaacagaggagtgcaggccttctcgggtcttagcaggctaacagaggaatgtgcttctgtaggcagaatccatgtggccttggtttcccccatctctaggctgtaaagtatagatatgcctttcccaaacgtttctgctttcatgattctaccaaatccaaaatctcttcattaaaaagttattggccgtgcgcggtggctgacgcctgtaatcccagcactttgggaagctgaggcgggcggattacttgaggtcaggagttcaagaccagcctggccaacatggtgaagccccatctctactaaaagtacaaaaaattagccaggcgtgttggggcacgcctgtaatcttagctactcgggaggctgagtcaggaaaatcgcttgaacccaggaggcgtaggttgcagtgagccgagatagcggcattgcactccagcctgggcgacagaatgagacgctgtcttgaaaaagaaaagaaaaaaaaacataaatagaatggagagtgtatgtagttgaatttcagctggacgactgcccccaccagctctgagccccaggcctacttcgtgtaaaaatggaactcagtcgttcagagaacccgttccaccagtggccagggctgccttgcaatgaagagcagggctgaggcccggcaagtgcttcactgagtggtgctgatcaaagtactccattaaaaaaaaaaaaaaaaaaaaggaggaatttgcaagggctgcaaagggaaggtggtgtccccatgtgagtccatgtccttaggccaggcctgggggctcctgcatctccccggggcctcccgtcccctctcctccctgtcatcccgagcccgccccgcgccatcctccaggtccccgcctggggtgacgctccgctgcgcttccccgcaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgctcaatccccactccctcatgctttgggttagggttttctttcacgctttctgaggaggagagcatggcgcgggcctcggcgaagcacttccgtcagcctcgggcggaggatcgtcttagtagctggccagacctggaggagagcgggcggtctttgcgggcctcaggagataggtggccgcccggcccctttccccgcctgcccggataggtgcgtgcagacccaccaaagaaaagcggtcgctgcgggacccccagtcccacctcggccgcgctgtgggatggctgcgcccccagggcttcctgcgtctccaggaagccgggagtggcgccctctgcggggtggggtgctcccgggccgaactccggacaggtggaggggacagggcagagctcgaggaagccctgtccccttcagtgcaaggtgctgtcactcacgtgtgccctcgaccctcccgttcacccgcagccttctcagcgcctctccctgggccggaggcctcctcaccagcctacctgttgctctggaaaaaaatcccgtcccccgactccgtccctacccccagtcttcggccggctctggcccctggggagggggctgcacggcggaaggaggctggctatgggcccggctgcccgctgcatgtacctcctcctccacccatcgcctcttgcctgggggtaactttgcctggggctcattctttggttaagctgaagctgccgtgggtggccaaaccgcagattctttgcaaattctgagctggcagagctcgcagccgggagccggccggggaagaggagacttgcgcgccgcaagccgcctgcctccaccctgctctccatctcccgctctagaagggctgggaagctcgcggccggggttccacctggaagctgcttgcatggctgaacccagcttaggtccctgacggggctgctggtggaattctcccccttcgaagctggggaggtttaggagggggaaggcttctgtgaagctctcaaaccactaatagagccccctccccaacagtgacggcgcagatgctcccccttttcttagttgacaccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagtattgagcagaataatttatttcttttttttcttttgctttaaatcatgaatcccgccaggtacggtggctcacacctgtcatcccagcactttgggaggccaaggcgggcggattacttaatacttaaggtcaggagttcgagaccagcctggccaatatggtgaaacctcgtctctaccaaaaaaaaaaaaaaatacaaaaattagccaggcgcagtggtgcgcacctgtaatcccagctacttggaaggctgaggcaggagaatcccttgaaccgaggaggcgaaggttgcagtgagccgagattgtgccactgcactccagcctgggcgacagagcaagaccctgtctcaaaaaaattaaatcatgaatccccatcctggaagaggtaggtcccagcatccagccagattttctgcaatagtaatttaaacacacttttttatttccttccctttctgaattaaaaggaacaaaaaactgtctagtccttcattgttctgaaatgggcatgatggaagaaggcgggtctggtaggatagctgtgactgataatggctgagaacgttgggggatatgggaggggcgagatgactcccagataccctcccccacctatacaggaggcacctcattcctggactctgcgctccaagacactgaaatctgagcgggtacaagcattttggttaaaaatcagctcgttgtcgcctcttgagtttcctccaggagaggagttcattggagaggattcctggtagcagctcctcgcagtggctgtcctgtaaccactttggcctctgtcaacatgatgtctccaggtatccatcaggctccgatacatttgggtggccacaggctgggctgtccccacctctcagggaagtgcatctaagtcaggttttcccctctggcacagccctgcctccacagcccaatttccaccatgccacaggcaacccgcatttttatttatttaatttatttatttattgagacagagtcttgttctgttacccaggctggagtgcaatggcccgatgtcggctcatcccaacctccacctcctgggttcaagcgattcttctgcctcaggagagtagggagtagctgggattacaggcatgcaccaccactcccggataattttatatttttagtagagacgggttttctccatgttggtcaggctagtcttgaactccagacctcaggtgatctgcccgcctcggcctcccaaagtgctgggattacaggcgtgagccagtgtgcctggccgattttttttttttgagactgattctcactctcgcccaggctggagtgcagtggtgggatctcggctcattgcaagctccgcctcccgggttcacgccattctcctgcctcagtctcccgagtagctgagactacaggtgaccgccacgatgcccggcagtttttttgtatttttagtagagacggggtttcactgttagccaggatggtctccatctcctgacctcgtgatctccccgcctcagcctcccaaagtgctgggattacaggcgtgagccaccgcgcctggcttttttttttttttttttttgagatggagtcttgctctgtcacccaggctggagtgcagtggcgcgatcttggctcactgcaacctccgcctcccaagttcacccacctcaacctcccgagtagctggaattacaggggtgtgccaccacacccagctaatttttgtatttttagtagagacggggtttcaccatgttggccaggctggtctcgaactcctgaccacaggtcatccaccccctttggcctcccaatgtttgaccacacccagcccataatagatttttaaaactcctataaatatcattctacttccctttattgctaaaatgggagctttttcatccagttttttgggtgtgttccaaatattttgttaaatttcccgtctattgctgttattgtttccatttatttgcccatgtgagttgatacctttttcattcctttcccatagctttagtgacgttgtgggaagggaagttaggtaagtgatgtttcatcttgtacttactagacacctttttcttccttgatttcctgagttccctgcctccacaggtgtgtttcactcctggttgcttatatttttttatttttgagatggagttttgctctgttgaccaggctggagtgcagtggcatgatctcggctcactgcaacctgtgcctcctgggttcaagcgattctcctgcctcagccacccaaatagctgggattacagatgcgcaccaccatgcccagctaatttttgtatttttagtagagacggggtttcaccatgttggccaggctggtcttgaactcctgacctcgtgatctgcccaccttggcctcccaaggtgctggcattacaggtgtgagccaccgtgcccggcctctggttgcttatttaacccctttgtcacgatggaggcttttctcttttttttttttttttttcagatggagtctctctccattgcccaggctggaatgcagtggtgctatgtccgctcactgcaagctccgcctcccgggttcacaccattctcctgtctcagcctcctgagtagctgggattacaggcatgcactaccacgcccggctaattttgtatttttagtagagacggggtttctccatgttggtcaggctggtcttgaactcctgacgtcaggtgatccgcctgccttggcctcccaaatggtaggattacaggcgtgagccaccagaccctttttttttttttttttttttttttaagagacagggtctcctgtcgcccagactggtgcagagctcactgcagcctcaaaaactcctggattcaagtgatcctcccacctcagcctccagagcagctagagcctagctaaaaaattttttaaaaacattttatggccaggcacggtggctcatgcctataatcccagcattttgggaggctgaggcaggtgaatcacgaggtcaggagttcaagaccagcctggccaagatggtgaaaccccgtctctactaaaaatacaaaaaattggccaggcttagtggcagacggctgtgatcccagctactcgggagaccgaggcagagaattgcttgaacctgggaggtggaagttgtggtgagccgagattgagccactgcactccagcctgagcgacagagtaagactccgtctcaaaaaaaaaaaagtattttacccatccacaggcagcagacaaggaagtaccttctgtgactgtctggcaaggtcagaggcatcagggaaggtaaaatactgaaactatatttttaaaaataaaagtattcccttttgagtgtgaattaggaatcaatgccccttctcactacttttgtgaaaaaaatcacagctcctgcagcaagtctatgcctgggtaacaaccaacccacaaaatccaagaggaggtccccctctcccgcctctgtgaggcttgaggagcagtatgtatctgggccagcctggtcctcagagtgtggaattaacacctttcctctagcaactgtttgtgctgctgagaacagcacagactctctggcagcctggttctctccagagggaagcctgtgaagcagaagaaacatatggcatctgcactcagggcgcccagttccatccggccttgctataaaatgactttgcctttccttttttaaaattacaaaaataattcaaccaatacataaacatatgaagtgaatcacggagggccttcctgcgatatctttttttgcctaccatttgtcatggaatgggtaaaggggaccacagagggaagagacgctgccccttcgcagggccatggcagtcccctgggctgcgtctccacggtgcttcctgtgaaacgctgttaccacgggcaccgcactggagaccatgaaagggaagagtttgacatctcagctgtctttgctataaatagaaataaataaaccttaactaaggcttgagtacacttaggccgggcaaggtggctcacacctgtaaccccagcactttgggaggccaaggtgggtgggtcatgaggtcaggagtttgagaccagcctggtcaacatggtgaaaccctgtctccactaaaaatacaaaaaatcagctgggtgtggtggcaggtgcctgtagtcccagctactcaagaggctgaggcaggagaatcacttgaactcaggaggcagaggttgcagtgagtcgagatcaagccactggagtccagccggggcaacagagcgagactccatctcaaaacaaaaaacaaaaaaaaatttttttatcagtcaccttaaccaaatgatcaaggtacatcaccagtctaatactaataaaaactctgtacatgattgaataaattaatcagtgggggagaagagagaattctcccttgcagaggagttgaataattaatgtaggtagctactctgcccttaaggagagcatgtaacttccttgaggtgtgggctgcatgtacataatgacttcctttcaaagagtaggatacaggccagggctcagcacagtggctcatgcctgtaatcccagcactttgggaggccaaggtgggcggttcgcttgaggttgggagttcaagaccagactgaccaacatagagaaaccccatctctactaaaatacaaaattagcccagtgtggtggcaaatgcctgtaatcccacttgggaggctgacgcaggagaatcgcttgagctggagaggcagaggttgcagtaagccaaaaccgtaccattgcactccagcccgggcaacaagagcaaaattccatctcaataataataataataatgtagtgagacaagaatgggcagctccccaacagaaaagattttctaagaaacttaatgtttgccaagcctcactaaatcaaaatcaaacaatgacataatctgtttttgccacttagactggcaaagttttaaacattgataatactgttggcaagcacgtaatttttgtatcacagtaacataaattggtaaaaacctttggcaagtgtaaatgacaatgaattaaaattttaaatgtccctactctttgacccaacaattctacttccaggaataatatcctgaagtgattttcaccaacgctcaaaaataagaataaggttgggcatgatggctcatgcctgtaatcccagcactttgggaggcccaggcgggcagattacttaagctcaggagttcaaaaccagcctcggtaacatggtgagaccccatctctacaaaaaaaaatacaaaaattagccgggtgtggtggtgcaggcctgtagtcccatctacttggaggggtgaggcaggagggtcacttgagactgggtcgaggctgcagtgaaccgagatcatcatgccactgtattccagcctgggtgacaaagtgagagctggtctcaaaaaaaaaaaaaagagaacaaagatgttcagtttgggtcaagggctcatgcctgtaatcccaactacttaggaggttgaggtaggaggatcaatttagcccaggagtttgagactggactgggcaacttagtgagaccccatcgctacaaaaataaataagcaataaatcttttttaaaaagatgttcaggccaggcacagtagctcacgcctgtaatcccagcacttttggagaccgaggtgggcggatcacgaggtcaggagtttgagactagtctgaccaacatggtgaaaccccgtctctactaaaaatacgaaaattagctgggtgcggtggcatgtgcctgtaatcccagctactcaggaggctgaggcaggagaatcgcttgaacccaggaggtggaggttgcagtgagctgagatcacgccacggaattccagcctgggcgacagagtgagactccgtctcaaaaaaaaaaaaaaaaaaatgttcggccaggcgtgatggcacccacctataatcctagcactttgggaggccgacagaggtaggcagaccacttgaggtcagttcgagaccagcctggccaacatggcaaaaccccatctctacagaaaatataaagattagctgggcatgctggcatgtgcctgtaatcccagctacttgggaggctgaggcaagagaactgcttgaagctgggaggcagaggttgcagtgggccgagatcacgcctctgtactccgggccagagtgacactctgtctcaaaaaaagaaaaaaaaaatgttcattgtggtactgtggataacagccatgtactagaaatcccccatgcctgtcactagaggaaccaggagataaatgccgggacagctacacgcagaaaggaaggtggatggtgtttccagggcaaggaagatgtgtgtgtattggacatgtcaacatgtctaacacatgctgatcagtgaaagcaggttgcatagtagtgtgaacagaatgttcctgtttttgtaaaagaaaaatgggtttatgcaaataaaaggcaatatggtagaatattcaccaagctgccaggaatcaggatcccagaagagaagggatagagagcactctcactttatatacacacacgcctttttaaaatgagtatatatttgtctaataagcagaaaaatacaaataaaaacaaatcattagtagagcgtttctcataattactttaaaatgtcttagcataatgaatggtgcatacgctacaatttatccatccttatttatttattgagtcggggtctcgctctgttacccaggctggagtgcagtggcgccatttcagctcacagcagcctctacccaggctcaagcgatcctcctacctcagcctcccgagtagctgggactacaggcgtgcgccaccaggcccggctatatttttttctatttttggtagagacggggtttcatcatgttggccaggctggtcccgaacgcctgagctcaaccgatccgcccgcctcagcctcccaacgtgctgggattataggcatgagccaccacgcccggcctatccatccttattcatattatgtaggaatcagagctctccataatgtccactattataaatgaacagcataattcccttggtcataacttccattccaaattcttgctcagctctcggccccgtgtgacacctgggggtaagaaccaactacgtatgcgctcagaaactcacctggggtctcctggctgccgtgactgagtaccaggggcctaggcagagggagcaaccgagagaagagaaggcaagaccaggcccagccccttcatcggccctcgccagatcactctctctcaaggggtcaggattcagactttcgtgtttctctccaaatctgaagtttacaaaagtagccgagctgctcatcagggatatgcaagtctgctttctgcagcagagaacagaagtgaaagggagaagggatgagcaagaaagtctctggatttcaggagaaggaagacagccccaagggcaggagaaacacttgtgaagggtccattgaagagacagagagggggcagctctggcctctctgctgccacttccctcattcgatgcacagcggtggggctcacaccattttccactcagcctcttccgcacaacctgcacatctatcgtttcttcaggggctggagctggttccacgatgcctagccaaaatcaggagggggtcctggggccagcgactaccactgtgaccagattattataaagatgggggaatgtggctttaaaaaagtggggaaaggacccaattttccaaaatgcaaattttttcttctattgccccccatcatttgcacctatttttgtcaagtccaaacataatttgaagtgaggtaggtagtttctctctacttctgccgttgtccttggggtgatgtcggggcctgtgccctaaatgcacttgtctcctgtgcaggggcagtgccagggctggcatcagtggctggtggagcttctcagttggctattttctcaatctcgtccaaatcatctgtgtccaatctttctatcttcttatctgggggaaagatacacaagtctctaccctgcccaggaatgtgccccacctcaggccacagcaatcattcattcaggcccaaaggctccgggtgcctaagcagggggcagcagggcccctagtcactgacagcaacagtcagagccccacgccccgaagcccagtcacaggggagctgtccttggagtccctgggtcctgaagtctccaggtgtgctccctgagaactgccatatggtcagaaaggaggggagtgtgctagggacagagcctctcttggggctacagaagatcctacccctttcaccaccccgccctacttagcaaagggcgccaggcacaggaccctccccgggactcactaaa

SEQ ID NO: 1379 - DNA, 2396 bp, Homo sapiens
ccgggctgaggcggcggcggcggcggcgctcggggagggttgggccaggcaagggcgggactagcccacggcgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacg

SEQ ID NO: 1380 - protein, 350 aa, Homo sapiens
MKCSLRVWFLSVAFLLVFIMSLLFTYSHHSMATLPYLDSGALDGTHRVKLVPGYAGLQRLSKERLSGKSCACRRCMGDAGASDWFDSHFDGNISPVWTRENMDLPPDVQRWWMMLQPQFKSHNTNEVLEKLFQIVPGENPYRFRDPHQCRRCAVVGNSGNLRGSGYGQDVDGHNFIMRMNQAPTVGFEQDVGSRTTHHFMYPESAKNLPANVSFVLVPFKVLDLLWIASALSTGQIRFTYAPVKSFLRVDKEKVQIYNPAFFKYIHDRWTEHHGRYPSTGMLVLFFALHVCDEVNVYGFGADSRGNWHHYWENNRYAGEFRKTGVHDADFEAHIIDMLAKASKIEVYRGN

SEQ ID NO: 1381 - DNA, 46742 bp, Mus musculus
  misc_feature (1)...(46742): n = A,T,C or G
agaaaataatttcagcagtctggtggtttgaatgcaaatggctctcatagattcatatattttatatgcttggtccccagttggtggagctgtttgggaaggattgggaggcgtggcctcattggaggggatgtgtcattgggggccagccttgaagtttcaaaagcccatgccatttccagttaactatctctgcctcctgcttgtggattaaggtgtaagctctcaactactgttgcagcaccatgcctgcctgcctgcctgccgccacatgcagtgacggtcatggaccctctgacactcgaagctccaaatgaaatgcttttataagttgcctggatcgtggtgtttgtcgcagcgattgaaaagtaattaagacacaggtcacggcgcttgctgccaagctgatgacttgagtttgatctgcaggggccccatggtgggagtggagaactgactcctgaaagttgtcctctcactgccgcaggggcaccatagcatgcgctctgctatcctcagcacacaaacaaatgaatgtaaaagttataaattttaaaattgttttagggttagagatgtagctaatgggagtgcttgcctagcatgcttgatgttttcattgggttgtttgtattttacgtattgcgtatgtaatccacctgtctttaccttagcactgggattactaagcatgagctacaatggctgttaagaaagcaaaaaaggcctagaggtccaaggtttgatttccagcacctgccatagcacatgtgtggtcagatgacaacttttaggggtcagctctgtcctttcatggtgagatctggggaactaactcaggtctttgggtttgccccacgaacactgtcaatatttggtttttgagtttaatgaagtgtttttctgctcttggtgggcttagcttgggggtgggtagtaggaccgtggaaatccagtggccttcagagtcactttggtctcacaatcacaaaggacggtgaccgaggccactagcagggcaagcaagccgagatcccctgatagtaacagcttccacagcaggtaggagtctcagaaatgactcgctggctggctttctgctcttttatgtgttgggtctcattgctttagcctgtatattgtatataaattagctgttgatttgggatgagtctgggaacacaggcacacacacacactagtgcacttttgtatgatatgagtgtgggtatctgtgtgtgtgtgtgtgtgtgtgtgtgtgtgtgtgtgtgtgtgtgtgtgtatatatgcatggagagagagaccagtgtcagctttgggctttagtccttaggaaccattcattcacctgtctgtctttacgtccttggcgctgggattataagcatgtactacgattaaaaaaaaaaagggaccagaggattcaggtttgatttccaacaccatatgacagctcacaaatgtctatagcttccagagcgtccaataacttctggcttccttcagtactgggcacacatgtagtacacagacatacaaataggcaaatacacataaaataaaataataataaaaaatgtgtgtgtgtgtgtgtgtgtgtgtgtgagagagagagagagagagagagagagagagagaatgtgggtgcctgtggaggccagaagagggtggcaagtttcctggctctagagtgttacaggagtttgtgagccatctgggaactgaactcaggttccctggaggcagcaaactctctgctgctgagctatagctccagcccccaaacccctggctgtgtgtatgtgggtgctgagagtcacactctggtcctggcgcctttggcaagctgctcacaattgcctgtaactccagctccagggaatgcatgctctttggtttccatgtgccagtgctcacgtacacacgcatactctccaccaagagccacataattaaaagtaaaataaatctttaggaaacaagtttgttcatttgaagcgattcattaagctgtgggtagtaagtctgtattatcagagtctgggaggtatcctggcaggagagttaggagacaaaagcaaaacaaaaccccaactacaaaaccaaaccctgaaaacaacacaacaagaaaacatgaattagatcccagtagtaagccacatcacagcaggtgtgaattactcgctttgttaaaagtttaaacaacaatgcttaacagtagtaagaaaatgcagtctagccgagaggtttggagccagcgtgctgagccaggatcccggtgatgccatcgctgatgccatctgtgggccaggtgacctcggctaacttactgactgcctttctaagcttcagctcttcatccgtaaggcaaggcaaacactaggtatcaagagctcctagagcaccgtcaggatgctgagtacatggaagactgcaaagcaaaaatcaaggcaatactgagactggacaagaggaagcccagactccccagtgaccattcatgctggggaaacataggacatcgattctctcagtgtcagtgcctgaagtgttgtttggaacctggttggttaggagctacatcgtgtactgagagtgcagacccccttcaggagaaaagcatgctctagtaaaatgttaaagcatcccgtgtagccacaggaaccgttgttagcagctgtgtgaacacttccaaaatccaggttctcaagacagcagcaacccagctctgagattgcgaggaagccttcagcaggctggcctcaggccttagcctcacattcccctggcagctctatttgtagactagctgggagggttaaatgagggcatctgtgcagagcgcttagcacagtggctaagcatcagactgcttgatgcctgtcattatcgcattggaagtctgacctaaggaagtaacgaatgggttcacagaagagacattgagagctggggtgatctttaggtgatgtctcatctaccctcgtattttatacattggaagctgagtccttcaaagatgaggcgatttcctcaacgatgctctctgtgtggcgtttaagttttcagagaggggagatgttcctgtattaaagagggagatttcccaagcgaacacccctcttgttgtataaactgtttgtaattcatgttagacaatgatgtcaaagacagctttggcagcaatgtcagcctctataatttatctagagataggatttgatatggtatgattcttgttaatatcggttggtttcagcttgtggcttcaggctgtgagatctgattatgcactcattacggtccatgcccaggctggagacaaactggtgttgagaaatggcccagctctgacttgcactgattggaaggataagcagacaacatactttgccttcctgccttccttcttctgtcaagtttatgtggcctagtctggccttgaactcacggttcagttgtaggtgactttgaactcctgatgttccttgcctccaccttccaagtgctgagcttacaggaatgtattgtcacgcccagcccaagatcagtttttgtatttgtactaatatttaactgcaagtccaaaaatggatttgtaatagaatctgtcccggcatttggctattactaagtacataattacctgttatctttttaaaaataaaaatattacaaaaataataaagcatgaggtttgtttgtttgtttgtttgtttttggcaagctctcactatttagtcttgactggtttggaatttattatgtagatcaggctgaccttgaacccccagagttcctcctgcctctgcctccggaggctgggatcacaagtgtatacccggcttcatgggctttcctggctaacagatctctgagctgtagggattaactgtacattagcctgtttaaagtgaacatctgaaggagttttagtatatgtccgtccccaccatcatttctagaacataccctcaccctgacttgaaacaggttttttatctgtttgttttgagacaggatttctctgggtagccctgtggaactcactccgtagaccaggctggcctcaaactcagagagctcctcctgcctttgcctgcctcctaggtgttaggattgctccttcctctttatagttgagtaacgatccactgtatgagtgtccagtgctcatttctctttataagtgagtcatagtccattattgctatacagcttcttatttatccattcatcagttgttggacattgtttccacttttagggttttatgagtgatgttgctgtgaacactgatgtatatgttgttgtgtagcataagcatttaagaccatttttaagttgcctttaataccaaatagtcactaaattaatatgttaacaaatagcatgtggtaggcattatactagcaaattgatttttaccctcaagaaaattgcaatctaatggagaaaatgtactataattaaataccattataatatctcaagtgccaagaaacagaatgctaggtcctgcagatacacagatgtagctaattcatcctggggtgtgagaggacggtccagcaaaaccttagaagtgtctgtactgaatcccaaagggcggggtggggggggggaaagaagaaggagatctgtgtaattgctgtgcaaacttcatgaactgattttgggtccctgtgacccgcataaaatgctgggcatggttgtaaaccccagtgatccaaatactgagtaggtagagatgggaccatctttggagcttgctggctagccagcctacccatattggtaagttccagggttccatgagaaagtctgtaaatcagtcagtcagtcaagcaaacaagcaagcaatggaggaaggcactccatgttggcctctgtccttgacacacagggacatgcatgtgtagtgtacttaccacacaccacacacacacacaaagatacagacacacaaaaagacaaagaattagccagataaaggatagaagagtcttccaggcagaaccagccattggtataaaggtcctgaggtgagagtgggaggaaggtggggggcggggtaagggagagaggaggaaggagaaagagacagacgtgagtttggagggctggcaggaattcatcttaaagaattgataatggctggcatatgggggcagcgttgggaggggagagctctgagatgggctgcgggaatggacaggaagctccaaggtagtctgtaaggctacactccactgaggatgcactcagtcctgctgactctgcagagccatggccagatttagcacagcagtctctgagatgacagggagcacagctggtggcaggctcctggccttcccgggaagaagtgataacaaggcagaggatgggagtggttgagtaggggagacaggaaggtctgtgcagacttagctgcagtctagtaaagctgtattcctggaagcagggccttttaggtcagaacgatcattgattctgatcctgtcttaatttctttgctaggtcactttggttttgtttgtttgtttctgtgtttttaactgaatatagcccatgttggctttgaatatgtggtcgtcctgttgcagccagctaagtgttaggattacatgtatgcatcacagtgtgtgtgtgtgcatgcgtgtgcgaaggtcagagaacagattagaaattggtttaaggcagtgcctcttgtttcgccaccataggaatgctggaagtacagaagtgtgctaccatatctggcttttcacctgggttcttggtaccgactaagactgtcaggattgtatggcgagtgcttttgcttttccttgctgagtcatctctctggccttgtttaaagatacctttctttctttttttctttttcttcttcttttatttttctgagacagggtttctctgtgcagccctggctgtcctggaactcactctgtagaccaggctggcctcgaactcagaaattcgcctgcctctgcctcccgagtgctgggattaaaggcgtgcgccaccactgcctgatttaaggatgcctttcttctatggttcttacttagtcgtgtgtgtgtgtgtgtgtgtgtgtgtgtgtgtgtgtgtgtgtgtgtgtgtaggtgtgtgtaggtgagtagcgctgcagtgcacagtaggaggccagggagctttgtggatggaggcggttctcccttccactgaggattaggtggtcaggctggcatggcaaacacagctacctgctcagccactcagccacctcactcgtccccagtacaagttttaatagggggtacaatcgctggtctatccataattcaagtttgaatcgctggtctatctgtaatctaccagccccttccttcaggcagataggaagttctacccacgtcactgcaagtgttccctcctcccttgccttggcgtctgataaaaccccacaccccgttctttataacggctcagcaccttttgttcattgtcatttttttcacttagcacatccgttcatttatctcatgtatggagccctgtcagcagtaaggccctggaccgtcgcccctgtcccctcagctcgtccttttctctggtcagatggcttcttgttttggtgagagaacctcctttccacttcttcatggggtcaacctagcataatctccctatgtttccctacaaatatactggtagctttttttttttaattagtggtttcttttaaaaagtaactttctgggctggacagatggttcagtggatataggtgattgccaccaagcttggtgacatgagtttaagccctggaacccatgtggtaggagaaacccaacctctgcaggttaccctctgacccacacacacacacacacacacacacacacacacacgtatcatccacccccccaaacaataaataaatgtaaaaggagatcccttaatatggtgatttataatatatttgcagtcttgatgcatttttgtgtttttaaaaatgctactagaagcattccattgtgtagatatgcatgctagagttgtaagtaaacagctctgtccagaaagcatttgctaccttctggggtagataccagaggcagagctcctgagacaaaaggcacggcacttttggactgttgccagattgtcttttcttagtgctctgttactgtatgcctcacactacaaatttagcaacttacaacaataaccatctcttagctcagatttctgtgggtcagacgtccaggcactgcatggctggtttctttgttcagtgcctcattgtcaaaatcaaggcatctctgagccatgtttccacttggaggcttcacctcagaggaatccatttccaagcttgttcaagtggatttcaatatccagtctctaggggctaggacagaaattcctgtcttctttttttttttggtttttcgagacagggtttctctgtgtagccctggctgtcctggaactcacattgtagaccaagctggcctcgaactcagaaatccgcctgcctctgcctcccaagtgctgggattaaaggcgtgcgccaccacgccaggcaattcctgccttcttactgactgtcgatgaggccttgcttccagctcccagaggtcaccatcaggtccttccctgggacccctttgtctgtctttcataggtggcatgggaatcccatctcctctttaggttaactggccggtgtgattaactctctcagttgctgccttccaaatagaaggtctatactcactaaacaacactcccccaaccttgtcagcctctgctttgtctctgtgagctctcctgctgcatgtgtgtcaaccttttgtgttggctgttgttgctgtaataaaatactgtaactaaagagagggtttatttgggcttgtggttctagagggagagttcgtaatgtcaggggaagctgagagatcacatgccagccacacacaggaagcacagggagagctagaagtggggtaaagcggtaatgcctgcttcccatgactcctccagcacctcctgaaggatccatagccttcccaaacaacccctcccacggggaacaagggtttgaatacacacgctgatgggacagttttgagcctccacacaagccttaagtggaaccatcttgtactagtgtctcgttgggtgtgtttctcttggtgcaatcctaagaatcattcctatcagaatctatcagaattcctgtttttaaaagctgaataataatctactgtgatggtgactacttttctttaatcttccattcttcccctgctggatacttgggctccttaatcatgtcagtaaaccactggccactctagctagaggagtgttttattaattagccgtgtgtagcaggcacaaggggtatgcatcaagaacccagaatcttggggctatggtcagatcctccatgagatgccctctagaaagatgctgctccctgttggggaagccaccttgttctctttacagcattaatctatacatcacacagaagggttctagagatggcatggcgccaagcttgcccatgcagccagggttccctctgctcaggattctagggcattatgaaggatgttctaaccacttttcaccctctgggcgaacagtctggcttcatgtctccaggactaggcatgacatgggttttgagtggtagatacgtgtgagaaaaccattagtgaggccagtgggggtggggttggtgctgccattcataggttatgattgtggcagcatccacaaagtgagttcttctagcatgcgctcttggaaagaactgagagcatttagtgaccaaacagatgatacaggaatgacagggtaaggctgtaactgccaggattcaggcagccacatgccgtaccttcactagccttggtacagacttggagatgaggctctgagtcatgacattgatgctcactaggatctacgagatggaatttcagactgaatgtcgatgggacacatttgtaacaatattaccttggaggatagtgaggtgcaggggtccgtttgacagtatgctcaaagtacattgggaactggcataacaatagcttcatgtaaccctttataataaacaatggctaaaatattaagaataaaaccttggatccaatagggatggtatttgagaaatatgccatatggcttcaagaaggtcccatgtgctgtggaaagaaatgggtgttctgtgggtatgtaggtagcaatgttccaggttagcttccggagtagaaggtcttgttagtagctgtttcttgctctgtgctagttagattccctgagggctctataacatctttctccacaacttagaatatgctgtcttggttgtgtatagtcctggtgtatgtgtgtgagtgtgtgtatatgtgtgtctgtgtgtgtatgtatgtgtgtgtgtgtgaaacagaagcgatcatttgccaaagtgaatgtaagatctgggtgggagccgggtgtggtggtgcaggcctttaattccagtacttgggaggcagaggcaggaggatttctgagttcgaggccagcctggtctacagagtgagttccaggacagccagggctatacagagaaaccctgtctcaaaaacaaacaaacaaacaaaaaagatctgggtgggaactaaaagaacaatggttcgcaaccctttggcaaacttctatctccaaaaacatattacaattcattaacagtagcaaaattatagatatgaagtactaatgcaataattttacggttggggtcaccacagcatggggaactgtattaaagggtcacagcgttaagaaggctgagagccactggaaagtgcagaacactaacacctgagaacggattattgtcaaccaaggacttcctgagaaacaggaagaagagtcaaaggtaggtctgtcttttcccctggttattttgtcagtagaactaaaactgtgttccttctcacaggcaactgccatgtctgtggactgtcttgggcagcatgcagtgctttctgggtaagtgagcttttggagttggtctcccacaagttctggggaacaaagtataaataagttcctgggaactcgaaaactatctttatgtgtgaggacaatccgagcgagcggggctttagtattcacatcctaaggaccacaagggcgcttgcaggggttctttgaggttttgtttggtcttgttttgtctctcatagtgaactcacattttagtgtttgtagtttggccttgagttgacagtgttcttgtcacaatactgtctcactgaggaatcagtctagtatggttagagaggtggttaggagggttgaggcaacctgggctctctggacactcactcagtttacctaactgggctttggctttttttttttccagaaagaatttaaaaaatgatttagagtgtgtgtgtgtgtgtgtgtgtgtgtgtgtgtgtgtgtgtgtgaaacctcaggtgtcattcctcagtcaccgtctactttgttcacttttgaggtaggttttcttgttggtctggaactcacaggtaacacaagcctggctgagtagccagctccagagagccatctgtctcctcctccccaggaatgaaataattactgcagggatgttaactcactgaccaagcgagttttctttcttaaaaaatatgtagcattcttcttcttcttcttcttcttcttttttttttttttttgagacagggtttctctgtgtagccctggctgtcctggcactcactctgtagaccaggctggctattgattgacactgtaaacttgctattgacatatttactatgttactttaattgttatgccattttcttgggtcatcagttcttgcagatagatctggttttcatttccaagttgtagacttgcagaggaatttgagatttttctgcaggatttcggtccagtaacaagaatgcttaacacatttattgaatgtaaagctctgtgcctggtaataccgggcttataaagatattttagacatcgtgtagtttccagacctacaggtgaattgagacaagagccttagcatttggtagacttcttgtagagaaaacacagttgaaacgcagctcctgcagtgggattgatatggatcccagccaggggcactgagaaaggctgggggagttgctgagctcagagggaccagacacactctgatgtatggatgtgggagtgaaggccaaccctggaagtagctgtcacagagacactgtcccctttgcataaccatcagcttgggtggcacttgctacctgtgtgccttttacagtagatgattgtcatgtgctagtaactgagagtttggggcaagctgtatgcaattctgaatgtgcttttctagcgccgtgtgcatgctcttacattgctgtgaggctataacactgatgtccttctagccgacgattcctgtacatcgtcaatctagatgccccttttgaaggtcaccggaagatctcccgccagagcaaatgggacattggagctgtgcagtggaaccctcatgacagcttcgcacactattttgcagcttcggtgagttcatttaaggagtgccattgagagctggcaagtctttgtcctgtacaaagaagagaatgtaagtcgtcactgctcaataaaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcgtgggttccctgtactcacatgcacatccccccttccccacagacagatgattaaaaagagagaaattaaagcaaaaatgtctcattctttccaaggatgggattccttcctaattggagttcattggcttggttaacctctgcaggttttgagtgcctatttgtaaattccccaggattatacctagctttgttttgttttctgagaaacttaccactctccaaaaagattttgggtcatgtcatctctggcacctttctctcgatcctttgcctccattcttttctctagaacagtggctttcaactgcctgatgctgcgcccctttaacatagttcctcattgttgtggtgacccccaaccataaaattatttttgctgctatttcatagctatagttttgctactcttatgaaccacaacgtaaatatctaatatgcagaagtcaacccctgtgaaagggttatttgaccctcaaaggggtcataacccacaggttgataaccactcccccagagcaactgtagatttctgtgcctgaccccttatgattactattgtgtgtgtgtgtcatgtggatatgtgttcctgctcatgtgtgcacgtgcgtatgtgtgtatctgtgtgcacgtgtttgcatgtgtgcatacatgtatgtagaggccagaagtcattgtgggatgtctttcttgaccattctccaccatatttttttgagacaggatctcttactgaacctggagttcactaatttgctgggtggctcagctgggtggccagtaacccccagagtttctcctctctccacgtccccagtgcagaaattctgttcccagcttttcatatggatgctgggcatcagactcaggctctcatgctctctgactaagctgtgttccagtacttaatggactggttttttaaaagctgaacccagagaatctgccataaagtcagcttctgtacctcacctcctttaccttaggcagttaggagagctaacaccccaggtatgtgccgagccactcactgtcttctcgtccttgcttcctctcagagtaatcaacgggtcgacctttataagtggaaagatggcagcggggaagttggtacaactttacaggggcacactcgagttatcaggtaggcattgcccctgggcagctccttggcctgtctcacttcgtcacagtcctttgatgaatgaaaggaagacgccagcctcttcacatgcttgacctgctgtatcgcctttgccctgagtagccagcagggctcagacttccaggcaaagtgcctacagataacggagagcacagccacttaaaatttaggaagcataacttggctacagcctagaccaaagtacaggtcagggctgagttttactgcaggaaggagttgttgctatgaaacagtctccctatttggtgtccgtagtggccagcatgccaagacaccccggcagcagccatgggtggagcctcggggggctcctgtttcagagctgcctccacgaggggcttgctttccagagctccctgatcctcttttctacagggttgctatttccttttcctggagagtactagcagggagtgtggggctgggggagatgacctggaaatgataggaaaagttagtcatctgacctggaagtgataggaaaggtgagatacacaatgtgtgtacacagtgtctgaggattgctgcctttcctaggactgagggtaacaggcaggaaggaacagttttgtcactgcttaagacggtttacccaaggctcccgtggttgataactcagagatcacactatgcttcctccttgttttgtctgtttattcagagagaggggagaaggagagagtagggcgaggaagagtgggagttgttaggggaggggggagcttatgttttgtctgctgttgtttttaagtcttaagggcaatttaatagagttgcaaagaaaagctccagggttaggttagccacagtctcatagccgcccggaggaggaaggtggagaagaggaaaaggccaggcagtttgggtcaaacctgcgtacatgggtcagccatgtttgtggggaggggaactttagagaaagcatgcttacaaagagatagaaaaaaaaaagaaaaggaagctgtgcttttttggatcaggactcagaaaaagggcaggatggccaggagcttgctgcagcatcctcctgctgtggcccgcggcgtctgcagcatccacctcagtgcatgttgtgaggtgaatgccccatgtcttttcaagagtagacaggattatggccagcagttctagggagacggacctgagtttccttcccagctcggttaactcttgttctttcgcacagagctttagtgccttgccctgagccgtgttaggaggcatactgtgaagacatgaaaccattagaaacggaatttgttaatgcttttgaatatgacattgatgttctgtctttctgttgttctgtttgtctctgtcagcgacttggactgggcagtgtttgagccagatctcctggtcaccagctctgtggacacctacatctacatctgggatatcaagtaagaacaatgagaggccatggccttttggtggaccgctgagaactttgttagagcttaagtgtcttagtttggttcccatggatgcagatcctagaccaggctgtgagagcaggtatagtaagaggtaagagaagagctgccagggataaagaagacaggcagttatggatggccacgaggaaactccttcctcagctgtgacctgaggagggcctggggggtaggggactgcagtcagagctgatggctgcccccagaagtgtgaatgcctcgactctttaggcttgccagggttctggaaagcagtcttcagagaccagacaaatccctttggcaaagcagcacagatgctggcatttgcgagttgagctggtctgcagagggggcaagtgatgagttgctaagacatctgcttagctcttatggctctgtgaggcgtctgttctccgtctgtctggggtgaggcggggtagggaagctaatggcctcatcatatggttgcacctcatgaggtaaagtcaaaggagcccccggcctgaggcctgccgtgtccaggagcagctcttttgctgatggtcagagctggtcattcccagtgggccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtgtctctaacctgaccatatggcccccttacctgcagaccagctcttaagtctgtgggtctcaggacaacacctgaggagaatcatggcattctgaagtagtagaggggagccttcagcaattggagagtcctcagggagccaagcaagggctaggactggggagtaccgctcatgtacatgcagtaagtgctttcatcattcagataccgaattagcccagcgtggtggcacatgcctttaatgctagcacttgggacacagaggcaggtagatctctgagtttgtcgctaacctggtttacagagtaaaaaccccaggatacccagggccacacagagaaaccctgtcttgaaaacaaaaacaaaaaacaaacaaaaaaaaagaaagaatagaagaagaaaatttaaggaaaaaaagagaaaagaccctgaagaccctgaattggcattatttaagttacacctgaaggtatgaggttgttaaaaaaaacaaaattggcaacaagaaaagattttttttccttaagatttattttatttatttaagtacactgtaactgtccacagacacaccagaagagggcattccattatggatggccgtgagccaccatgtggttgctgggatttgaactcaggacctctggaagagcagagggtgctcttaactgctgagccatctctccagccccaagaaaagatttttggatattcagtgacctaaaaattaattcaaaatcaaccacagaatgaatctgaggtgttttgattttacacctgttttataaacccgtgagccccagggttacataaaaatttcttagttgaaaatggaatgttaatttgggaagtttaagaaacaataaatagtgagcttccttaataccagggagccacctgcttctctcatagtctctgtggaagccacccccactgactctgtagtcaactgttgtacttttgtgtatccagagtaattattcttcactaaaattgcaatgtcatatgtttgtaactacattatcttgtctgcaaagctttgtcttacaaatcgtagactttacaccttaaacaactcccctttccctgcagcacttggaaggaagcactcagctcttgccagctgcagtcccagtttctgtttaatgggtctgaccgcctccgctacctcctataagaaggtagttcttacaaggagggttctgattctccttttgaggcaaggtctcactcttcattatggctggtttgaaacttgctatgttgaccaaggtagcctggaaatgacagagatctacctgcctctgcctcctgagtattgattgggcttaaaggtgggtacccatggccagcacaggcttctgactcttgtggtttcctctcctgtcacacatcacacatgggctacctgggttgtgatgaagtttgtaatctgtttctatggatccactcaaatgatttggaacccaggctttcttatctgaagcgttggacaaacagatctctctttacacattgttttaaggttcttaaagcactgtaaagtctaaatgtccctagaatagagtaccagagtgtgagcagacggtggagcgcgctgtctgggtcttggtacatgatgatgagcatttgaattctgctttctctgtttcagagacacaaggaaacctactgttgcactgtcggctgtaggtgagtgtgtgcatcctggcttgtcctccccagttccttcctgttcctactgttgcactgtcggctgtaggtgagtgtgtgcatcctggcttgtcctccccagttccttcctgttcctactgttgcactgtcggctgtaggtgagtgtgtgcatcctggcttgtcctccccagttccttcctgttcctactgttgcactgtcggctgtaggtgagtgtgtgcgccctggcttgtcctccccagttccttcctgttcatccttcgcacaactctgactgcccacagcccatgctccatggtggctaagtcccatggtgccagatgctgacctgactctgctccaagcttctcaccattagcttcaatagttgttaccatatgttccattttgtttcaccctcattccctttgtgattattttgaagctaaatatgggtattatagtacttatccaatgttttattatgcattacacatacatacacatacacacgtatggaatctctgaaggctggagagatggctcagttgtcagagtgcttgccttccaagcatggacaccccagtttgatccccagcactcatgtaaaataagccaggtgtgatggtgtgtacttactgttccagatctagagagggagagacaggagggtccctggggctcacaggccagccacccagcctaattagtgagcttagaccagttcatgtcatcccaagttcatgtgctcagagccagtggccaaagctacctgtgctgatgggagatgacagtcaagagggatgtgtagagcggggcatggtgatacacagaagcaggcggagctctgtgggttcaaggccagccaggtctgcatagtgagatcttgtctcaaacaagaaaaacaaaaggagtagggtacagagcgtgtggtcaaaactgcctaacctggagctgattctaggggttgagttagtgtttcttgaagacgatcatgtagaaacaacaatgacagagtagggcgaggggggggggtcagagtgagtcagattctttttttttttttttannnnnnnnnnnnnnnnnnnntgagtcagattctttttttttttttttagatttatttttttattatctgtaagtatactgtagctatcttcagacaccccagaaaagggagtcagatctcattacggatggttgtgagccatcatgtggttgctgggatttgaacttgggaagagcagtcaggttctcttacccactgagccatctcaccagccccgtgagtcagattcttatgacaacagtgttaccaacctaactatcccctcttgctcctataagaggctcctcaccccgatagtgtgtctcccttggagatgatttcctcggaggggactgtgttcttgctcctacgtgtgaactcgcttgtttatagcttcttcttctttttaaaataatttttattaggtattttccttatttacatttccaatgctatcccaaaagtcccccataccctccccccccccacccccctacccacccactcccactttttggccctggcgttcccctgtactggggcatatttacagcttctgtaccagcagagccagtgccctcatagaagctggacgggcttcctggaccagggctcgttacccagcatccctggacatgctcctctgcctcggaagcatcaaaagcagtcactctccccatgttgttttcctttgcagctggtgcctcccaggtcaaatggaataagaagaacgccaactaccttgccaccagtcacgatggtgacgtacggatatgggacaagcgagtgagtgacctgtctgttgtgacttttccctgtagttggtgtttggttcttcccagagggtgtggagaggatgttgttgagtcccaggactcacctcaacacattgaagagtgggcatggcaagatgtcactgtaaccagatgacgtttgcttctcatctgagttgctgttgaaggcgggtggaaaataagctcttgtgatcagtggttggtaaacgtgccttgacctaaggctgagcccaactttgctgctccctgttaggacatcagggtagccactgcagcggctttcctgtctttgtccgttttcctgttttgtttcttagagacacggtctcactgtgtatccctgcctggcttggagcttactttgtagaccaggactgtgtagaccaggctggccttgaactcacagccacctgcctctgcccatagagtcctgagattaaagatttgtgttgccgtggccagcatgctaccccttcctgtccccctctctcttgagaatagtctgctacagaggtgcctcaggagttaaaagcactgtctactccttattccctcattcccagagtccacatggcatctcacaaccatgaactccagttctaaggggtctgatactctcctgtggccttcttgggcactaggctttcacgtaatacacttacatgcaggcaaggcacccttgcacagaaaataaaaataaataaacttttcaaaggagagggagaaccttgaagtctctccttccgcttctgcatcctgagtactgggattacaggtgtgctgccagcacacccggcctcaaaatctttgtcttcaaaatcaagacaatagtagtgagtgtatcagtgaggtctagcctttaggacccagtgcttgcagggaatgacctactcgcctcctgtctctgcccctgtttgcaaagtgaacgctttggtttggggcctctgccattttcagtccttctagcataggtctctgaggcaggggactgattatgcttacctcttcctttgtgtattttgtcagcctcagagagcctcatgtaccatgtactagtgagtatgcagagcttgccgcacgcttcctgtgtataatggacggtcagttgggagtctgctctcttggcattagtagagagtggtgggtgaggctttccctgcaccgactacctgctactccatggggtaatgacaggcaggagagtcagctccatatagtctagggtacaatcactgttccatgctttgtgaaatttggggctacagatactcagcctttgtagagagggcgtcttcatgactgtcccaacccaggtgcctatagtaaagtcctggctgtgcagagaacactacacatttttgaaagagggaaacaaagcagagctcgggggcttgggagtggctcatcctgtctgctggcgaaggctttaggacctgctggggtgcactgcgcagcgtgcaggctgaagtctgcctcccagggctctcaggagaaggagattccaaaaaactggaatggcctagcagtgtctggttttgttttctctatctttggtccagtctgccagtagccatctttctgcctgcctgcgtgccttctttccttccttctttgaatctggttgtttttattcagtttaccacacatttaggtgtacgtaaatgttcttagaaaggtgggtttggctcacatgtctgtaatcctagtacttacatgttgaggggaggaatattgtgagttcacaatttattcaattaaattgcaccctatttattggttctagaagttgcttttggtattctagagttccaaataaccctaacatacatgtctagagttccacataaccctgacatacatgtcttttgtgtctgaagcttcagttgaattaggataactgcattacaaaaggaaaattgtagtgtttctttttaaacatattcaggagtgnnnnnnnnnnnnnnnnnnnnnnnnnnnnnnnnnnnnnnnnnnnnnnnnnnnnnnnnnnntgagtatgtgagtatgtgtgatgtgagtatgtgtgtgcatagggtgttttggagatcttagtacccagtcactaaaatactcttaccctcatggttgaggttgggtttgttacagtccctcttcttgtgtcagaaggggaacagaaatgtcctctctgaaaggaaaagagacagccattacctgtatcttctattaaaatcacacactaagctggagcgggtagacatgtggaagggtctggggaagtcttctgttgttgggtttatttgctatgaacaaagagagcttatgaaaggttgaggcttaactgtcctgagattgttagggtcccctcagtgcccagtacaccgttcgttttgtggtagccattcaatagtgttctttcaaagtcaacaaacatggcgtcattgtgctgcagaaacccagtacagctgtggaatatctagcagcccacctctccaagatccacggcctggactggcacccagacagtgagcacatctttgccacctccagtcaagataactctgtcaaggtgagtggttcccactggggccgttggaggagctttgtgtgacggacgttagggatgcatggtcatggtagcattttggaaggaaacatgcagtttgctgtatgctccatgtgcgttgtgagtgcatgtgctccttgggggcctgagtgtgtcagcccggctctgctgaccagcagatgcgatggtgtagcggcagactaatgagcctctgaatctgttcagatttctttccctctctgaaactcagaggcagaaagcatttaggaaagaaaagtttacctgaaaaggatttgtaaggaagccagaagtacacacagaggtaaagaggcccacacaagggttaaagccaccaagattgtcctttatctgttcatggtggcaagccagcagttcctcatcaaattatcatatctgtaaaagttatgtcctcacacattagcattgacaggatagagctttgctagtagtctctaacttaagacctgctcaaagtttatgttcaggagccctgccagttttgatttatcttagacagtgtttcttctttgcttgttttctgtagctgtggcatcaggctatgcacccttgatcaaagcggtgatggggcagggtcatctctgctccaccatccttcttcggtcaagtctctatccctgcaggtcagcacttggccacagaagttggcttagcaattttgtgacttcatcatcatcatcatcatatttaattggatttacatagcagtactctttctggtacagttagctaaaattgagcccaagcctttctatgtaaaggactgaacgttctctctggaggtttgtaaatcccctggccttgtgttggcaagtgacttgtttgtctgttcatttgggtttctgtccctaacctcccaaactcaggaaacaggaacatactccaatctgcatttggaaaagagattagtagcatcctgcaatgtttgttgtaaagattgtgtaagattaaaaagaaaagttttaaatgtctgtctgatggccgtgagttgtcgcctagtgttaaattgcttttagatgtaatgtaggatcaaacccgttattttaccttttagctacagtggttatttgagaggcagttgctctgccctgtgtgtcctgttgaggtctagatatcctcatgcgatgttgactagtgtaaatggaagggctctctgtgtgcctgacagtaccgtggttataggggaggaactgaaaacacactattgaagtattccttcggccatcactggaaagagaggctcattggacacacaaactttatatgccccagtacaggggaacgccagggccaaaaaaatgggaatgggtgggtagggaagtcggggggagggtatgggggacttgggattgcattgggaaatgtaaatgaggaaaatacctaattaaaaaaaaaaaacccacatttatcatttctcaaactttctgtcttgtagttctgggattaccgccagcctcggaaatacctcaatatcctcccttgccaggtgcctgtctggaaagccagatacacggtgagtgagctgttaaacctcttgtctggagtgtgcgtttttctgctttctttgtgaggcagtttctccttctgtcttggtttacagtagtggccttaggtgcttagcctccggggtgctcaataggtgctccacagagaagcaggcgtgtggaggttcttagtcacggaagtagctcagcagggtaggatggagagaggggccagagtcggacactgctgagctataggagaaagaactctggtgtagactcagaggacctggtttggggccagcttaatgtttttgtagccttggaaaacatacttcttttttttttgtttgttttttgttttttgtttttttttttttcttttttcgagacagggtttctctgtatagccccagctgtcctggaactcattttgtagaccaggctggcctcaaactcagaaatcagcctgcctctgcctcccaagtgctgggattaaaggaatgtgccaccaccacccaacatacttcatcttaagtagtagttttttttcagttgcaaagttgaaggacacttttcactctgccctttatattttttaaaaggattttgtgtttatttatctctgtgtgtgtaccatgcatgtcagtgtccataggctagaagagagtgttggagcccctggagctgagttacctgcagttacaaatctgccaacatgggtgctgggagtggaacttgggttgtctggaagggcaacaattattcttaactgctgagccatcatccctgctcaaagattttattgttatttttttcatatgtgtgtacataccatgggagtgcaggtactcacagaggttagaagagggcgtcatatcccttggagctggaggaggttgtgggttgcctgcagtggatgctgggaatggaacttgggttctctggaagagcagcatcttaattgctgctgtctgttctggcctccaaccttccttttactattgtgataatatttgccattctaaagtggacagtttcatggcatttggaatatcaatctgccttccattggtaataatgtatatgaatgtcctttgtaaatcacagaatggtacaaatagccggttatccgcctccagccatgtttccatggcacgttgatggctgtgagtcagagataagtgtatctcctgtaatgtcactttgaaagcaatccccgggatgaacaaagcagcagttatgcattaggctgtcacccagggacattgggaagcaaagaagataattggacattatgttgttttgcatctgggatcacttgccaagaaatgagacgcagttcttaggagctgacatctctgcattcatgtttgctttaaaaaataaacaggaaggttggggagtgttatggggaggggacggaaagataaatagatgtgctcttgtgtaactatgtgtttttccttcaataacagtcgggttgtaaaccaaacgggtcctcatttcccctgcagtctgggttttactaagtcaaacagcagtcctggggtaactaagttctgctttgattccgtgctgctcggaggcagtgagagggtgatgtttcatgtggatggtgttctgctggcccgtctgcctgcagattttcccagccagctttgcatactcacggagagtagctaggacatggaccagaaagaaccatttgcttacggtagaatttccagagttatccaagcatttggcttagcctcatatttcatttgctgtgttccatagaggctgtgtgtaatagacatcatatgatatttgacaaaattttccccagatgagtttgagctttccataatttttttttaaagataggttctaagctgggcagtggtgccacacatttaatcctggcactcagaaggcagaggcaggtggatctctgagttcgaggccagcctgctctacagagtgagtttgaggacagccagggctacacagaaagaccctgtctcgtaaacttaaaacaaaacaaaaaaaggataggttcttcctgtgtagccatggctatcctggcctgtaatttgagatgtcgaccaggctagcctcaaaggtgtggcaattctcttgcctctgctttctcagtgctggcattacaggcccgagccaccatgcctggtgtctatcatgtagcttgatttagttaggaacagttccagctttggtttggtttcggctgattccacatggagtaagcccagcttccccttcctggctgcagcctttcagcaacgggctagtgaccgtgatggttccccagctgcggagggagaacagcctgctcctgtggaacgcgtctgacttgaacgctccagttcacacctttgtgggtcatgatgacgtggtgctggagttccagtggaggaggcagaaggaaggtgagtgagtagggagggctgtgctctgattttctcctgagctctgctggacatctctgccagtcatgttgtcatagtgaactagcagaccagggctggctctagggactggaatggaaggcaggcagggagggagggctgtgttgaattagagatgaataaacagagtgtgcaacattttccctctccctagttctgttctccaacttccattgtgtctctcttgcttggaagagatccgctccaggaagaggttgaagaggtggtttttattttggtttgtttttttaatcatttcaagggccaaagactttagaatcttccagagccaagccataacaatagcaatttttaaaaaaagatttatttattaatttattttatgtatgtatacgagtacactgtagctatctttagacacaccagaagagggcatcagatcccattacagatggctgtgaggcaccatgtggttgctgggaattgaactcaggacctctggaagagcagtcactgctcttaactgctgagctgtctctccagcccacaatagcaatttttttttcttttttttaaaatatttttattaggtattttcctcatttacatttccaatgctatcccaaaaaagtcccccataccctccccccccactcccctacccacccactcccactttttagccctggcattcccctgtagtggggcatataaagtttgcaagtccaatgggcctctctttccagtgatggccgactaggccatcttttgatacatatgcagctagactcaagagctcaggggtactggttagttcatattgttgttccacctatagggttgcagatccctttagctccttgggtactttctctagctcctccattgggggccctgtgatccatccaatagctgactgtgagcatccacttctgtgtttgctaggccccggcatagtctcacaagagagagctctaactgggtcctttcagcaaaatcttgctagtgtgtgcaatggtgtcagcacaatagcaatttttactgtgggggttgctgatgcctttaatcccagcactcaggagacagaagcagaccatgtctgagttcgaggccagcctggtctacagagccagttccagaacagccagggctacacagagaaaccctgttcttgaaagcaaacaaacaacaatcctccccgaaaaaaccccaaaactcataaaaccttaacaaaccaatagcagttttccacctaccctcttcctctcctccttgccttcttctctgactactcagtctgtctgtctgtctgtctgtctgtctgtctgtctgtctgttggttctggagattaaacctaggacttgctgctaaggtatacccctggctttcactaccaatttgtgaatccctaaagctggtttgaatttgtatgtttttgagctttccacaaatttaattattctgactgtatgcttaaattcgaccttcttcccgacctactgttgctttggtatatttttactatcatgtcttctcagtgcgtttttgttggagcgagcacctcatgcctttggctttggtcggcactgtgggaatggatcaggacgtggcagctaagggaataggaaagaaccagtagtcagagggttgggtgttgctgaaggatcacagtgaagagagagaaaaacatgtaattgaacaaaaaggaagatgtttggtcattaggagagaaattgcaaagcaggctgaggctagaagccagatacctaggtggtataagggaggcagcaggaactgctggctacgcccaggacaaggagtagaatggagagttggtgaaggcaggaagaggctgtgtgaaggaagtcagtggtgagaaggacccttgggagttcgaatggcatggaaagtgcagggattggagctgaatttacaggacactcaggtcgaccctgtcctcaaagcccgtgcatgtgaggacagatgttggatcgaagcattgatgcccatgaacatgagacaagatagtggggttcagcagtgattcagagaggcagaactaaaatactggagaaaatgcagagaagggactgatgtggagactcaccctagtccagagcccacttaccctgttactgagtacagagcatgttgtctgttgcctcagtttccccatgtatgaagtgagggaattgagtgaaatttattctgaattcttttttgtgtgaagttggccaggagggagattgcagatgctctggagttaccctagtatcctcaggctttataagctgtttcgtggagcaccctaaacttttgaatcatccctttagacccagtatctaaaaaacacgattcagctgatcaagagaattgaaaggctgagtatttacttcataaagagatgtatctttttaccaaaatagaaaaaacaaaaacattttgaacaatgagatcccacgatgcatagaacacaattatttttacacgcctacgagctccttgggagcacatttgcagaggtgaaagtttaggtgacactaggtcttagtgtcacactctgtctgttaatttgtcaattattctttcacttcatttatgtttctgcttttttgagacttccccagggagtcctagctgaagagcctctgctgttatctctcctgctgcttatcaccaggattttattatatgtttatctgctggtctcttcccaccattggaatgggagctctataaagctagataatctcattcatgccactgtttggggcctaggcaggtacctgtcagactaaggtgtgtagtaactatttgttggttgtatgtactatgaatgaatgaatgaatgaatgaatgaatgaatggatgaatgaatcatactccactgctgtctataacaaaatggatgtcaaatctgaatgattttttttaaaaacacattttattgatttgttatgagtttcacatcatgggccccagtctctctcatctccctgtctcctcaccttctgcccttgcaacttggtgtctaaaataaaacgcacacacaaacacaaaaaccaaacaaggcatagaaaacatctcagtctgggagctatagtgtgtcacagtgtgtcccaaagtatacccctctgtccacacatcatcatttacaaatgttagttacagtcagtcattggtctggttcaagatctttgacttctgtgagaccaacaatattgattcagtggatttttttgttgttgtttttttgtgtttttttttttttggttgttcgttttttgtgatttctaggatccaaggactatcaactggttacatggtcccgtgatcagaccttgagaatgtggcgagtggactatcaaatgcagagggtatgtattcagtggtattatagagaaatattaagtggatgcactagaaatttaaccaaaagatacaaaaaaaaatcagagaatgtttgctgacattgtgcctgtggtgggctggtggcctgtgtggccacgggcttggggtcttcagaaccaaagtagtcttcactgtaaggctacgcatgtaaggctacagactctctgcgtgtcccctttgtcctagtattggacaggatggataccacagtgagcacatggcttagcctttcatttgtctcttccccatgattgggaagcctgccctgtgctcgtcagtaccaccttctctgtgaagctccctccagtgctttcacatatgagcatttgtttctgacatcaatggaagtggtactggtgtgccgctctgaaccgtcatgggacagtcctcttctcatccagtggctggatcacctgacggtgagaagcatggctcactggcagttcatacccaacagcattgagagcatctttcacaccagctcccccagggctgatgggaaatgctgggcgaagattacagcactgcttagtttaaactcacctgagcattttagtcaaatctgctaccttatcactttttaaatgtttttctccagaatattccatttggtccaaatgcttgggcttatggtatttgtacttgtgagttaactgaataactccactaagacttggaatttaagtagattttttttcctcagcatttttactctgatcatggtggaaaaagacaatatgataatagagtcaattatcctttttatttaaccaaggaattttggtgatgggtaaaacctatttgagggtacaagttcttcttcttcttctttttttttaaaagatttatttattatatatgtatatatttttgtttttttggttttttttttttttggtttttcgagacagggtttctctgtatagctctggctgtcctggaactcactttgtagaccaggctggcctcgaactcagaaatctgcctgcctctgcctccgagtgctgggattatatttattatatgtaaatacactgtcttcagacactccagaagagggcatcagatctcattacagatggttgtgagccaccatgtggttgctgggatttgaactcaggaccttcagaagaacagtccgtgctcttaaccactaagccatctccccagctcgaggatgccagttcttgactactctctgtcctttatgattcccattttaaagaaagaactcttgagtcagacacagtgaccatttctcttacatctctagccctacatctttatccttatgttttggttttttggtttttggtgttgctgtcaatcaaacgcagggttttgggcacactaggaaaacacttcagcattgacgcctactctgcacaccaccctttgcccttgctttcagctctgtgccaatgacatactggatggtgttgatgagttcattgagagcatctctctcctgccggaaccagagaagaccccacatcctcaagacatagatcaccagcccagcttaagccatggagaggaagatggtaatgtaactgatgtcctaggggagggaccccactctgcgttccagagttacatagcagagaccccagaactgactaaaacatttctaaaacatttccaatattgcctgtttctcctggtagccataaaggaagaccctcccagcagtttgctggaagagaagagatcagaccaactaggcctcccccagactctgcaacaggagttctccttgatcaacgtgcagatccggaatgtcaatgtggaggtaaggcagagttatacactgagtctctgtcagagtctctgtcagagctgcccaacacaggcactgagaactctggccctgtggaagaacaagaagcacacttaactgctgagccatctctctagctccagtcttcatttttaactcacacgtttctgtagaaatagaagttttaaaaacatagacattttttgaagctcatgtaccatagcatctccgtagcacccagaattctatccccttattttatgatattggctcaaggaaggcctgctgattgtcaggaaacggggcaggctaaggcagagctgagtttggagnnnnnnnnnnnnnnnnnnnntttggagctgcagctcctgtctctccatgctattatactgtgctcttccatctcccctttgtgagctagtttcctcttctgtaaattcagagtgagaagatgaccaaagcctcttgttcacttagtacttggagcagacctggatcagcaggttgttcttcagtgacagaatctaaggagagtgaggccagaagatgagacaataaagaaaacgttaacctgggatcaggaggtcttgcacaagctatgtcttaggctaagcaaacttactaagaaatacagcatctcacatatacagtttccaggggagacatgggatgaagtcagtagaaactggctgtcacacaatgggacaaagtccacaagatgctaatcaagctgctgtgttgcacgaagggagcctggtctgcaatgtacttgtgataccccatgctcagcacagcggccttgggactgataactccagtctcttcaaggggaaaagccaagtacccaggaaccaaaaccttaacttgtttgatgcccagaccgcagccccagactaaaccttgccaagtctgctcctgagcaaggacataacataaaacttggttctttttgttgtttcagcggggcctctgaaagccttggattggcctggctctcaatgtggaacagtgtgtgtgtgtgtgtctgtgtctgtgtctgtgtgtgtgtgtagacttcaagaatctttgtttcagagacctgagtatcactccaagaagggctttgggagctcaggtattcacaataggaatgtgtactacagtgctgtgatttgtttagtctttaaagctgttttgtaatgcagagttatcacgcttcacagatgaagaaattgagacacaaggtacaaaatgacttcaaaggccagcagctgtttggtgggaagacataatatttgaatatttaaatgtagttgaatagttgaggtttttaggtttagctctcttcactaacttgacttcagttgctttttctagttggccacaatggaaatcaacagacctaaaggctactttaatggcttctctgtatcagcttagcctgcactgctgttgtcccagttgagagcagtggtgatctggtgagagcagtggtggtctactgagaacagtggtggtctactgagagcagtggtggtctactgagagcagtggtggtctgctgagaacagtggtggtctgctgagaacaatggtggtcagccttcagaaaggccttgattggggagttgtgcagcttccaccattgcctaattccagaacaaaagacaaaacagaattcaacaaagaaacctctgtgtcttagttaggatttctattgctgtgaagagatcctgcaaccatgccaactcttataaaggacaatatttaattggggctggtttgtagtccagaggtttagtccattactgtcatggtgggaagtgtgcaggcagacatggtgctggagaagatgctaagagttctgcatcctgatttgcaggcagctgggagagaactgatttgaacttctgacacacttcctccaacaaggccacagatcctaagagtacaactctctatgagccaagcattcaaatacaggaatctatggggaccacacctattcaaaccaccacactgtaaccagcaagtgtggtagcacacttctgtagtctcaacactcagggacgttcatgagttcaaggtcagccttagctctatatcaaattccagactagcctggagtacatagtgagacctgtctcaaaaaaaatttaaaaactcctttatgcaactatagagatggatcagaaattaggagtactagccactctctcagaggacccaagttaggttcccagcactcacatggcagctcataactgtaactctaattcaggggacctgagtccctccccaagcctttgtgggtactacaagcatgtggcacacatgcatacagatagaaagtcttttaaaagaacatctatacctgttatcagttactctccattgcccctgctcctacccatcccacaccccattgcccctggccccacagtcactattttattttctgctatccattctctcaggagtttttaagttgactcgggttatgtctttcaacttcttgctttatttattttttttcatcacaaattaagtatacaagttttagtcagcattgcaactttgagatgctttttttttttaaagataaaaatattttgcgtttggggctgaagcgatagctctctggttaagagcacctgctgttcttccagagggtctaggttccattccagcacccacatgatggatcacaacctctataactcagtttcagggaatccaatgccctcttctgccctccaaaggcaccagacatatgagcagtatacagacatacctatacacataaaattaaaaaataatatatatatatatatatatagaatttatttaaaccagtannnnnnnnnnnnnnnnnnnnnnnnnnnnnnnnnnnnnnnnnnnnnnnnnnnnnnnnggacatgacaggtcttgcctattcaaggccggcgttgaggctcagcccccgcaaaagacgatgcggcacagtatgataaggtgtgcaggtgcctctgcagtccctttgctgtttgtcttgcagatggacgctgcagaccggagctgcacagtgtctgtgcactgcagcaaccaccgtgtgaagatgctggtgaccttcccggcgcagtaccctaacaacgctgctccttccttccagttcattaatcctaccactatcacgtctgccgtgaaggccaagctgctgaaggtgaggctgggctcccagcgttagtctctcctcgtggctgtaacaggccgtggcgagcttgaggacaaacgtggagcagtggctgtggaagctgcccattccccgaatgctgcagttcctgcttcatagccactgtcctggctgcccacttggtgcagacagcggcaaggcagagtttctctgccttgagtttctttggccagagtaaccctggccatcctggaacatgctctgtagaccaggataaaataattttaagatgaattaattttaatagtacttttctttaacctggcacattttaaaaatattaccatgccaacatataattagtgaaaatgagccagttagtatagtcctgtaatccaagcatctcgaatgggaggcaggaggatcaggattcaaggttatcttcagctacatagtttgaggccagcctgggctacatgagaccctgacacaatccctcaaatgagatattttacactttttacttttgatatcaagccttctatacagttgtgaattttatatgtgctgcagctgtgagtctgaaggaggcgcaccaccgtgcaggcagtgacggcagtggtcccgttaatgtgtccgtcttaatgcgggtgtcagtttatatctctgttactgtttagtggataaaaatataacaatatgttttaacttttgctgaatagaagtctctgccctggcctatatcacttgaagcagttttctctgcagcccagtgacggtgtttttaaaacaatgagatttttcatgtgtggaaggaaactgtagaactcactagaaagagagagtagtcattgtagtctgtgtaaggctctggaaacctcttcccttgagcacctgtggggaccactagacgccccaggcctggccgtgtgctggctcctgtgccgtcacgctcccgggcactttgcagagtatagccaagcaggaagcatatggatggctgattctctccctgatggaggtttggtttttttccagatcctaaaggacacttcactgcagaaagtgaaacgcaaccagagctgtttggagccttgcctgcgccagcttgtctcgtgccttgagtcttttgtggtgggaaccatgaacttgttgagccaacctgtgctttagtatcttgtcccacttcttatcccaagaccctgactccctttgtggtactgtaccattgttttgtaatccaacttagagatacactgtgggttctagtgtgcttatctttgatttcagaaccaagaggacagtgcttctagcaacccatttgcactccaaaactctgtcacaccacccttgccgacatttgcacgggtgaccactgcctacggctcctaccaggatgccaacattccctttcctaggacctctggggccaggttctgtggagcaggttggtttctttgttgttctttggctctcaactctgagagagtgtagctaagaaaggcttatattctgtattaattatcagaaaatgtttgctttttacttcccaagaactcagaacaacatatggtgcaatgctaaattggtatctgtgagtatagcctaagaatgtttacagggaacctggggagatggttcagcaggacagagcactcgctgctctttcaggggactcaagttcagttccctgcacccatgtccagcagcttacagccacctgaccttccagttctaggagatccaacatcctttttgggcctcagcaggcacctggatacacaatcgcatacacatagagagacacatgaacatgcatataagtaaaacaaataaatttttgtaaaaaagaatgtttgctataatccaagtcttttttttttttttttttttttttttttggtttttcgagacagggtttctctgtgtagccctggctgttctggaactcactctgtagatcaggctggcctcgaactcagaaatccgcctgcctctgcctcccgagcactgggatcaaaggtgtgcgccaccacgcccggcctgccataatccaagtcttaactatttagttctgatcatcctgagtttgtgtctgcttaaagccttaattctttcacctctcctagatctagcagacccttacttttgtccctttaagggttagtgtagtcacaagccttggcagtttatggagatgtgcctcaggtatactgaaatagagaaaaagcctgcccaagctggtggtaagaatgcttggcatgtgtgcatgccaatccccagtaccaccgaatttatatatacattttaagtatagttattaatcctggcatggaggctcatgccttaatcccagtacttagaatgctgaggctggaggcttgctataatttccattccagcttgcccttgctagtgagaccctgtctcagagaacaaaaggattacccagtcttgctgtggggttcccgtgtccagctcactgacagtactcatgtgtctcctttgtcaggttacctggtgtacttcacacgacccatgacgatgcatcgagcagtgtctcccacagagcctactcctaggtgagtctgggagatatggcaggaatctgcatctctgagtctctctttgcaaagttcatttcagttcttcagttaattaaattaacttatttctactgtatggtgacaaagtaactttcattcacttgctgtaattgtcatataagctcacccgttctaggtctttctggtctctggctggctgttacaactcagctgttctaactcaaactcctctccaagctgactgattcaaactggcttctctcagcttctcactgaacttattcttggtctcaaatgaactctagcaatctgttctaatcttctgcctccttctcattctctgacccgtctgtcttcacctgtgtccagcttgttctctctgcaaagtgtctcgggaaaactgcgtcctctctcctgtcctttctcttgaaagttgggtgtatcctttctctcaaatctttctctgattcgtcactttgtctctcaagtagaaataactgtttgggattaaaggtgtgtactaagggtctgtctataatccacatcagagcagatgctgttgtttgagggggagggtgtcaggttctgtattagaccaggcagatggaaccttgattcatgaggactgaggttaaatacccaaagtcctaacacccagtcttcaagggaaaccatgagtagtggtctggacttgggaccacatgccctcgtggggaccttttccagtgagtctttcattgacgtgtaattggcaatgtaaaagtccagagtttactgctcagggacccacattcagatcaagatatagaacattgtcctaacctctaaaagctcctggtccctttgccaagtccctgaagaaaccactgtcctgatgtctgccaccctcttttagttttgcctatttttaaacaaaattgagttagactcatgcagcatgaactgttttatatttggcttacgctgttcaacttaatgttattgaacctgatttgagtggctgcgtggatcaatagttgcattgtatgaacataactcagggtgattcattcttctgttgatggattcttggatcatttcctgtttggggctattaagagtaaaatgaaatatacaagtctctttctttctttctccctccctctttctctctctctctctctctctactctctctctctctctctctctttctttctttctttctttcttcctgcatagatttactaatttcttgacccaaggagtggaattgctgattcatagggataggcatgaggttaactttgaggaagtctgtgctgagtggagagtgcattttgtcttcctctcagcaaagcctcaggattgatgactgcacagcttctctctgtgttgccagcccttcagcttctgtccctgtggtgggtagggagtattgccttgtggctctgatttgcattcccacaataatgactagcggtgtgagcagcttctgtgtgtggctcatcgaccatttgggtgtcgtcttttgtgatgtgcctgttcaagtgcctgcactgtcttccttatttgtggtagctatctattttgattgaacatcctttgctgaatatatgcattggctctgtcctaaggtatggttggctttcctccctccttaataatgtccagtgatcatgaatttcaattttgatgctgcctaattcatcattttttaattttatggttagtgatttttgtattgtatcaaaagaaaaaagcctcagtcttcatcgaggtcataaagatgcctggcgcatcttcttctgggagcctgtaaactcctcggttaaggtccatggttcatttcaggctctttggtgttccagcatggtgtaagggtggacatgtgttttatttaatagaaataaacggtggttccagcaccgtgtgcagcctgccttcctttgcacatgaaaattggccgtctgtttctgcaccctagttattcttttgatctatacatctctcaccatgtctcatcactccgaatgtagccttctatgctaagtcttgaagtttggcgatgcaagttctcgaaggttattccctttagttttttgttggctattctaggccttcacacctccataaaactgtgtcagcttgttagtgtctgcagtgtctgctcatgttggaattgcagttacactgactctgtgcattcgttgagagaaatctgatgttgtatcggtgtagaatcttgtcatgcctttttatagtatttctccattttcttgtatcttctttttattttttcttaaagatttatttattattatacataagtacattgtagctgtcatcagacacaccagaagagggcatcagatctcattacgggtggttgtgagccaccatgtgggtgctgggatttgaactcaggacctttggaagtgcagtcagtgctcttacccactgagccatattgccagcccatcttgtatcttctttttttttttttttttttttttaaagatttatttatttattatatgtaagtacactgtagctgtcttcagacactccagaagaaggcgccagatcttgttagggatggttgtgagccaccatgtggttgctgggaattgaactcaggaccttcagaagaacagtcgggtgctcttatctgttgagccatctcaccagccctttttttttttttttttttttttttttttttaaaaaatttatttattgattatatgtaagtacactgtagctgtcttcaaacaccaaaagagggcatcagatctcattacggatggttgtgagccaccatgtggttgctgggatttgaactctggaccttcggaagagcagtcgggtgctcttacccactgagccatctcaccagccccttgtatcttctttagtgactcttttttattatatttgttcctaaattattcaactattttttttgagacagggcttcgtttaattactcagactgccccaatttttttaaatgctttttacatttgtgtgtgtgttggattccctttttcttcccatgtccatattctcagtttcattaaatgctaagaatatactcaagtatagagaatacagttagtatgggtaattctcatttcaaccacaggtctctctcagccctgtctgcttatcatactggtttgattgcaccaatgaagatccgcaccgaggcccctgggaacctgcgtctgtacagtgggagcccaactcgcagtgagaaagagcaggtctccatcagttccttctattacaaggaacgggtaagtgtccgagccattgcctttagttcttaccccggctggattctcgtttcctgtcccactcgtgccacgcacagtagttaagttagtaatccctccctggtctttcactttcctaattagtttatgtaggaacagtcattgctgtgatgctctcagttggtctgcactactgtaaacgatgggtagaggtggtcagtgcttacactagactgtgacgtgtgtcttacactgtagtataaagtatctgtcctggcaatccccattagttgaattggttcccatatttcaagtagaataatttgactttgggtctcccatgatatcctgatgcctgtcaacagacagaaagctgaaagcttctgaaagctggagatcttgatggagttggagctttgtagttgtgggtgtaaagctgatccccagaagggtttctacttctacttaagtctgcactttaaggtctcatttgagtggatcggctgtacaaatgctatgtggacttgcccttatttatttatttttttaaacatggggggtctcagtctgtaactttgcttggcttggaactcatagagatccacctgcccctggctcctgaatgctgggattaaaggtgtgtgccaccatgcccagcttttctggggttcttaaggatgcagtgaccctaaaatacttagcattgagctggcaggagcctgcagatctggggaatgcctagaagtctgtctgctgtcaagctgagaaccaggcctcaacactgacaatcagtatttctgctgacctaccgcacaaacgtggccttaagaattcttcagcttcccacaaaacagggataatgactgtcagtaattagaatttgctttaacaacggaatcatttaaaatccaagggatagtttttccatcaagtattgcaagtgtccccacatgtgttgcagtggtgtgtcccccagctcctactgatggctgaccagctctgactgtctcggggcttatgtggctgacatcaggggcagcagctgacatttgggactgaccaatcttgggcaaagccatccagccaaacagggatgtggctctagttattgtcatgcctgccttcagtcctccacactccctctccccagctcccgggtggaattctgtccctgtgtctggcacagacctccttcaggcacccaccaaactctatctcccacaagtcattcatattaaatcaattagttcctttcccccttttcctgcaaggcagctgttacctgagtagatttgataattgggggagttagctggcctaaaagccatgtaaacttactgttaggtaaatgaaggctttatttagtatcagggctagtttgaagagatcccagagtcagaggcaattctggatgcccctttgattcttgtcccgtgctgccacccatgcttgcaatttgattggctaaaacagactatgtagatatttggcttggtgctcatgcaaagcccatctgtagtcagtgcccgagctcctgagccaggcaccagtgatgcccacattcatagttacaatggtctggccccttccctgcccactctgtgttcatgaggaagcacgagagagcatgtggctaaccatcctagcagctagaaaggactatgaaatttcagtgtgggccagctcctagaatgctgcttctccacaggaaatgggctgttctagtctgctctgacaaggaaagtagcctttaagtattttacataactgccaaataaaatggggagcacttttttttttaaatcacagtgtagcatgaaacctttgcactgatgtataccatatgatgtataccatatgatgtataccatatgatgtataccatatatgcacagtgaacttagctggttatagatgtgtagcttagagaattcacaggcacccaagtcaagaatggcatagaataattgtggaggtaaattgtgggcacttgcttatatttaaccactttcgatctaaaggtttcatgtggttcaatgtatttacgatgtccaaaacagatgtcagttgttttgtggttaatttgcaaccaccgcacctctccctgaggcttcctcatgcagtaatgcagtagtctctttaagctgagcaggctgacggagtggagcagtgggagccccatgctctcctgtgtgtggcctcgccctcgctgtggaggccgatgagtccgtcctgaggactgttttctcctcaggaggcctgcatccgtattaccgaccacttttgctctggaagtatttccagctaactgaaattttctgtgtccacatttttcttgtgtgcacttgacctctgcccctgagagtattcggagagggaggcagaaggaccgagatgggcctgcattaaggcctagcaaggagcaagtgcactgggctccccaggtctcgtgcagcctcctgcagaccatggtttatttctcttgtgtttttaatctgcctgacttaggttgaatttgcattcacccagtgttctctagatgaaattatgtttgctactaagaacttaagtgtaagtgacctaaagacctgtcaaatctcatatagatcagaaagcacagcacagattaggccaaagaaatattgtttattctggatcttctaataaatattgagcattgacctataggcattttccaaattttgcagcctctcatctctgcttcagtttccattactaaaatagctctgatgtaaataactgaagaggcctttaagttaatggagtaggatctgatctccacaaacagtatggtatactgcttatctgatgctggagtactagggagtgccctctcagcttagctcctgggtcccctggcattgttcaggaataggttttgcagtcctggtactaagacattcagtcaccaagctgctccccagccgcactgggaacagagcctaggaggaacaagagtgtgctctgctgtgttcttcacacctgtgaggcgacggggaaactctttgcttgtttctccacttgcagcaggaccttaggcctgccagagtccctcatcccttcttctaggttcctttgtcagagccctgttggcatcagcctccttatatcctagacagtgactagggggcaacaaaactgaagctgggcttgaggcaggtgggttgggggaggggaggggcaaaaacccctcccacctgtaggctcagcctttccagtcatcccagttcccatttgcagcatatatacctataaatccatcagatgtgggggaaactttcattttattctatatttttcccttttaattttcttggtgtttttcttcctcttcctgggtgtaacgttttcacgcacagatgtctcctcgctctgcccggcgacgttggtccatacaagcaattaacgacttcccggtactgtgcgctgtgcaaatgctctccttgactaatcctgtctctaccagaggcccaagaataaaatgccacctgcctggctttgaggaacctgaatgaaaggctggctggtgttcaggaccagcggcagtaaatttttcacctggcgggggcaggcaccaaggactgcctccttgccagtcagggtatttcaaatggggacacacttagggatcacctatgggcttctttgcgaatgaaactcactactgggttcttggaaggcaccctgaccgaatggcttcagctcacctgataccacttggggcacttctgcaaattgcatggagctttcaaaagcctgcctttggcatggggggagcagaggaagatagaagagacttttgccatttagccctgttttgacagcctctgtctgatacagagaggggagacctacttgcttcattggcaggctgtatgagttgattttatcctttgggtattttctggagcaaattttccttcttaccctggtattttgcattcataattaaatttgctatggacattctgtgttccttcctccttttcctactcattcctattggccatttcccctcctctgtcttcctctcccgcccccttcatgttttagtagtgccaaggtgtcctcacggcagccttgaggcctcaagtcaattttatttgctataaagaacgtttagagcaacacatcaacacccctgtcctagaaaaaccagttgaaaccggagcctgagtagcgagaaccacttctccacagcttgcaggtcgagccaccagcatggcctcttttcctcaaacatttgcttctatccggctcccttgctgagtttcactggtttcccgaagcccatttcccaccgctcttcacataggagctcatttggcttcctgcccactctgctgattatgcattgttgatggggttgctgcgaagcggttggtggcttattcttgggctaattttacatttaacctatttactggcattgatgttgcctcagattgtagcagtaacagtagaggtgcagtcacgagctggatagtgcttgtcacttagtggctccctccatccagcccccgcttccctgtcctctttgccatcttccacaaccacctcccaggatgtccacagggtcccagagcttatcgtgcaataacctgtctgccttgctttgtctctcttccctcagtctcttcccatgccatctatgaggaagggcattttctgttgatggagcactgaaagaccttgtctcccagaggtacccatttatcagtacagaaaggaatctatcttgagacctatcagaatgggactggagcagtgcagaagggcaaagggcaaagttttagaccatggtgcccttccatgacctggacagagtaaccgcacctcagccttgtagctccttgttctccataagcagagatcccaagagaaacttggtgatgttacttgacagctgtacagacagcaaagacccctaaagtacttcaaggtattaaggagaaagttaggcttagggaaaacagatggggtaggaatgtttcttattactcaaagtgtaggaaactctctaaaaaaattcttcatcttctcatcatggacatccaggacccaaggccctaactaacatctgtttgaaaatgtatcatatcttcatttaggaagccttcttacatttgaatttcaagaataactggccatttggtggctcactgaatgatccctgtaacctgaaggggagacgttagaactgccatgctacaaaactaaaaacaaacaaaagtacagcgaccactgctttgcccctgtgcgctgtcgagcagcgccttacagttattctttgctaaattcaaccagataagtaaataaaccaaaaccccacagaaacgaaaccatactacacttttgcgtttgtctcatactacacttagaatttcatccctggtggcagctacaatcacagtgacggtatgttggggaatctcctccattgcaggctgaggtagctgtgtgaggttccacagtcgtcttgtagacatccaatatgtagcagatggaaattcctggaagtttgttgtttggaaatggacagaccaatttccataattcaatgagggataattgcagaaggttgctgaataccactgcctttctgtttccaaggaattggcagctcagatttgtttgttttactgatctctataaccctgcaattgggattgtctgcagatgggagaagaatcttacgacatctctttggactctgatttttcttccctgatgcctaatcttaataaactcacaaagggtcacatacacagacacatccacacacaggcatgcatggcatattcttaagcccagcgggaagcctagcattcttgtgtgaatctggcttttacccagggacaacactgtgtcactgttctcttaaaactaaagactcagccgggtatggtggcacatacctttaatcccagcacttgggaggtagaggcgaatttctgagttcgaggccagcctggcctacagagtgagttccagaacagccagggctacacagagaaaccctgtcttgaaaacaaaacaaaaacaaaaacaaacacaaactgaagactggcaatagagagcctggtaagcaccgctgttaacagcaaacaaacaacagggcctccttcagccaacggccctgagttagcagcatacgctcacaatgcctgagagggaagtgactgggaaagtagtcacagaaggatgcttaagggtcagcatcccatgtcctgatgctgatctgcttaaagacagaccacactactcacattactggcacattagattagtgagggcttaattttttacctttgttgattcttaaaataacagtcagtactgaaaagcaagtcagcaaaagtggacttagctggggtagggtatatggcttaggtggtaaagtgcctgccacacaagcgtgaggacctgtattggatccctggcaccagtataaaagccagacccggtgatcaggcctgtggctatagccctagtcttggagttgggcagagacagattattggccagccagtccaccccaatcttgtgagttccaggttcagtaagagactctgtgcctattcccccaatagtataattgagggggaccccagaagttgacctctgcacacacacagaggagcgtagcagcttgatagacctatttaaatttcagctccataactgtgaccttgtgtaaggttcatgtctccatttacaaaatggaggttatgc

SEQ ID NO: 1382 - DNA, 1562 bp, Mus musculus
gcaactgccatgtctgtggactgtcttgggcagcatgcagtgctttctggccgacgattcctgtacatcgtcaatctagatgccccttttgaaggtcaccggaagatctcccgccagagcaaatgggacattggagctgtgcagtggaaccctcatgacagcttcgcacactattttgcagcttcgagtaatcaacgggtcgacctttataagtggaaagatggcagcggggaagttggtacaactttacaggggcacactcgagttatcagcgacttggactgggcagtgtttgagccagatctcctggtcaccagctctgtggacacctacatctacatctgggatatcaaagacacaaggaaacctactgttgcactgtcggctgtagctggtgcctcccaggtcaaatggaataagaagaacgccaactaccttgccaccagtcacgatggtgacgtacggatatgggacaagcgaaaacccagtacagctgtggaatatctagcagcccacctctccaagatccacggcctggactggcacccagacagtgagcacatctttgccacctccagtcaagataactctgtcaagttctgggattaccgccagcctcggaaatacctcaatatcctcccttgccaggtgcctgtctggaaagccagatacacgcctttcagcaacgggctagtgaccgtgatggttccccagctgcggagggagaacagcctgctcctgtggaacgcgtctgacttgaacgctccagttcacacctttgtgggtcatgatgacgtggtgctggagttccagtggaggaggcagaaggaaggatccaaggactatcaactggttacatggtcccgtgatcagaccttgagaatgtggcgagtggactatcaaatgcagaggctctgtgccaatgacatactggatggtgttgatgagttcattgagagcatctctctcctgccggaaccagagaagaccccacatcctcaagacatagatcaccagcccagcttaagccatggagaggaagatgccataaaggaagaccctcccagcagtttgctggaagagaagagatcagaccaactaggcctcccccagactctgcaacaggagttctccttgatcaacgtgcagatccggaatgtcaatgtggagatggacgctgcagaccggagctgcacagtgtctgtgcactgcagcaaccaccgtgtgaagatgctggtgaccttcccggcgcagtaccctaacaacgctgctccttccttccagttcattaatcctaccactatcacgtctgccgtgaaggccaagctgctgaagaaccaagaggacagtgcttctagcaacccatttgcactccaaaactctgtcacaccacccttgccgacatttgcacgggtgaccactgcctacggctcctaccaggatgccaacattccctttcctaggacctctggggccaggttctgtggagcaggttacctggtgtacttcacacgacccatgacgatgcatcgagcagtgtctcccacagagcctactcctag

SEQ ID NO: 1383 - protein, 521 aa, Mus musculus
  VARIANT (1)...(521): Xaa = Any Amino Acid
ATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANYLATSHDGDVRIWDKRKPSTAVEYLAAHLSKIHGLDWHPDSEHIFATSSQDNSVKFWDYRQPRKYLNILPCQVPVWKARYTPFSNGLVTVMVPQLRRENSLLLWNASDLNAPVHTFVGHDDVVLEFQWRRQKEGSKDYQLVTWSRDQTLRMWRVDYQMQRLCANDILDGVDEFIESISLLPEPEKTPHPQDIDHQPSLSHGEEDAIKEDPPSSLLEEKRSDQLGLPQTLQQEFSLINVQIRNVNVEMDAADRSCTVSVHCSNHRVKMLVTFPAQYPNNAAPSFQFINPTTITSAVKAKLLKNQEDSASSNPFALQNSVTPPLPTFARVTTAYGSYQDANIPFPRTSGARFCGAGYLVYFTRPMTMHRAVSPTEPTPX

SEQ ID NO: 1384 - DNA, 95960 bp, Homo sapiens
  misc_feature (1)...(95960): n = A,T,C or G
tctcctgcctcagcctccctagtagctcggataacaggcacgtggcatcataaccagctaatttttgtatttttagtagagacggggtttcaccatgttggccaggctggtcttgaactcctgacctcagatgatccacctgcctcagcctcccagagtggctgggattacaggcttgagccactgcacctagcctctttctgttatgtatttatttgttatttattattttttaattgtgtggttacaaagtggtgtctttctgttttatgcatttacttatttagagacagagtctcactctgtcacccaggctggagtgcagtggtatgatctcagctcactgcaacctctgcctccgggttcaaacaattctcacgcctcagcctcctgagtagctgggattacaggtatgtgccaccatgcctagctaatttttttttttcttttttgtagagatgaggtttcactatgttggccaggctggtcttgaactcctggcctcaagcgatccacccgccttggcctctcaaagtgctgggattacagccatgagccaccacacctggccttgtttttttaaatcacattttttggtaattgaatggatttctttttgaagtgatgaaaatgtttgggaattgggtaatggtgatgcttgcacagacttgtggatatactaagaactgctgaattatacacttagaagggtgaattttatggcatctgaattacactagcataccatatagatcaataagtattggtggggcgtggtggcttaagcctgtaatcccagcacttaggtaggctgggcgggtggatcacttgaggtcaggagttcgagaccagcctggccaacatggtgaaaccccctctctactaaaaatacaaaaattagccaggtttggttgtgcaggcatgtaatctcagctactcaggaggcggaggcaagagaatcgcttgaaccagagaggcagaggttgcagtgagccaagagcacaccactgcactcctgcctgggcagcagagtgaaactctgtcttaaaaaaaaaaaaaaaagtactgaagcaggcagtgacaatacagtatgacaggtaagcctagaatggtgcctgacatgtactaggcactcaataaatattgttgaattaatgaatgaatgaatgactaaatggtatgagggagaaagagtatggtgctgaaagaaaggcaagagacaggaatagaccattccaagctgatgcctgaaaggtgagttggagatcagccaggcaaggaggcagggcagggaaaaaaactgtgtttcaggaagagaatactgttccaggcaaagggaacagcccagatgtgagagaacatggcatattcaaggaactgaaagaggctatagtgctgcaatgcaagggggtgagagccaaagatgaatctgttcctcaggggcaggcaagagggtcctgtgagccatggcaaggagcgtggtccccatcccaagggcatggggagctggaaagcctttatcagcatcatgagatgctgtctatctagcaccagcatcattggtgctatcatcagcaccaataggaatggcctcccagcactttgggaggtcgaggcagacagattacttgagcccaagagttcaagaccagcttgggcaacagcaagaccctgttctataaacaatacgaaaattagccaggtgtgttggcacgtgcctgtggtcccagctacttgggaggctgaggtgggaggatcgcccaaacctagggagattgaggctgcagaaagccgttatctcaaaaataaaaaaaaggaaaaaataaattttgatagatgatagacaaaacatactacatgcacattaatggtcatgcagctagtaagagcagagctgggctttttattttatttttttgagatggagtttcgctctgtcgcccaggctggagtgcaggggcaccatctcagctcactgcaaactccccctgccgggttcacaccattctcctacctcagcctccagagtagctaggagtacaggcacccgccaccatgcccagctaattttttgtatttttagtagagatggggtttcacgtgttagccaggatggtctcgatctcctgacctcgtgatccgcccgcctcggcctcccaaagtgctgggattacaggcgtgagccacgacgctgggccagagctgggctcttaagttttacggtgaacatgctcatcaaggaattttttttttttcttgagaacagggtcttaactctgtcacccagctcgaagtgcagtggtgcaatctgggcttactgcaacctctgcctcccaggctaaagggatactaccacctcaccctcctgagtagctgggaccacacgtgcgtgccactgtgcctggctaagttttgtatttttttagagacagggtttcaccatgttgcccagactggtcttgaactcctgggctcgagcaatcctcccgtctcagcctctcaaagtgttgggattacaggtgtgagccactgcacccagccgaggaattcttccaatgacaattttgttttctctgtatactttccaaaggggtgaaaaagactagatctacttaacagctgtatttctttttgtgaattaattatttggccttaagatttacattccagtgtgctgattattataagtcacctctctcatagctggcaccactgaacagctgagatcttgtactgcaaaggtgaagcccctgctctgtgcaatgtgattgcactcagcttaggtgccctgtgggaccccgaatggtagcctatctcagaaaatgtcctgttatggctgggcacagcggctcatgcctgaccaacatggtgaaaccctgtctctagtaaaaatacaaaaattagccaggcatggtgtcagttgcctgtaatcccagctactcgggaggctgaggcgggagaatcgcttgaacccgggaggcagaggttgccgtgagcggagatcgcgctactgcaccccagcctgggcaacaaagggcgactctgtctcaaaaaaaaaaaagaaaagaaaatgtcctgttatcttgttttgtactaacaataaaccactgatccacttaccacaacagtcaggaggaagagctgataaaatttttgctgccaaagccctttggaaatgcgagtgcatatctattctattatagaaagcctgggactttcactattcagaaaataggggaaagggcttgtgagggcctactcctgagaagcagtggggaactcccatccacctccctgtttctgtgagccagaggaaggcgagggtttcccatggctttggagggcatccccagcacccctatcaccccactgggggtggacaaatgccttttagtgagaaacttcctcccaggccctctcggagctctttaaattttattgttttgcttgaaaggagacagcttagagaaatcaggataatgagtaaccaaatacacatggccgggaggctgagcacaggaccatgttcataaatatttgttgattgatgaagagagggaaattattactgggactcagggccagggtccaaggttcccagatgtaaatgaactgagtagtcagctagctccaaattctgcagaagagcaaacagaagactagaaagataaaggatcatgttcaaattgcatggctagttgctgataagagcccagcccaggccctggatttctgggtttgctgtgtaccctgctttcctgccgcttggctagcaagtgacctgaaaaaacacagtttcatgataaatcctctgtggcaaagtgggatctacttgacaaaggaccctcagtggtccccagcctctgattcagatgcaaaatcctaagtcccccaagttacagaatggaccaccctcccccaggccaaggggactccagagaaacctgaaaaactgaatttctggccatcgtgggaaagaaggtcattataccccccaccttttcgagtttaggcataactgaccagcgttaaggttgaaatagagatcataagactgacagaacagacgctttgtggcaataagataccgaattccaacctgactctggtatagcatcatataacagacagcagaccctgaaggaaataaaagtattttaccccaaaatatatttctttggcgtagtttgaaatggctcttcaaagcactctgttgtgggggaaattttgcatcgtagagaacgcagctgagactttcctgcatttaagagagattaagaggccgagcgtggtggctcacacctgcaatcccagtactttgggaggccagcggggcgggaggatcgcttgagcccaagagttagagatcagcctaggcaacatagtgaaaccccatcctaattttttttttgagacaaggtcttgctctgtcacccaagctggaatgcagcagcgccatcttggctcactgctctgcctcccgggttcaagcaattctcctgcctcagcctctggagtagctgggacagcaggcatgtgccaccacgcccggctaaattttttttgtatttttattagagatgtggcttcaccatgtggtctggaactcctgacctcaaatgatccacctgccttggcctcccaaagtgctgagattacaggcgtgagccaccttgcctggccttaattttttttttttaaagagataaactgatattgacaccttttaaggccctgagaaatttactgcctattctctctgaaggctgatgcctgtgaaactttgtcttcataacaagaaccttggtctctatagcgtccctcatattaactgaaacatttctttctattgacttcaagtctttagacacagttgaactcttttaaccaattgccaatcagaaaatcttagactccacctaagacctgtaaccaccccctccaaggtatcttgcttctttaggctgaatcaatgtataccttccatgtattgacttatgattttacctaaaattcctgtctccctaaaatgtacaaaaccaatgtataccctgaccgccttgggcacactttctcaggatctcttgagactgtcccccaggccatggtcactcatatggcacgcatatgggctcagaataaacctctttaaatattttacagagcagtaatttgggaggctaaggtgagtggatcacttgagctcagtagtttgagaccagcctgggcaacacggccaaaccccatctctataaaaaatacaaaaattagccaggtgtggtggtatgcacctgtggtcccagctacttgagaggctgaggtgggaggattgcttaagcctgggaagttgaggctgcagtaaaccgagatggcaccattgccactgcactccagcctgagtctggaaatatagtctccaaatacatacaaaaagtctccaaaatacatacaaaaagtttgattttgattttgtttgattttttggtcaacatggaaagaacacttacatggggatctcagtgtgtgaatagcaatgaagaagcagccagagagctctggatgttgctccagagtccccactctttctctctctccttccttccttcctttctttctcttccttccttcctttcttcttttctttcctttcttttttttttttttttttttttttcttaaaagggatttttgccccggggccgggggggnnnnnnnnnnnnnnnnnnnnttttttttttttcttcctttccttttttttttttttcccttttttttttttttttttttttttttttctgagacggagtcttgctccgttgcctgggctggagtgcagtgacttgatcttggctcactgcaacctctgcctcccgggttcaagcgattctcctgcctcagcctccggagtagttgggattacagggcacctgcccccacacctggctatttttgtatttttagtagagatggggtttctccatgttggccaggctggtctcaaactcctgacctcaggtaatccgcccgccttggcctcctaaagtgttgggattacaggcgtgagccactgcacctggcagagtccccactacttcatgacagtgtcatgacatatgggtgggagactccaaagcaggatccgaggaggcaattggaaaggttctcctgctccctctccccaaaattctgctgaacctttttcctacttaagaaaaaaaaaacattgggagaacagagtgcaccaaggacttgaaagccaaagtactatctttgcctatgaaccatgacaggcagattttgagaactagataaatatgaactaaagaggtgggagtgggggagggttgcagaaatgctcaggcacgatgatcttagatcccactcattttggtgggaagcaaattaacaagctatgtacacaaagacagagagctttagaagagctatgtctctatttgtatgtatgtccaaagtaaaactcaaacgcctaagcagggctttctttttttttttttgagacagattctcactctgttgcccaggctggagagcagtgaccctatctccgctcactgcaaactccgtctcccgggttcaagcgattctcccggcctcagcctcctgagtagctgggattacaggcgcctgccaccatgcctggctaattttttaattttttaattttatgtatgtatgtatttatttttttttgagacggagtttctctgtgtcgcccaggctggagtgcagtggtgccatctcggctcactgcaagctccgcctcctgggttcacgccattctcctgcctcagcctccctagtagctgggactacaggcgcccgccaccacgcccggctaattttttgtatttttagtagagacggggtttcaccatgttagccaggatggtcttgatctcctgacctcgtgatccgccctccttggcctcccaaagtgctggattacaggcgtgagccaccgcacctggcctacggtgggtttctaaagaaaaagaaggggcagttcctaaagtctttactaagaatttacctcaaaataacataagctactgattggctatacgttgttctttgtatcacaaattcgagaaacatgaagataatggatgaggtagccagtcaggaatgaaatgactttaattttaatttttttttagagacagggttttgttctgtcacccaggctggagcacagtggcgcgatcatagctttttgcagcctcaacctcccagactcaagcagtcctctcacctcaccttcccatgtagttgggactacagatgcatgccaccacgcctggctaattttaatttttttttttttagagatggggtcttgccatgttgtccaggctggtctcgaactcctggacttaaatgattctgtcaaataacaggtgtgagcaaacacgtccagcctttgctcacactcttaatggtgaagtgtttttttttttttcatagtgtactgtatcaatatcttaacattatactgaaaagctcagatgtcgggccggatgcagtggctcacgcctgtaatcccagcactttgggaggccgaggtgggcagatcacgaggtcaggagatcaagaccatcctggctaacacggtaaaaccccatctctactaaaaatacaaaaaattagccggatgtggcagcgtgcgcctgtagtcccagctacttgggagctgaggcaggagaatggcgtgaacccgggaggcggatcttgcagtgatccacccaccactgcactccagcctgggcgacagaaggagactccgtctcaaaacaaaacaaaacaaaacaaaacaaaacaaaacaaagctcagatgtcatattcttcaagatttcaagatgccatttcgggtcgcctatttaggcttttctctcctgccatattgcttgcaaatctattataatatacaagtcattctgccaagcacattcctgttgtagagtaaccagttgtcccagtttgcctggaacttatgggtttcttgggatgcaagactttttggtgatgcagtgctagaatatgaaaagggatcaggcatggtggctcacacctatggtcccagctaatccagaggctgaggccggaggatcacttgcttgaagccactactttgaaaccaccctgggcaacacaacgagaccatctctacaaaaagtaaaaaaaaaaaaaaaaaaaaaaatagctgggcatagtagcacatgcctgtagtcccagttacttgggaggctgaggcaggaggattgcttgggcccaggagttggaggctgtggtgagctatgctcacaccactgcactccagcctcagtgacagaacgagaccctttctccaaaaaaataaaaataaaacatgaaacggtccaggcaacaagttagtcacccgtaatctgtcaacaagtctgtcttcccccttatagccaatactccaggagggaagagaccacactttcttacctctattcatacaatgacttgcacatacaaatagtgataatattaacaacaacaataacagtttattttattttatttttattgatttcctggcttctagaactgaattaatagtttatagttgagcttttctacatcccaggccctgtgcttagttccttacaacaatccaatgaggtaagccatttttcccttctatagggaaactgaagctaaaccagttaaatcaacatttaagagtgtgggactgaaaaggaaacttaatcaccacccaccatgttagtacagtggttctcaaactttttgatcttggaatccctttacactgctgttaaaaattactgaaaatcccaaaaaaactttttttttttttttgacaaggtcttgctctgtcgcccaggctggagtacagtaatgtgatcctagcttactgcagcctccttctgggctcaagccatccgtccacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctcaaaaaaaaaaaaaaaaaaaaaaaaaaagaaaaggaaagaaagcagctggattgcaggagggggtatagctcacaggtagagcattggactacagatcaagaaaacagctggattctcacatttaagtctaccttcattgttacgggaggcgctgctgtattgtatgaaacaataaattgcacattcagacttttaaatatctcgatgggataggcatcaggagaagaggtatcttcggtttgcacgagctttgatttttcttttttctttttttttccgagacggagtctcgctcttgtcacccaggctggagtataatggcgtgatctcggctcactgcaatctccgcctcccgggttcaagcgattctcctgccccagcctcccaagtagctgggattacaggcgcccgccacccggctaatttttgtatttttagtagagacggggtttcactatgttgtttaggctggtctcgaactcctgacttcggcctcccaaagcgctaggattacaggcgtgagtcaccgcacccgccccgaacgttgattttgatttgagactgggtctggacgaatgctggggactccagcgaggagctagtgaggacaacaggcacctcacctcacccaaacccaaacctgcgagcccttcccaggtcacccacgcttgctcgagcttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggtgagctagaggccgagtggagccctctgggcatgcgtcctccccgcttcccctcccccacgcggctgcttccgtcccggggggctacggggagaccctaggccccgtactgaggaggtgggcggggcttagccgacctcttaggccccgtcgggggagggaagacgaccatcgggggcaatcggggcgagcatggacggagtttcggggctccctacgcgggtaggggagtggggtccgccttgtgacactgaggcagagactgcgcatcgtgagtgctgaggggaggcttcccacaatcagggtacggagcgagggcgtgacggcttcccgaggccctagccgcgtgtggcgacttaaggcaagtcgcgggacttttctaagtctcagctgcgtggacgtaaccctgttggggtgaattcgatgaaacactgtttgcaaagtgcctgttgcagcgtctacgcggttaagtggttcttaatgccatcatactggaaaataccgtgtagtggataggagtgacactgcacgtgttgcccgagttcgaatcccgcagcccctaccctgtcatcactccgtacacgtcagttttctcacctgtagaagggagatggtcgtacttacaagattggcttaaagattttattttttaattttctatttaatttaatttaatttattttttttgagatggagagtcactctgttgcccaggctggagtgcagtggtgccatcttggctcactgcaacctccgcctcccggattcaagcaattctcctgcctcagcctcccaagtagctgggattacaggtgcgcaccaccacgcccggctaatttttgtatttttagtagagacggggtttcaccttgttggtcaggctggtcttgaactcctgacctcaggtgatccacccacctcagcctcccaaagtgctgggattacaggcgtgggccaccgtgcctggcctattttacttcatttgagacagggtctggctctgtcacccaggcttgagtgcagaggcgtgaatcaccgctcagttcagcttcgacctcctgggctcaagctatcctcccacctcagcctccccagtagctgagactacaggcgcatgccaacacgcccgactaaatttttcatttttttttgtagagacggggtctccctatgttgtccaggctggtatggaactcctgggctcaagcgaaccccctgcctcagcgtcccaaagtgttgggattacaggtgtgattcactgagcacagcctcgagtgaagattttatgtggttgtatgttgaggatgtgtggcacacacagcattgggatttggatgctggatcctaccccagagcccttgtttagctcattggactactttactcatagtgggtagctctgaaccggtcatatacatcccctcttccccagcacctaggacagtgtcttggtgattctcttcaattttaaatttatttacctttttttttgagacagagtctcactctatgacccagactgtagtgtagtggcatgatcttggttcactgcaacctctgcctcccaggttcaaacgattcttgtgcctcagcctcccgagtagctgggattacaggcacgtgccaccatgcctggctaagttttgtattttttgtagagacggggtttcgctctgttggccaggctggtcttgaactcctggcctcaagtgatccatctgccttggcctcctaaagtgctgggattacaggtgtgagccactacacctggcctattattttttgtagagacagagtctctttgtgttgcccaggctggtcttgaacccctggcctcaggcgattctcccactttggcctcccaaaatattgggattacaggtgtgagcgactgtgcctggccattcttttcatttattcaactaatatttatcaaataccttctgtgtgccacacttttattcactcatttattcaacaaggatttactgagctcccttcaggtatacactataccatgcacaggtgattcatactgagggagatctggataagtatgaatgggtgatgtggtttcttctttccaaaaccccatcctgtcttttgccggagaatgagtgagtggaggagctacccaccattttgctctgtggtgccctctgatcagtagcctctactgagaatttgagcagtagcatttggattaaggacccccaagtactgtcagcacagagtctccgtgagacctgctctccctagggaggcgccagactccttggaaaaggaaccatattcctgttttctttcttgttaattgcttttactggcaactaggacagaatagaatcatgtatcatgcctctaagcctgctaatttggaagctactaatctgcaaaccctttaattttcacagaaacccaggtagtctcacccctgcctgtttatagagatgtaattgaagagacctgcagagagggtgctgacacatatattaggatgctatgaagtcgtagcaaataattaaacctcaacagcagttgtcacagtaagagaacaaagtaaattgggtaattttactgccttgtgggagtttctgtttttttgttctgattttcctatttacaaggcttcctctttatgtgaattagcatggttttgtgggtgattctggtgatgattggaaggggcaggaacccattttattaactattttgttaatgtagaaagacaaagttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagtggctcatacctgtaatcccagtactttgggaggccaaggcaggcagatcgcctgaggtcaagagttcaagaccagcctggccaacatggtgataccctgtctctactaaaacacaaaaattggccaggcgcagtggcccacacctgtaatcctagcactttgggaggctgaagcaggtggatcacctgaggtcaagagttcgagaccagcctggccaacatggtgaaacctcgtctctactaaaaatacaaaaattagctgggcatggtggcaggcacctgtaatcccagctactcaggaggctgaggcaggagaattgcttcaacccaggaggcagagtttgcagtgagctgagattatgccactgcactccaacatgggcgaaaagcaagactccatctcaaaaaaaccaattttacacactacttgcaggtaatcttccagagcaacactggttttttgtttgtttgttttgttttgttttgttttgttttgagacagagtctcactctgtcgcccaggctggagtgcagtggctcgatcttggctcactgtaagctccgcctcccgggttcatgccattctcctgcctcagcctcccgagtagctgggactacaggcgcccgccaccatgcctggctaatttttttgtattttttagtagagatggggtttcactgtgttagccaggattgtctcaatctcctgatctcgtgatctgcccgccttggcctcccaaaatgctgccaccgcgcctggcccagagcatcactgttttgtagaacttccagtgatgatggaaatggggctagtgcgacagatgtattttcaattttatggcattttaattgccatttaaatagccactgtggctaatggctatgatattggaaagtacagttcagagtactgagaagtgtggagattagttttcactctcaaggaaaggtaagatgctggaatgtgcagttacaaggctaacctaatgatatttgcaaaagtgctgcagtggatgactcctgtgttgaagagaagaactgcagacccacggtggctgcctacttcgtgtctccacttcaggatctgcgagaaaatcaagctctgtatgtccaaagcagctgaacatacttggagacaactcttccctcacagtagcatttccttcttccattttatcttccatatagccagagtgattaaaaaaaaaaaatccaggtttatgcaggtataattgtagagtttgttgggttttgacaaatggatgtagtcatgtaaccactgccgtaatcatgatgtagaacgtttccatcactccaaacagttccttggtccccctgtgtactcaatctccatcccttatctctggcagctgctgatgggatttctataacaaatggaattatgtgatatgatgtgtagccttttgagtctggctttcatttttgttttgttttgttttgttttttgaagggacagaatctttctcagttgcccaggctggagtgcagttgcacagtccttgctgagtgcagcctccagctcctgggctcaagtgtcctcccatctcagcctcctgaataactgagtcgacaggcatatgccaccaggcctggctcttttttttttttttttttttttttgagacagagtctcactctgtcaccaggctggagtgcagtcgcacgatctcggctcaccgtaacctctgcctcctgagttcaagcgattctctgcctcagcctcctgagtagctgggattacaggagcccatcaccacgcctggctaaccatctttgccaggctggtcttgaactcctgacctcacgatccacccaccttggcctcccaaagtgctgggattacaggcgtgagccactgtgcctggccagtcctgggtaatttttaaaaattttttgtgggggtggaatctggctgttgatgcccaggctggtcttgaactcctggcctcacacagccctcccaccttggcctcccaaagttttgggattacaggcatgagccaccaccctacctggcgtcttttgcttagcctagtgcttttgagattcattcttgttgttgagcctatctgttagtgcattccttcttcttgctgagtagtgttccagtatatagactgcaatttgtgtattcattcacctgtttatggacatttagtttttttccagtttttagtgactgaagaaagctgctataagtagataagtatcaaggccaatttttatttattgatttatttatttttcttttttgagacagaatcttgctctgttatctacgctggagtgcagtggcacgatctcagctcactgcaagctccgcctcccgggttcacgccattctcctgccttagcttcccgagtggctgggactacatgcgcccgccaccacaccctgctatttttttgtagttttggtagagatggagtttcaccgtgttagtcaggatggtctcgatctcctgacatcgtgatctgcccgcctcggcctcccaaagtgctgggattacagacgcgagccaccgcgcccggctgcattgtctctttcttatagattaagaagagtgtaaaaatttttctggattccagttctgtatggttatatatattgtaaatccattctcccaagttgtagcttgccttttcattctttttatggtattaaaaatttttttttaatttaaattaaaattttttttttgagatgcgatctcgctgttactgtggctggagtgcctattcacagtcacgatcatggtgcactgcctccttgaactcctggtctcaaatgatcctcctggttctgcctcccaagtaactgtgtctgtatttgtgagttaccactcccagctatgtgctgtcttttgatgaacagaactttaattttaatgcagttaaatttatggattatgctttttcagtcttgttgtttttgttttcagacagggtctcgcaatgtcgcccaggctggagtgccgtgattttgaatcagtgcaacctctgcctcctgggctcaaatgatcctcctgccttggcctcttaagtagttggaaatgcaggcacacaccaccaggccgggctaatgtttgtattttttatagagccatgttggccaggctggtctcgaactcctgggctcaaatgatccacctaccatggcctcccaaattctttttaagtcttcttaagaaaaatgtttaggccgggcttggtcgctcacacctgtaatcccagcactttgggaggccaaggtgggcggatcacaaggtcagaagatcgagaccatcctggctaacacagtgaaaccctgtctctactaaaaatacaaaaaattagccaggtgtggtggtgggcacctgtagtcccagctactcaggaggctgaggcaggagaatcgctcgaacccaaaaggtggaggttcagggagccaagattgcgcccttggactccagcctgggcgacagggtaaggctgcgtctcaaaagaaaaaaaaaaaaaaagaaaagaaaaagaaaaacgttcgtatcctagattcataaagaaattcctcaatattttcttttatcttgaaattgaaaatgaatcatctcagcagaaagtatactctcttctgacctaataatggttggtgatttattagtctcagcattgcaacagctttgccacaaagataaagattgaggactgtgttttactctaataaaaactaaaataaaaaagcacaactcaaattatttggctaggagcaaaattataagtaattaataatctgtgtgtttttctggagcaatccagcttcggttcctacttttttagtttcatacaatgttcattttgaaaaactatagagatggaggggcagaataggactttttggtgtaagtgactattaatatgtatactgtgaaatattttttcttttttaaataaatttatatatgtgtattttaacatcgagatgggggtctcactgtgttgcccaggctggtgtcaaactcctgagtttaagtgatcctcccaccttagcctcccaaagtgctgtgatcacaggcatgagccactgcacctggcctattttttttttctagaaaatttaatataaagatgtggtgatgaatgggagaagaacaaagacgttaaggatttcgtgccagactgtgttaagatttaggttatgccacctgtcttccatgtgatcttgggcaagttacttcctttctaagcttcagttttcttttttaaatttttttttcttttttttactttttttttttttgagacggagtttcactcttgttgcccagactggagtgcagtggcatgatctcggctcagtgcatcctccacctcccaggttcaagcaattctcctgcctcagcctcccaagtagctgggattacaggcgcctgccatcatgtccggctaattttttgtatttttagtagagacggggttttaccatgttggccaggctagtctcaaactcctgaccttaggtgatccacccgtcttggcctcccaaagtgctggaattacaggcataagccactgtgcccagccttgtttttttttgttgttttttgagacagagtattgctgtctcccaggctggagtgcagtggcgcgatataggctcactgcattctccaactcctgggttcaagcgattctcctgtctcagcctcccgagtagctggaattacaggtgtgtgctgccatgcctggctaatttttgtatttttagtagagacgaggtatcgccatgttggccaggctggtcttgaactcctgacctcaggtgatccaccgaccttggcatcccaaggtgctgggattacaggtgtgagcctctgcgcccgactgacttccttcattcataaaacaaggatagtagtgcctacttgtgttgggggttccccaggccatgccaggctcagtgacttataaggaggcttcacagtcatatttgcagtcattacatattacagcaaaaggacacaatgcagaatcaaagggaaaaggcaaatggcatgaggtcagaaggaaaccaggccgaagcttcccagagtcccctcactgtagacgcacacagtatatgcttaattcctttcgtgtgtaactggaacaatgtgtgagagacattgtgtaccaaggaagttcattagggactcagtacccacaatttctatttagggctggtcatgtaggcaccgtctgccttaacaggtaccaaaattccagaccttcagaaggaaagtaggcactcagcgtaaactacgtcgtttgtacatacagttgaggcacagggaggctctcttactagttaaggagcagtggaaccctcctaaaatccacgttctagatagcagccaagagccacccttgcaagcaggcctcgcaaggatagtagtagcctcatgcccgctgtgccaactcttttctgcatactaccttgtagactagctgtgaggattaaatgacaatatcagtttggaacacctagcgtagtggtcggtatatgttaagcagttgataaatgttgattaccattattattaaattagaaaactggcctaaggaagcaacacacttggcctgacaaaatagccctctcctctgccctgtcgttttgcaggtgaggagtgtgagccccagaaagattaggtgacgtacctagtagtacccagtgcgggccattttagtgtgtgggaaagtgagactgtttccatttaattaaatttaattaatcaattgatttttttctttgtttttgagatggagtcttgcttttcgcccatgttggagtgcagtggcataatctcagctcactgcaaactctgcctcctgggttgaagcaattctcctgcctcagcctcctgagtagctgggattacaggtgcctgccaccatgcccagctaatttttgtatttttagtagagacgaggtttcaccatgttggccaggctggtctcgaactcttgacctcaggtgatccacctgcttcagcctcccaaagtgctaggattacaggtgtgggccactgcgcctggccaatttttgtgttttagtagagacagggtatcaccatgttggccaggctggtcttgaactcttgacctcaggcgatctgcctgccttggcctcccaaagtactgggattacaggtatgagccactgcgcctggccgaattaattaatttttaattttacaatccaccatgacattcaaagaatgttctcatttaaaagagaagacttcctgagcaacacccctattgctgagcgtgtgaacaagagtctccgataggtaacgtgtagtgagtattagacaaggatggctcagaaactgttgggccaagcatggtggctcacgccttgtaatcttagcactttgagaggccagggccggtgcatcacttgagcccaggggttcgagaccagccggggcaacagagtgagaccccatccctacagaaaatgaaaaacttagctgagcatggtggcttgtgcctgtggtaccatttactcaggaggctgaggcaggagaattgcttgagcccaggagtttgaggctgcaacgccactgtgctccagctggggtgatggagagagaccggcccccccgccaaccccaatctaaaaagcaaaacaaaacaaaccagctttggcagcagtgttcatatataattttatggtttttgagacagagttttgctcttgttgctcaggctggagtgcaatggcgcaatcttggctcactgcaacctctacctcccgggttcaagcgattctcctgccttagtcttctgagtagctgggattacaagcatgcgccacaacacctggctaattttttgtgtttttagtagagatggggtttctccttgttggtcaggctggtctcaaactcccgacctcagacctcaggtgatctgcccgcctcggcctcccaaagtgctgggattacaggcgtgagcgaccgtgcctggccaatatctaatttgaatagaaattggatcttgtcctctgaaatggtcggacccttttaataatcagtggttttcagtttgtggctttagtctgtaaaacctctttttttttttttttttttttttttttaagacagagtcctgctctgtcacccaggctggaatgcagtggctccatctcggctcactgcaatctccatctcccaggtttcaagtgaatcttgtgcctcagcctcctgagtagctgggattacaggtgtgcgccaccacgcctggctaatttttgtatttttagtagccatgttggccaggctggtctcaaactcctaacctgaaatgatccacccaccttggcctcccatcgtgctgagattacaggtgtgagccaccgtgcctggcctagacatgagttttaatctaattctgactgcaaagccgatgcataccgtttctgctgcaccaggctacctccattttatgcctggagaaagggcagagtttttcctccctttgataaattgtggtctgttgctttggattgctgaaaccaagtgcttcagaacactgttgcctttggaagttgactcaccaagaaattttttaaacgaggacagcagcaatttgtagtctaatagagtctcatggaattgatttccttcattagccatcagttagcttgacgtttccaaattattatatttactccaagagaatcagaatcaaatatcaccatcaattctcatttcataaagggcatgtaaatcctaaagtgttaagtgtgccaaaagtcaccatccttctttgcagttgaaggaacaaagacttctaagaacttcattctcttctgtttaaagatacctgttttgatagagagcagtcctggacaataagtttgttttcctacaattgaggaggacttttcagtatggaaaagcaagagtttggctgggcatggtggcacatgcccataaccctagccccttgggaggctgaggcaggaagattgcttgaacccaggagttcaacaccagactgggctacatagcgaccccccatctctacacaaaattttaaaattagccgggtgtggtggtgtgcatctgtagtcccagttacttgggagcctgaggcaggttaatcacttgagcccagaagtttggggttacagtgagtaccactgcactccagccttggcgacagagtgagacactttcttagaggctgggtgctgtggctcacacctgtaatccctgcactttgggaggcccaggcaggtggatcacttaaggtcagtagttcgagaccagcctggccgacatggtgaaaccccatctctattaaaaatacaaaaaacagccaggcacggtgacaggtacttgtaatcccagctactcannnnnnnnnnnnnnnnnnnnnnnnnnnnnnnnnnnnnnnnnnaaaaaaaaaaaaaaaaaaaaaggaaggaaagaaggaaggaaaactgatgaaaattttacagtataaagtgtatgggtaaggtacacaaatcttttttttctcttttttttgggaccactgtcagaaacaaaattttgttcatcacattattctaatagaacgtctcacacagcatgcagtgagctattgaagtttattgtcctaggaggtattaacgaaacgaatgaactttaaaagtttagataaactcgtgggtgataaattattaaggggaattatcaagagaaaccaccaaaaatattctcagagatgtcgaggaacaccttggcacattgtgagctggaaggaccttgattttgacttggttctgacctaccatcttttttttggctttttttttagacagggtcttgctttgtcgtttagccaggagtgtagtggtgtgaacattgctcattgtagccacaacctctcgggctcaagttatcctcccctcagccccccaagtagctgggagtacaagtgcatacaccattcctggctaattttttttttttttaaaaggtgtggtttaatcatgttgtccaggctggtctcgaactcctgggctccaagcaatcctcctgcgttggcttcccaaagtcctgggattataggtgtgcaccaccatgcccagctgcaaccatctttcatactacagagttttacagagcacctctgtgtacaaagcaacttgctgggtgctctgggagaaatgaaatagaccatgctcagcaggggctcatcagctagtgggagaagaaagatgtgtatagcaataactaaacacagcaagctgtggcaagttctgtgatgcaggggcagagaaagtgctttcggaaaaggtggaacctgcttagagaggtccttgggagagctgcttttttttttttttgagacagagtctctctctgtcacccaggctggagtgcagtggcgcatcttggctcactgcaagctccgcctcctgggttcatgccattctgggagagcttcttaggggaggtatgtcttgggacttagaagataagtagaattaagtgaaatgacaaatgacaaggtatcacattgcctgcctttaaattatactacaaggctgtggtaactcaaacagcatggtactgctagaaaactagacatatagaccaatggaacagaatagagaacacaaaaataaagctacatacctacaaccaactgatctttgacaaagttgacaaaaattaacaatagggaaaggagttctagactagcctaggcagcatggtgaaacactatctctaccaaaaatacaaaaaattagctgggtgtggtggcatgcgcctgtggtcccaggtatttgggaggctgaggtgacaggatcacttgaacccaggagacggaggttgcagtgagctgagattgagccactgcactccagtctgggcaaaaaattgagaccctgtctcaagaaaaccccccaaaatcccacaaaaattagcaggctgaggtgggaggatcatttgaatctaggagtttgaggctgcagtgagctgagatcatgccactgtactccaacctgtgtgacaatttgggaggctgaggtggcgatcaccttaggtcaggagttcaagaccagcctgggaaacatggtgaaaccctaaaaatacaaaaatgagccgggcgtggtggcacatgcctgtaatctcagtacttgggaggctgaggcaggagaatcactttaacgcgggaggcagaggtggcagtgagctaaagccattgcactccagcctgggcaacgagagtgaaactccatctcaaaaataaaaacaaaaaaacaggccgggtgcagtggctcacacctgtagtcccagtactttgggaggctgaggtgggtggatcacagggtcaggagattgagaccatcctggctaacacggtgaaaccccgtctctactaaaaataaaaaaattagccgagcgtagtggcatgcacctgtaatcccacctactcaggaggctgaggcctgagaatcacttgaacctgggaggtggaggttgcagtgagccaagatcgtgccattgcactccagcctgggtgacagagtgagactccgtctcaaaagacaaaacaaatatgtataatatatatatatttataagtagccagtttaaattttagtctgtaagtggatataaaatgccactttacacctctaacctgtctttaatccccagcaggcacctttcttcagactgctgggaaatcctatctcagtcattgcagggcttcccctcctcacttgcagtgtggtcatacaaaaattccacagtcccgtggttcttaacccacgtctagaattccccacctggtgtgctgagggtggagagggcttggattgcagactcctttcccccacaaagcactgactttctctggttaggtcgttttcacttcctctgctcagtgttccctttctccattccttctttgggacagcttagtgtaagcttcctcagtgtgctcctgcaaacatggtggtaacctgttttttctagggtagtggtgggaaaaatcacgtaggtggtgttgtggtggtagtttttcttttttttaaataacttcctctgatatgggtgagttatgatagtctatttgccgtttttgttttgttttgttttgttttgagacagagtcttgctctgtcgcccaggctggagtgcagtggcaagatctcagcttactgcatgcagcctccacttcctgggttcaagcgatcctcctacctcagcctcccgagcagctgggactgcagatgcatgccaccacgcctggctgatttttgtatatttagtagaaatggggtttcgccatgttggccaggctggtcttgaactccttacctcaggtgatccgcctgcctcggcctcccaaagtgctgggattacaggtgtgagctactgcacccggtccatatttagcatcttacaacaacatccatttattagctcacagttctgtaggtcagaagtcgaggcactctcagctcctacatgctgtctcaggtccttgccatgtccttctgtctttgcagccagcaatgcgaatcttcatgttgaatctctcacccttttaatctctgacttcctgtctctgacatctagacatagatttaaaggactgatgagactaaatctctcagtctccccgtcctctaaattttcatcatcccaaataggagctctgtacccactaaacagtaactccgcattctctacttccccagaccctggcaacctccattctactttttgtttctatgagttcatctgctttaggtggagtcatataatatttgtccttttgcatctgggatactctacttagcatgtttccgagctccatccatgttgtagcatgtatcagaatttccttcccttttaaggctgaataatattccattatatgtctgtaccacattttgtttatctgttcctccattggtggacatttgggttgtttgaggtcttctatcttttttttttttttttgagaccgagtctcgctttattgcccaagctggagtgcagtggcatgtctcggctcactgcaacctctgcttcccggggtcaagtgattctcctgcctcagcctcctgagtagctgggattacaggtgcctgccaccatgcccggctaatttttgtatttttagtagagatgaggtttcaccatgttggccaggctggtctcgaacttctgacctcaggtgatccatccgtcttggcctcccaaattgccaggattacaggcatgagccgccgcgcccagccgagttctatcttaaggtcaattgattgggaccttaattacatccataaaatcccttcccaatagtagctagatttgtgttcagtgaatgttgaatagcagggaagaggtgtgtatataccaagggcctggaatcttgggggctgttaggattctgcctaccacagactccccagaaagattacacagatcttgttagaggaaccatcttgccctcctccttatcatctccttactgtctgtaaattgcacagaggaatcctggaaatggcatctcatttcactgcctgcctttccttctgggcttcgctctgctcctgactctggtgcactgaaggatgcatgttaatcactttgcagcctccggtgagagtactctggcttcttgtccccaatgttacttgtgatgtttcttgagggtagatgacttgagaaatccactaaataaggccagcgagggtgagggaaagaaggtgcttaccatttgtgatttgtgattgtcgcagaatgtataaaatggattcttcgttgatactgtcttggagagaacttagagcatttaataaccaaacagtggcacaaactgtttcatgatactggcatgagagtgcagcaggatttgaacttgtccaaagaaattcagggcaataactgcctggattaaaataagccttgtgctcagcctgaatgcacattctttggactcattgcagtctcttgggagttagacgttggctcctgaaacgatgtgatagtgctccctgggaattgggagacccgggaaatagaaaccagttaaatgcactagaaatttcagagcgaatgtgacctggggatgtcagtatccagaatatgaccttggattcagcaggggtggtgtctgaatattgccaactgccatatggcttgaggagaagtccatgccctttggaaagtcacgggtgtcttgggtgtgtgtggggtgggggtgtccaggttaggtttcacttgcaagaaggctctttgttcatagtagctgctgttttctctgagctagtcagcctccccatgggctccaggacttctgtctcttcaatttatttatttttatttattttttgagatggagtctcagtctgttgcccaggctggagtgcagtggctcaatctcgagtcactgcaccctccacctcccacgttcaagcgattctcctgcctcatcctcccgaatagctgggattacaggtgtccaccacaacaccgggctaatttttgtatttttagtagagttggggtttcaccatgttggccaagctggtcttgaactcctgacctcaggtgatctgcctgccttggcctcccaaagtgctgggattacaggtgtgagccaccccgcccagcctgtcttttcaatttagaatgtaccagcttggttgcatgtagtcttggtgtgggggtaacaggtagcaactgccctattgtcaaaaatgaatgtgtacttgggaggctgaaatgggaggatcacttgagaccaggagttggagtccagcctgggcaacatagcaagaccctgtctctacaaaaaataaaaaaagtgaatgtggaattgggttgtaaattagaagtgggtgggtagaagcatccactgtagagaactaatgatacctgcgagctggggacttcttgggagacaggaagaggaagagccacagagacctctgccttctatccccggctgggtttgctggcagcactgactctgtgttctctctctcaggcaactgcgatgtctgtggactgtcttgggcagcatgcagtgctttctgggtaagtaagcttgccgagtttgtctgccatgatttctggaaacgatttgcaaatcggggtttctgggaacttggaagctattcttatatttacggattatgatcatagggtttagttctgatatcctgtttgcctcagggctactcggagggattatttgcagtttattttaatctctgccctaataggtaagcaataaaacacctttgaagttttagtgactggtagcttgaacttgaaattgcagttttctgtttactgcaagactcaaggatgtttgctactacatacctgaaggatgaaatctattttggtgaagcaggtggttcctaggattgaaggaatctgagttccagtttgacggtgccactaactgtgagcccctggacatttattcagtttggcttaactggactttggttttctcatgaaggaatttgatttcatcatgaaggaactgaatgacatagtttctgtagcatcttctggctcaaaatttttaagactctggcaattaagggccatctctgcttttctaataaccctaacatcgtactattgggataaaatgtaataatcaagccaggcatggcctgtagtcccagctacttgcgaagctgaggcaggaggaccacgtgagccaaggagttcaagaccagcctgggcaacatagcaagaccccatctcaaaaaaaaatttttttttttttttgagacggagttttgctcttgtcgcccaggctggagtgcagtggcgcgatctcggctcactgcaacctctgcctcctgtgttcaagtgattctcctgcctcagcttcccaggtagctgggattataggcacgtgccaccacgcccagctcattttttgtatttttagcagagacagggtttcaccatgttggccaggctgacctcgaactcctgacctcaggtgatctacctgccttggcctcccaaagtgcctcctaaagtgctgggataacaggtgtgagccaccgtacccagccaaaaatttttttttgatggtcatggtccccttttcctttcgtgttgctctcgagtacagtccttacctctaggatccactgtgttttcattaatgtagttgtttatgaacccatttacaaatcagtgaaaatattttcttttctatcagcttcattactttattttgaaattatgttttaatttaccttttttaaaaaagtatacaacatggtaaacgtgtaaaaatttcagaaggatatacaatgaaaagtaaatttccttcctacctctgaccacctccctggagaaaattatttatatcatttttttgtgtgtcatactgggtgcctagataagggaaagttggtatctcttttctgcctccagctccctgctctttttttttttttttgagatgatatttcgctcttgttgcccaggctggagtgcagtggcacgatctcggctcactgcaacctccgccttccggtttcaagtgattctcctgcctcagcctcccgagtacctgggattataggcgcctgccaccatgcccagctaatttttgtatttttagtagagatggggtttcaccatattggccaggctgatcttgaactcctgacctagtgatctgcccggcttattctcccaaagtcctgggattacaggtgtgagccaccgtgcttggcacacatttttactatttttcaacatgatcttgaatctttatatttcattttctttctttttttcttttttttagagatgagggtcttgctttgttgcccaggctggtcttgaactgctgggctcaagtaatcctctcaccttggcctcatttcatattctctctctctctctttctccctttttctctttctttcttttgagacagggtctcactctgtcacccaggctggagtgtattcgctgatgtgatctcggctcactgcagccttgacatcccagactcaagcaatccatctgcctctgccttggcctcttgaagtattttctcttctttttaaaaaaaatttaatttaattttaagttccaggatacatgtgcaggatgtgccggtttgttacgtaggtaaacgtgtgctatggtggtttgctgcacctatcaacccatcacctaggtattaagccccacatgcattagctatttatcccgatgctctccctccccctggccccccaacaagtcccagtgtacattgttcctctccctgtgtccatgtgttttcactgttcagctcacacttataagcgagaacatgtagtatttggttttctgttcttgtgttagtttgctgaggataatggcttccagctccatccatgtccctgcaaagtacatgatctctttcctttttatagctccatagtactccatgatgtatatgtaccacattttctttattcagtctatcattggtgggcgtttgggttgattccatgtctttgctattgtgaatagtgcttcactgaacatatgcgtgcatgtatctttatttttatttgtatttttttttgaagacggagtctctctgtcacccaggctggagtgcagtggcatgatctctgctcactacaacctctgcctcccgggttcaagcaattctgcctcaacctcccgagtagctgggactacaggtgcacgctgccatgcctggctaattttttgtattttagtagaaacggggtttcaccatgttgcccaggctggtcttgatctcctgaactcagacaatccacccacctcggcctcccaaagtgctaggattacaggcatgagccaccgtacctggccatatctttataatagagtaatttagattcctctgggtacataccctataatgggattgctgggtcaaatggtatttctgcctctaggtctttcaggaatctctcacctctcctactcaacatagtattgaaagttctggccagggcaatcaggcaagagaaataatgaatattcaaataggaagagagaaaaaaaaaagaaaaaagaaaaaataaatagagaggaagtcaaactgtccctgtttgcagatgacatgatcctatatctaggaaaccccattgtctcagcccaaaagcttcttaagctgataagcaactttagcaaaatttcaggatacaaaatcaatgtgcaaaaatcacaagcattcctatacaccaacaataggcaagcagagagccaaatcatgaatgaactcccattcgcaattgttacaaagagaataaaatacctaggaatacagctaacaagggaagtgaaggacctcttcaaggagaactacaaaccactgtacaaggaaatcagagaggacagaaacaaatagcaaaacattccatgctcatggataggaagaatcaatatcgtgaaaatggccatacctcccaaagtgatttatagattcaatgctgttcacattaaactaccattgacattcttcacagaattagaaaaactatgaaattcatacggaacccaaaaagagcctgtatagccaagacaatcctaaacaaaaataacaaagctggaggtattacgctacccgacttcaaactatcctacaaggctacagtaaccaaaacagcatggtattggcacaaagcagacatatagaccaatggaatagaatagagatatcagaaataagactgcacatctacaaccatctgatctttgacaaacttgacaaaaacaatcaatggggaaaggattccctgtttaacaagtggtgctggaagaactggctagccatatgcagaaaatggaaactggaccccttccttaaaccttataaaaaaataaactcaagatggattaaagacttaaatgtaaaatccaaaactataaaaaccctagaagaaaatctaggcagtaccattcaggacataggcatgggcaaagattttatgacaaaaacaccaaaagcaattgcaacaagagcaaaaattgacaaatgggatctgattaaactaataagcttctgcacagcaaaagaaactatcatcagagtgaacagacagcctacagaatgggagaaaattcttgcaacctattcatctgacaaaggtctaatatccagaatctacaaggaatttaaacaaatttacaagaaataaacaaccccgttaaaaagtgggcaaaggacgtgaacagacacctctcaaaagaagacatttatgcagccaacatatgaaaaaaagctcatcattactgatcattagagaaatgcaaatcaaaaccacaatgagagaccatctctcgccagtcagagtggcaattattaaaaagtcaagaaacaacagatgctggtgaggctgtggagaaataggaatgcttttacactgttgatgggaatgtaaattagttcaaccattgtggaaaacagtgtggtaattcttgaaagacctagaactttcattttcttatattgggttttttttgttgttgttgttgttttgagacaaggtttcactctgttgcctaggctggaatgcagatcacggctcactgcagtctcgacttccagggctcaagtgatccttccacctcaacctccaaactgctgggactgccggcatgtaccaccacgcctgtctggctaagttttttttttttgtagagacagggtctccctgtgttgcctaggctgatcttgaactcctgggctcaagttgatcctcctgccttggccccccaaaatgctgggattatagacgtgagccactgcacctggcattttcttatactgaattttacaatatgtgtagtaaattgtataaagtgtggtaaacttaagtaaatagctgaaatttacaaatatatatactcatgtaatcaccattctgattaagatacagaaattttttttagaaccttggaaggtccttcaaatctggaaatctgtatcttttagtttagagaaatgtttctgtattatgtctttgatcattttctcccttttattttcccattttctttctctctctcttttttttttttttttatttttgagacggaatcttgctctgtcaccaaggctggagtgcagtgatgaaaacttggctcactgcaaccacctctgcttcctgggttcaagcgattttcatgcctcagcctcccaggtagctgggattacaggtgagcgccaccaagcccagctaatttttgtagttttattagagatggggttttgctgtgttggccgggctgatctcaaactcctgaccttgggtgatccacccgcctcagcctcccaaagtgctgggattacagatgtgaaccacgtacctgacctcattttctcttctcattctttcttgttggaattcctactagtagtcaatgttggatatcttgtatgactttgcttctggcctcgtcagttttgccttctgggagttttaaactttagcttctttcttttttttagatggagtttcgctctgttgcccaagctggagtgcagtggcgcgatgtcggctcactgcaacctctgcctcctgggttcaagcaattctgctgcctcagcctcccaagtaactgggattacaggctcacgctgccatgcccagctaacttttttgtattttagtagaaacggggtttcaccgttttgcccaggctggtctcaagcccctgagctcaggcagtctacccgcctcggcctcccaaagtgctaggattacaggtgtgagccactgcgcccggcctaaactttagcttctaacactactttcagatttaaaaaaaaaatttcaactattttaattttcaaaaaatttcaactattgttttaatgtttattattatttatattgtctcttaactcttggaaaatattggttccaagattttttctcttctgcatttatcgccgtttcctttgaatttcttcttttcttcttcctctttttttttttttcttattgttattattttggagggcggtggggaggcaagggaggagttttttctttccttttctttttctgttttgtcacctaggctggagtgcagtggtgcaatcatggctcgctgcagccttgaattgctgggcaagcaatcctcccatctcagccttctcagtagctgggagtacaggcacatgtcaccacacctggctaattttattttattttattataatttttttttctttatgcagataaggtcttgccaggttgcccaggctggtcttaactccgggcctcaagcgatgcttctgcctcggcctgcagcactaagagttccagtgtgagctgctgcttccaaccatgaaggcttttttcctttctgttgcattagtccctatccttcaggtttcctccggtgactgagatcgttggctgctaatgctaaagagcgactggcatctctctttaagtgggtagacggtggaggagatcaggtgggaaccaggccctgttagtggatgtccaaatgtcattgtctgcagagttttgttgttgtttgcttgcttttgttttttcctgggctggttattttctcctgagaagtctatctgaagagtaaaaggcagagtcgtgagtgctgcatagagagaggaatgacttagtgcagcacttcccacttcccaggtctggggctgctctaggggagaatagcacccactctccactgaggcagccacctgggtggatgggttgcacataaccctctccttagtgtttttttgttgagatggagttttgcttttgttgcccgggctggagtgcaatggtgcgatctcggctcactgcatcccctgcttcccaggttcaagtgatcctcctgccttggtctcctgagtagctgggattacaggcatgcaccaccatgcctggctaattttttttttattagtcaggggtttctccatgttggtcgggctagtctcgaactcctgacctcaggtgatccatccgcctcggcctcccacagtgctgggattataggcgtgggccactgtgcccggcctccttagtggtctttcaaacaggtgtcctagttttgttctgcttgttgtcttctagccctaccccttgcccttgtcttgagacaaaagcctccagttggggggaagcaacttgcttcacactcatttctctctccatgtactttggctttatttagcttgtttttttttttttttttttttttaagcgaaaaggagactnnnnnnnnnnnnnnnnnnnncagcctgtcccccaggctggagtgcagtggtgtgatctcagctcactgcaacctctgcctcccaggttcaagcaattctcctgcctcagcctcctgagtggctgggattacaggtgcctgccaccaatgtttagctaattttttagtatttttagtagagacagggtttcaccatgttggccaggctggtctcccacttctgacctgaggctatccacccaccttggcctcacaaagtgctgggaatagagttgtgagccaccatgcctggcctatttagctttctttagatcaattaccatttgtccacctgtttttcatttcctgtctcattttctttgtctttggaggttttttgtcttctttactcttattatagtggagcattggggaaaatgaagataaacacctatgttccatcaggcgtgttcaccctgaagtgcccactttctgcctttgtacatttgccctgtaaagtctctgcagccccctattgatactcacctcacatgtatagctactagccttgtcctgttgttcttctgatgggacgatgccagctggccatcgcaggatcaggtgattcctttggagcaggccagagattctatgtgatatttgttctgcactttcttagaagtcctggaaattctgtgaaattgtgtattcccctggcttttcttcttctccctccatcttctctcctcagagttctgctaccacctagagttttgtatgccatttcctggctcttctgagcagggatgattaatctttttcttcatttttgagcctgcctattctcattgatctccaggggcttggagtggtctctagcaaagaatcaatagctgatggctgcagagatgttgattcacacaccaagggtattttacttaaaaagaaaataggtgaatgcagaacctccctgttttcagatccttcatgttgattggaaccttaaacattactggcacttcatatgttattttaattattattcctttttgttgttattgttaaccctcctgatagatttagttgagttttcttgaccaggaagtagtaaggggaattttgagattttctgcttctacaggattttggcttagtaataagtgatatgtttaatttaactcacatttgttgagtgcagagcactgagcctggcgatgtgaagcatacagagatattcaagacagccgggcatggttccttgtgcctgtaatcccagtactttgggaggctgaggcaggtggatcacccgaggtcagcagttcgagatcagcctggccaacatggtgaaactccgtctctacaaaaaatgcaaaaattagttaggcgtgatggtgggtgcctgtaatcccagctacccggaaggctgaggtaggagaatcgtttgaacttgggaagcggaggttgcagtgagctgagatcataccacagtactccagcctgggtgacagagcgagactctgtctcaaaaaaaaaaaaaaaaagaaaaaaaaagatattcaagacatagttcattctctgaacacttagttgattcaggacaagagccttaaattattagtcctgctacaagataaatgctgtggtcaaaatgcaaactatgcaatgggagtaatgtggaattaattaattcagtaattaaccctagctgggggattgggaaaggctgggagaagggcaggttggaggtgaatccagactctcatggatggatgtggtagggaaggccatctctggaggtgggactctcacagggacacttcttccctttgtgtgacagccaccttgaattacacttgtcacttctttgcctttcagagtaaataaatgccatgtgtgtttgggttttttggagcactgcttgcaaattgtatgcaattccaattgtgcttttctatcttaatgctaatgatgttgtgtttttatactattataatgttgatgttggtctctagccgcagattcttatacatcgtcaatctagatgcccctttcgaaggtcaccgaaagatctctcgccagagcaaatgggacattggagctgtgcagtggaatcctcatgacagctttgcacactattttgcggcttcggtgagcttatttaaggaatacaggagaatgctgttaaatgtgtcatctggggctggcagatctatgccctgtgtagagaagagaatgcagtcctcattgctcatttggaaaagaggtttggatggttctgagaaaaagacagaggcaagttacggattaaatatacgtgggaatgctcgctggtcccatcggtgtcaggccttgtattactagggactgaattcagattttgaaagggaaacaggcagatgcatccatttctgtgagtggtgagaacctgtttcatcagcagcaatgtaactagccagcggccaaatggcagatgactttgaaagacattctaaggagggtaactggcgagctggtgtggagttgaccttcattgctttcagagggatcagaagactccccctacccttctattcaaaggaagggattcttccttgattgggaatcattagatttcgttaaccccatcaaattctatgtgcctgtttatgtgtgattttttttttccctagggaaaacatgtataagttttgttaggttttctaatacaaaaatcttttctttatacaaaaagattctggactacaacctgtctggcatctttctccagattctgtgtcacattgtattctagaataatgagagatctaaactttttgctctttttgcattgggctggcaggagagtatttaaaggaattcttctgattcaccaggggcaggaccactgtgcagtctgtctcagtctgttcttgtcaggaaaggcagtctgcagaaggaaagcaactgagcaaggaaagaagagcaactttgtcagcttgagaaggaacagaaagccgcccttcccagctatttccaaaatagagtctgcctttaactgtggatgtccgaggttgcgctgattttcagggctattctcaaagagaaaggcagagtcagtcttcctgcctttctactctcaggcctctttcctgagtgctagaaggagctcttttagttggtttatacctcgggacccttatttccctctcaccctcggcccctgatcgtctagtccagggttttttaaccttggcactactggcttgttaggtcattctttgtggtggggctgtcctgtgcgttgcaggaagttcagcagcatccctggccctacctgctagatctcagtagtatgctccccacctgttgttatgacaatcaaaaatgtctccagccactgtcagatgtcctctgggaagcaaaatcacctctgattgggtttaggctgacgcctcagttgttgtactcagtggattaacactgcatttgttcgggagtgctaacaaagacagcctttttaaaatttgttccttcacaattaatcattttaaagtgaacaattcagtatccttcactgcattcacatgttgtataaccaccacctctatccaattcccaaacatttctatccctcccgggtaaaaccctttattcattaagcagtttctccccattcctccctccgttgcaacccctggcaaccaccagtctgcgctctgtctcaatggattgatctattctggatcttccatagacatgaaatcataaaacaagtggccttttgtgtctgacttcttttacttagcataatgttttgaagttcatccatgttatagcaggtatcagaacttcattcctttttatcagtggataatattccattgtgtaattgtttatctatccgtccatccatcagaggacatttgactggctattgaatagagctggtatgaacatatgtgtggaggtacttgtttttgcttcttttgggtaaacatctaagagtggaattgcagggtcatatggtaattctgtgtttaacttttggagggaaccaccaaactatttccacagtggctaaaccttttatactcccatcagcaatgcacagagttccagtttttccacatcctctccaaaatttattttttgtatttttaaaaaaattatagccatcctagtgggtgtgaaggtgtgaggtggtactttgttatgtctttttgtttgtttgttttgagacagagtttcactcttgttgcccaggctggagtgcagtggcatgatctcggctcaccacaacctccacctcctgggttcaagcgattctcctgcctcagcctcccaagtagctgggattacaagcacacatgatcacgcctggctaattttgtatttttagtagagacagggtttctccgtgttggtccagctggtctcaaactctcgacctcaggtgatccacccacctcagcctcccaaagtgcttggattacaggcatgagccaccgcacccagccttattgtggttttagtttatattcccccagtgactaaggatgttgagtatcttattggccacgtatatgtcatttttttggagaaatgtctattcaaggcctctgccctttttctttttttttttgagacggagtctcgctctgtcacccaggctggagtgcagtagtgctatctcagctctctgcaagctccacctcccgggttcacgccattctcctgcctcagcctcccaagtagctgggactacaggcgtccaccaccatgcccggctaatttttttgtatttttagtagagacagggtttcgccctgttagccaggatggtctcgatctcctcacctcatgatccgcctgcctcggcctcccaaagtgctgggattacaggcatgagacaccacgcccggccttgcctctgccctttttcgaattgggttgtttgcatttttactgttgagttgtaggagttctttatatattctggatattagacctttatcagatgtatgatttgcaaatgttttcttcccttttgttgattgtctttctgcattcttgacagtgttctttgatgcacaaaagctttaattttaatgaagtttatctgtttttttcttttgttcttggttggaaggcaacttttttttttttttttgagacggagtctcgttctgttgcccaggctggagtgcagtggcgccatctcagttcattgcagcctctgcttcccaggttcaaggaattctcgtgcctcagcctctcaagtagctgggactacaggcacgtgccaccatgcccagctaatttttgtatttttaagtagagatgggctttcaccatgttggccaggctggtctctaactcctcacctcaagcgatccccctgcctcagcttcccaaagtgctgggattacaggcatgagccactgcccctggctggaaggcaaccttttgagaaagctttagttagggaaatctgaggtcaagtcctagttttaacattctgtcttttatcttgagaggccccacaattttctgagccttgcttgcctcatctataatgtgggtgatgatacccgctgtgtcgtgtgctgggagaggtcagaggccagattcgttaaggtggactggcactagcagaccctccagaaatggcagggaatattattagaagagggaacttttcttttcattcctattctctttggaagctattttgaatcctaaccttttcacaagaatcttacctttttcaatttggaaactggtatttcaggacaaaaatctcagaattttatacgtctgtctgtctctgagctaaaatgacaatcagtctaatgtgtatatatatatatataaaatttaaaaaattattaagtagcctgccgttgttttcagcctactagtaatctttatcactttcagtgtgtttcataaagtcatgatatgtcgggagcctttgctgttttgttgtgtatttaagtgaaatgtactttgatggaagttatttttctattgtagctgtggtttcttctggtccattttccttgtcactttctgcttaaccctttaagaaattaaatacaggcattatttcaaggagtgttaaataattttgccttctaggacacccttttgaggatctttcttcttttcttttctttttttttttttttttttttgtttgagatggggtcttgctgtgtcacccaggctggagtacagtggcacaatcacagcttactattgcctcgacctcccaggctcaagcgatcctcccacctcagcctgtcaagtagctgagaccacaggcatgcaccaccatgactggctaatatttaattttttttgtagagatgcgatctggctatgttgcccagactggtcttgaactcctgggctcaagcagcctcttaaagtgctgggattacaggcatgagccaccaagcccagcctcttttttctctcttatgcacctatgtttttaaagtgacacgggacccagttgtgatggcgcagtcctcacacctcacaccttatcccagctatcctagactctgaggcaaggggattgtttgagcctaggagttctagaaaagcgtgggcaatgtagatcccatctcaagaaaaaaaaaaaaacaaaaacctgtggtaggtggactctgggcatttggtcatggaagggtgagctggagacatccagtgtaccagcagctggggagacgagtgtgtgaccttcagagggaggaggttcctctagtggccgggacattttcctggcccatgaagctcgtctgcagaagtgcttctgcaccttcagttcagctgtgactgttcaagatgcatctcttaagatagtcctgcctttccattttgagattcacagacctacatactgagctgaagttagctcaagctaatgttaattgtacttattcctgatggctttttaaagaaaagttcagcctgaaggatctttgccatgcatgagatccctggcttcctcttcactgccttaagctgattggggcaagaccatatatcccaacatacttgcctgtggccttctttcctttcttttcagagtaaccaacgagtagacctttacaagtggaaagacggcagtggggaagttggcacaaccttacaaggccacactcgtgtcatcaggtaggcaccagccctccacagctctttggctgtcttgctttgtcacagtcccctgggaacgaaatgatgatgccgtcctccttgcatggcttgactgtctgtgttgcacaggtcccgggtggtcagcgggttattagcattcactgagatggtggtgaagagcacagtgaggaacagccggcatttaggaagtaccatcgcgtagctgttgacccccatcccagaccatatcccggatggatatagtccagtccagggtaaaggattagagctgacttttttttttttttttttttttgagacgaagtctcactctgtcgcccaggctggagtgcaatggtgcgatcttggctcactgcaaccaccgcttcctgggttcaagtgattgtcctgcctcagcctccagaatagctgggattataggtgtgcaccaccacgcccggctaattttttttttttttttttgtggagacagggttttaccacgttggccaggctggtcttgaactcctaacttgaagtgacccacctgccttggcctcccaaagtgttgggattacaggcgtgaaccactgtgcctggcctagagctgattttcaacataggagaggagtggttatgcagcagaatcccccagttcatgatcagtggtgcctgggaggacatgtggatgtcagggagtggcccttggctttctctccggcagcagcggttacagagctcctgcgtcacagttcattacccaagggcacagccgcctcccagtcgaggcttccagttggtttcgagttttccttgatccactctttccctgggtcactgtttctgggctaagctgacctggaagtgctgggaaaggtgagacacctgggttgggtggaatgttctgtgcagttgctgcctgtctaggaaggagaacatgggtaggggacaccacaggcctctggccctctctgggtgctgcatggcagtgtggcagtttgccgctgcttaaggatgttgggtttacccaaggtgcctctggtggaatttgatttagaaaatgataaagattactttatgtgtttttcctttgtttgtttatttagagagagaaattttgtttgtttgtttgtttgtttgtttgttttgagatggagtttcactcttgttgcccaggctggagtgcagtggcacgatctcagctcactgcaacatctgcctcccaggttcaaatgattctcaagtagctgggattacaggtgtgtgccaccacgcctggctaatttttgtgttattagtagagacggggtttcaccatactggccaggctggtctcgaacttgtgacctcaagtgatctgcccgcctcagcctcccaaagtgctgggattacagtcgtgagccgctgcgctcagcccagagagagaatgttttaagttgaagcactccatttcttttctgggagcagatgatggtatagctggcgaaggacctgacagtttccttccaaactcatgttcgttcccaaggaactttggagattctcagcctaaaccacattaagaagcccgttaatgatgacattctgaagccactggagactcgatgtgctagtgctttggacctggactctgaatttttttccttttctttgttctgtttattctttgtgtcccagcgacttggactgggcggtgtttgagcctgacctcctggttaccagctctgtggacacctacatctacatttgggatatcaagtaagaacaattaggaggcataaccacttggttgggggtgatttgggacctttgttttagagatcaagtgtcttagtttggtttcccctcgatacagacctcgagacaagtttgagtgagagatttgagcgcaaatatattatttgagagtgaaagacacagttgtagggggatagagaagagagccaggacctctccaggcaagaccttaaggagaactcttccctagttagagtctgtcctccctccctccctctctccttccctccctccttctttccctccctccctcctttcctccctcattttcacccttcccccttccttcctgtctttccttccttcctctctttctttcctttcttttttttttttttttttttttttgagacaaggtattactctgtcacccagtctgcagtgaagtgatgtcatctcagctcagtacagccttgaacccctgggctcaggtgatcctctcacttcagcctcttgagtagctgggaccacaggcacttgccaccatgcccagctaatttttatttttttattttttatttttgtggggacagagtcttgctgtgttgtcaggctgatctcaaactcctggcctcaagcagtccttccaccttggtgtcccaaagtgttgggattataggtgtgagccattgtacatggcctgtaatttgttttctttctttctttctttctttttttctgagacagagttttgctcttgtcgtcctggctggagtgcaatggcacgatcttggctcactgcaacctctgcctcctgggttcaaacaattctcctgcctcagtctcccgagtagctgggattttaggtgcctgccacacgtggctaatttttgtatttttagtagagatggggtttcatcatgttggtcaggctggtctcgaactctgacctcgggtgatccgcccaccttagcctcctgaagtgctggaattacaggcatgagtcaccgtacctggccagcaggtctctctttagacttctttttaaggccctcacagcggatctacctactccaagttcccactgaaaggaaagcgaagaattgtgtgcaaagggtgaaaaataccaggtgggtggtggcatataaattggggatttgattttttatttttatatttcagagacacaaggaaacctactgttgcactgtctgctgttggtgagtgtatgcttctcccacctcaccctggcgccttggtttgtcttcattttcttccttccagttctttcccgttccttcctattcctttccatctccctctctaactgcctctgtctgggctgcgccgtggctgagtggaattgtaagtctcatgttgttgcaaggggctcactttaggctgctcccagaagccacagttaggactgttgggtgtggagcaggacctcatatcagagtccaaggacaagagccaagatgatttgtttgtaacctttttatagtggaaaatttcaaacattctgtaaaaatagggagaagaaaatgaactgcctgtgttcatcgtcaccttcaacacttgtcatcatacatccaattttatttcatcttttcctccacccaccatttcacctccaccttcatcccccttgtgatttttttcttttctgagacagagtcttgctcttgttgcccaggctgaagtgcagtagtgcagccttggctcactgcagcctctgcttcccaggttcaagcaattctcctccctcagtctcccaagtagctgggattacaggcgcctgccaccacacctgggtgatttttgtatttttagtagacacaggtttcactgtattggccaggctggtcttgaactcctaacctcaagtgatcttcctgccttggcctcccgaagtgctgggattacaggtgtgagccaccatgcccggccctcttgtgattattttgaagctacatatcttatcatttcttcaacaagtatttcagtgtatgttttgcaaaagaagaatcccaatatcatacttaaaaatacctaaaaatattaacagtaactctttaatatcatcaagtatctaagcagcattcagatttccccaatagtctctctctctttttttagttacaaattgtttgaaaaatggattcagtgagaatctaaataaagtccatacctgtaagtggttgatatatttctcatctttttaagtctgtctccttctcctttttgggtttgtgtttttcttttcctgtagtttattaaagcaatagttcatcctgtggtttctccacaattagattacactgattgtatctgcatattttttttgttttgttttgtttttgagacagagttttgctcttgttgcccaggctggagtgcaatggcgggactacaggcatgtgccaccatgcccggctaattttgtatttttagtaaagatggggtttctccacgttggtcaagctggtcttgaactcccgacctcaggtgatccacccgacttggcctcccaaagtgctgggattataggcttgagccatcgcgactggcccatggtgttgtttaacatggatgaaccaagtctttgtagttacattctgatctacctgttttcattgcttagttggaactgaccttttctggaattctcaactggggctactagggaatattcccagcacttcctgagagtagaatgtggaatagaactggtataacttatttacagagataaagctaaattgtcaatattttgacatcctttataaaagcatgtgttatctgtctcttaaattctgtccgtttgtatctccttggtgcattggaacacacatttggtgtttgctctgaaatggttactgtacatggtactttttccctctgtaccccacgcctttttatgtaaaggcctttagcatcatgactgtattagcagctggatgatatgatttgtgaagttagaaaccacttctttctttcttttttctttttttttgagacagatcctcactctgtcacccaggctggagtgcagtggtggaatctcagctcactgcaacctccacctcctgttgttcaagcgtttctcccacctccgcctcccgagtagctgggattacaggtgcgcaccaccacacccagctaatttttgtatttttagtagagacagggttttaccttgttggccaggctggtctcgagctcctgacctcaagtgatctgcctgcctcggcctcctaaagtgttgggattataggcgggagccaccacacccgggcagaaaccatttctttcttattcagttctgtagacgagtgtatgtatttgtgcgctacaggcatttgtgcctgatccaaggagatacttaatatagtaatacagtaatcccccctcattctcaggggacacagtccaagacccccattggatgcctgaaaccacagataatactgaaccaaatatactatgtttcttttctgtacatacataactaggataaggtttaatttataaattaggcacagtaagtgattaacagcaacaactaataataataaaatagaacagttgtaacactgtaccgcaataaaggttatgtgaatgtggccgggtgtggtggctcacgcctgtaatcccagcactttgggaggctgaggcgggcggatcacctgaggtcaggagttcgagaccagcctcaacatggagaaaccccgtctctactaaaaatacaaaattagccgggcgtggtggtgcatgcctgtaatctcagcttcttgggaggctgaggcaggagaattgcttgaacctgggaggtggaggttgcggtgagcgagatcacgccattgcactctagcctgggcaacaagagcaaaactctgtctcaaaaaaaaaaaaaaaaaaaagttatgtgaatgtggtctgtctctctctctctcagaacgtctccttgtactgtaccgggagtgactaacactgtagaaggtggacccgcggataagggggactaagcatttgttgcatggatagatgaatcaaacccctgtgcttctgcgctaagtgcttaacagttccactgctctgccccccgccaccacctgctttaggtacttatgatctgagacatagactggctgcagagggcgtataactgaatagaaatacaggtggtctacagatgcctcaatcacattctcctgactttgttacttacatttataggtttcttttttttttttatttttgagacagagtctcgctctgttgcccaggctggagtgcagtggcatgatctcagctcaccgcaagctctgcctcccaggttctcgccattctcctgcctcagcctcccgagtagctgggactgcaggcgcccgccaccatgcccggctaatttttttgtatttttagtagagacagggtttcactgtgttagccaggatggtctcgatctcctgacctcatgatccacccgcctcggcctcccaaagtgctggcattacaggcgtgagcctcttcgcccggccacatttataggtttctaagttagattagttttagggaaaccctaaaaaggacggtggttctttttttatttgagatggagtcttgctctgtcggccaggctatagtgcggtgacacgatcttggctcaccgcaacctccgcctcctgggttcaagcgattctcctgcctcagcctcccgagcagctgggactgcaggcatgggccaccacacccagctaatttttgtaattttagtagagatggggtttcaccatattggccaggctggtctctaactcctgactttgtggcctacctgcctcggcctcccaaagtgctgggagtgagcctctgcgcccagctgaaagtggttctttttttagcctgcctgttctcattgcttttttttctgttatagatctttcttaaaaaatggaagtagaagacttctttcctttgtactcagtgaggtttctcagtggtgcagatctaccctgggggaaaagaggcaagtgagaggcttgtggaccttgataagctgctggatctagcataccccgagtggtacagcctcgggtactgcctgcttcccagagcctgtggtccccatctctcagggggcacattattcatgccctttgggatagggagtcacgttgtgagtattccagagtgttctctgtgtctgagagttctcatagcccgggacctccattcgaccctggtgtaatgattttttttttttttttttgagacagtcttgctctgttgcccaggcctgagtgcagtggtgcagtcttagctcactgcaacctccccctactaggttcaagcaattctcctgcctcagtctcccaagtagctgggattacaggtgcacgccaccacacctggctaatttttgtatttttagtagaaacagcgttttgccatgtttgccaggctggtcttgaactgctgacctcaggtaatccgcctgtctcagccttccaaagtgctgggattataggtgcaagccaccgcgcctggcctctggtataatgatcttgataaagcaggttgcattgagggggcttcccagagtcccttgggagccctcgagttctgatgcctccccactgggaaaggtgtgttctcttggactcttaagtaactctgtcaaggaggtagagcaagctcttctcactcactttctcctccagctgatatccttccgtgcgaagaagccacctcctaatactcttccttgcttcatcttcactggtctccaccatttgttctagatgacataagataccttatgtctcaagaaagaacaagacagacaaatagtgtcatcaaaaccaacacagcatatccttggacaggaccaagttctgggcttaatgctgtatgtcctgttagattctgagtcattgctctgtcctactctggacttcttggatcaagtagctccccaaagctgtggatctactatgggcttcctcagtaataaacaccaggcagagggacaggtgtcacagcagtaatgtcatgtgtgctgtgagcaagggcaggaggagacaggaaggagtgctgtcacttcagttctggtttggttcttgattaatgatttattttttaaaagtcagctagaggtgccactgtgtcccagttttccatgtctcagctctttctggcatctcacattatgcctcctgtcttaagtagcccttttgtcactaatgtatcaatgacactctgtattggcagagagggaaaaggactgaggtcacatactgccaagggtgttccctttcccttatcagtgtggtgccagtggccacggctgacatagctgatggggagtggggtgcggggagcatgtaacccttaggacagaattggtcaacatcggggcttattctgtagctggtcttcagctaaggctgtgtttttctaagactattgctcaacaattaaaaaaaaaaaaaagggggcaggcataacagctgaggctgttctaattaggagtgcgagcaggtgtcatttggggatgagaaagggtcaggttgtgtgacaagtcaattactagccagcagtgccatgctcaactactgctctgtaagaaactatgttttcctgctgattctgctcagagtgacctgtagattttttcccctgagattatttcctcaattaggtgactatgatcctgttcccatgtgttaattcatttattttttggcttcattttatctggaatagtggagttggtgcagtcacagaaacttgaagggttctgggcttattcagccagaactcattatccagctcccctggctgtgctctgctctgcttccgaaagcaccaagggcagcagctttcttccctgatttttctttgcagcgggtgcctcccaggtcaaatggaataaaaaaaatgctaactgccttgccaccagccatgacggcgatgtgcggatatgggataagagggtgagtaatctcttttttcgcccttattggtctttgatccctcccagagggtgtgaagatgattttatgagtgccaggacttggcttgagagtctggggaaccctgtgcagcatggtaaatgaccattttaagctcatagtaccagacgatatttgcgtctcaatccagtgttgaaggaaactagggaagtgagacattaggaacagtggttgaaaaaatcagctccattttgccacctcctaattatgacaccaggtaagccaccgtcacttctcttaacctcagtttccttcaaaataaagacactaacagtgtgtgtgtcagtggggttaagccgtggagcccaggcgctattctagaattgtcagcaggcttcttatccctgcccctgcttgcaaagtgaaatgtatttgttctcggatgcctgccatcctgaatacttccaataacgatgagcaaggtagggtgctcatgatgcttacatttactcttacaagcctagacatcccatcagcctcaaagtattgtgcatatcactcatacgttcttactgcagcagcccatggacacctagagatggaaacagtgctgggtccttggctgtggctgtaatggaaagtctactgaagttgattgtgttggcctcagtgagggtcgtggcacagggaaaaggcctcccctgcattgactgccagactgttaggtaataatgaacagagccatcactgccatgagacctgggtgtaaatcctgcttcctgcctgtgagacctggggctacagatgctcaggcattgtggggatggcttgttcagggatgtccccactgtcttatcttccggctgctcccttccctccatacgtttggaagagaagcgagaagtggagcagagatcaggcgtggcagatcctgtctgctgcattaggctccaggacatgctggggaagccttatgtggcagaagccctctgccttagatagctcttaggtgagaaggtgatttcatagaggttgggcaggtgcatcttcttttttttttttttcttgagacagagtctcattctgtcgtccaggctggagtacagtggggaccttggctcactgcaacctacgcctcccaggttcaagcaattctcctgcctcagcctccccagtagctgggactataggtgcacaccaccacgcccagctaatttttgtattttttagtagagatggggtttcacatgttggccaggatggtcttgaactcccgacctcaagtgatctgcccacctcggcctcccaaagtgctgggattataggcgtgagccaccacgcctggccacatcttctatatgttagtttttgtcttctgttcctttatggccattttccccttctttttttttttttttgagatggagcctcattctgtcacccagactggagtgtagtagtgtaactatggctcactgcagcctcgacctcttgggctcaagctattctcctgcttcagcctcctgagtaactgggactacaggtacatgccaccacacccagccaattaaaaaaaattttttttttgtagagacaaggttgctgaagctgacctcgaactcctggggtcaagcgatcctcccacctcagcctcccaaagtgctgggattacagacatgagccactgctcctggccttctttatttcctaactagtgattggttttattcagtttgtcactataacagcattttcggctgggcgcggtggctcacacctgtaatcccagcactttgggaggctgaggcgggtggatcacgaggtcaggagatcgagaccatcctggctaacatggtgaaaccccgtctgtactaaaaatacaaaatttagctgggcgtgatggcgggcgcctgtagtcccagctactcgggaggctgaggcaggagaatcgcttgaacccgggaggcggagcttgcagtgagccgagatcgcgccactgcactccagcctggatgacagagcaagactccgtctcaaaaattaaataaataaataaaattaaaataatgatacttaggacttctgctcaggtgagttgtagaacttgttgattatattttcacttctctggcactttgtagtgtcaaagcagcactgatggcagcaagcattacagacttcacaaagttcagtgtcagtgctaacagtggattttaatccagactcatgtatgactatcatattaacatttactgagcatttattgtacataggccttcttttaagagttttacatttattgattaatatctctttataattagcctttaaagtacatgtttttgtttgtttgtttttgttgttgtttttttttttttgggagacagagtctcactctgttgcccaggctggagtgcaatggcgcattcttggctcactgcaacctccacctcccaggttcaagcgattctcctgcctcagcctcccgagtagctgggattacaggtgcccaccaccacgcctggctaatttttttatttttagtagagacagggtttcaccgtgttggtcaggctggtcttgaactcctgacctcaggtgatccatccgcctttgcctcccaaggtgctgggattacaggcgtgagccactgcgcctggccagtgtgtgctattattatcccttttttacagatgagtaaactgaagcaaatttgctgccaaaatttgaacccaggcaggctggttctagagactgctctctgttttttgtttttgagacagtctccctctgtctcccaggttggagtgcagttgcacaatcatagctcactgcagcctcaaactcctggactcaagtgatcctcccagctgagtagctgggactgcaggtatgcaccactatgatgaggtaattaaaaaaatttttttcttgtagagatgggaatcttactgtgttgcccaggctggtcttgacttttggtctcaagtcatcctcctgccttggcctcccagaacactgggattataggtgtgagccactccacccagcctggagactgcactcttatcctcatagactaatgctaattatggaagtaatacatgctctctgtagaaaatataaatgaaaaaataaaaatcattcataatcctactacccagagacaaatgctaacattttggtgttttctgttcttatgctttttttttttaaacttagtttgtcgtactgtgtacgtagttgtgtacacttttttttcatttaacattagaacagatgcattatcctcgtactataagctctaagtataattttcagtggctacatcatattgtatcatcatttggtgtcgcatagctgtagtatattgattcagcttcattatttcccatttgttgatcatttaggttttttttctggttttctagtgtttcagataacaccaagatgaacttcttttatatctaaagctttttgtgagtttggattattcccttaagacaggaaaaattttgggctgggaaaagtggctcaaacctgtaatcccagcactttgggaggccatggcaagaggattgcttgaggccaggagttcgagaccagcttcaccatgttggccagactggtcacaaactcctgacctcaggtgatccacccaccttggcctcccaaagtgctggaattacaggcatgagccaccgtgcccggcctgtttattttctatgcttattaatcatgtattgtttttttttgtgatgtacattcattctcctttggaatcttagtgctccatcactttaagatgcatggttttaccctcttgttgaagctgagtccatttggatgtctcagtctctcttcttgggtgatcatgggggagacgagtgggaattgtcagactgcactgttaaagtgtgaggccgggcacagtggatcgtgcctgtaatccagacactttgggaggccaaagcagggggttcgcttgagcccaggagttcaagaccagcctggacaacatgcaaaaccccatctctagaaaaaatacaaaaaaattagccaggcttagtggtgtgcacctgtagtcccagctacttggagggctgaggtgggaggactgcttgagcccaggaagttgaggctgcagtgagctgtgatcgtgccactgcactccaacctgggtgacagagcaagacttcgtctcaaaaaacaaaaaagggggtgaaaagcacctactaccttgtatccttcattgaagtgggaagaaacgaggctcacaggcgcattttcagagcatgtgaaggagcgttggataagtcttttggtgatggtgttttgtttggcttaaccaaaacaaacaaagtctgtgtagggtagagacagtatctggtagtatttttgcatcctcactcactacctagcagacttttacgtgatagacactcaaagagttctttctaaatcgataatattaggtgctgatctgttgcagaaacccagtacagcagtggaatatctagccgcccacctctccaaaatccatggcctggactggcacccagacagcgagcacattcttgctacctccagtcaagacaattctgtgaaggtcagtggcacccatggggaagttggaggagcagtgtttgggtggcatcagggatgtatgattccaccttggttggaaagctgcagtgtgttagcacagtatgtatttcacggtgcatgtgcttcttgggcaactgaacacataaatttggttatgctgaccagcaaaatgcgacagagcgagacccagcatggtgctgttcagcataaccacattgtgttatgatggcagagtgacatgccatagcatctcctctgatacgtctcttagaatttgttcagaaggttttcgtctttccctttgtgaaaggaagtcagagacaaaagtacttagaaagggaaagaagttggccgggcatggtggctcacacctgtaatcccagcactttgggaggctgaggcaggcagatcacttaaggtcaggagttcaagaccagcctggccaatatggtgaaacctagtctctactaaaaatacaaaaattagctgggtgtggtggcgcacacctgtaattccatctacttgggaggctgagacacaagaatcgcttgaacctgggaggcaaaggttgcattgagctgagattgatccactgcactccaacctgggcgaccgagcgagcctctgcctcaagaaagggaaagaggttcccttgcgaagaagctgcaaggaagtcagatatgtatgacagatataagtaaaggagaaaagtctacagttgttaaggtttcaaagtttacaattagtctattcctggtggaaaaacagctgctccctcacatgcttatcgtatgtagaaagttctgacgttttcaggcatcagcatttcacagttcagggatagagtcattttattagtgattctctaacttacaggaaatgctcaagattttatgtgtttcagtaacccgattatttctggtttatcacaaggtacagtgttgtttgtttgtctttcctctctgtgacatgggatgttcacccttggtcagaatgatggcagggcagagtcatctttgttccagtagttcctccttgtggtcaggtctctgaggacaggggtttgaccacagaaattggtttagcaattttatgattcagtgtcatttatttaatgctttgttgtatttatatagtcatatatgacatctttgtggtatgattagcaaaactacagtcatatactaagttaaaagttaactcctgtcttgaagtttgtaaatctcttagggttgtaagttatttttaatgtgtcagatgtgacttttttgtttgttcgttcgtattacgtttgattttttgtttttatttatttatttattttttgagactgggtctcactttgtcacccaggctggagtgcagtggtgtgatctcggctcactgcaacctccgctcctgggttcaagcgattctcctgcctcagcctcctgagtagctgggattacagatgcacgccatcatgcctggctaatttttgtatttttagtacagacagggtttaaccatgttggccaggatggtctcgaactcctaacctcaagtgatccgcccatctcggcctcccaaagtgctgggattacaggcatgagctaccatgcccggctgcatttgggtttctgtccctgtaccccaatcagcttgtctcccaagttcaggaaccagaagccatccagttcaactctacctctttctatgagatgcccaagtttgttgatactcagtgtcatctttcctacctgtgagtctggggtttcctaggtaataaagcaggtaacagccagtttcctgggaggactttatatattttttctttatatatagatatatacatatctatatagacaaagagaaatataaagaaatatcagaagagccttggtcaaaaaagaaccaggtttccttgagggttgatgtcctaggaaacagactcaaagctacgtgtttctcaccagaatgtaccaagggtggtcgggcatggtggctcatgcctataatcccagcactttgggaggctggggcattatttccccatacaaagtcttctctgttctttaccagcaggcttagcttattaatgaaatgagatttttggcatggtatttgatttattccactatatcctagaaggaagacaattttttttttttttttgaggtggagtcttgctctgtcacccgggttggagtgcagtggcgcgatctcggctcactgcaacctccgtctcccaggttcaagcgattctcctgcctcagcctcctgagcagctgggattataggtgcatgccaccatgtccagctaacttttgtgtttttagtagagatggggtttcaccatgttggccaggatggtctcaatctcttgaccttgtgctctacctgccttggcctcccacagtgctagcaagacaatttttattgaatgtatgtaaatagcatgatcataaaaagtgaagaaacttagaaaagggactttgcataacattcaaccatttttttagtagataaggaccaatatgtgtaatttttctacataatcatttttaagtttatatgacaatttattagctcataatttatattaattatttttattatatttttattttctaaattctaaggggtcagctggagcaaggtatcactaaatgtgtatttcacttcagtttataaattatttaactacaaaacaattgagttgaaggttagggatagatcaagaagaaagaaaagaatttttcttatgtggcccttagaaatagaacattaactacaattaaatgagtttatatcattttacataatctttttttttccctgatcttgggttaacagcagcctatttcacaaaattgctgccttctagacaaagagagtcctggaaatccagacatagtcacttggtacattcttttttttttgagacagagtcttgctctgttgcccaggctggattgcagtggtgtgatcttggctcgctgcagcctctgcctcccaggttcaagcaattctcatgtctcagcctccctcagtagctgggattacaagggtgcaccaacatgccaggctaatttttgtatttttagtagagatggaatttcaccatgtttgccaggctggtttcaaactcctgacctcaagcattctccctgtctcggcctcccaaagtgctgggattataggcatgagccaccatgcccgaccacccttgctacattctggtgagaaacatgtagctttgagtctgtttcctaggacatcaaccctcaaggaaacctggttcttttttgaccaaggctcttctgatatttctttatatttctctttgtctatatagatatgtatatatctatatataaagaacaaatatatattttgtttcactgtcttgcccaggctggttttgaactcctgggctcaagcagtcttcctgcttcagcctcccaaagtgttgggattacaggcgtgagccacacctggcccctgatatttcttcagaggacttttttctgatctgtagcttgtagcagggacccttagaaaagggtaaatgaaaaggagaaattatctgtgaatggggggatggaatggctccggttaatttataataactacctgtatcagattgaaatagaatgaagtcttctgtttgcaaatgacatataatcgttttataagactgcatcagtgattgccttgagagcaagagcatgttatgaacagtgaggatattatcaaatctccagggtcctctaattaatcccataaattgtataattgtcaccagttggtgaacatatttaaatctagaaacaaaatctttctttttttcttaaaaaaaaaggattaatcttgctaacagttatatgccagtctttatgcatgaacgtgaatatgtttctatccaaattgaaaagtaaacagttgctgaaatgtattcatattaacaacattttacttgtatataattaatctggggaggctgaacttttctttgctagctttccacatactgtggatttgataatagggaggcatgcacagtgtagagctcattaaaaatctgcagaatgacaagcatatctaattattttgagtatcattccttttataagttgaggggcgaattatagtttaccctgtggccatgtgggaaacccaaaagtagtttaagctgaaaagacatcttgaccattttattattttgaacataggacctgaatttggcaaaaaagagttgttatataagggtctaaagataagaaatggctggtgcggtggctcacgcctgtaatcccaacactttgggaggccgaggcgggtggatcgcctgaggtcagaagttcgtgactagccccactaacatggtgtaactccatctctactaaaattacaaaattagcttggtgtggtggtgcagcctgtaatcccagctagttgggtggctgaggcaggagaatcgcttgaacctgggaggtggaggttgcagtgagctgagatcatgccacatgcactccagcctgggcgacaagagctaaactccatctcaataaataaataaataaagataagaaatgattgcagtcttgatatatagtgaaactaaagttaaatacagcagtaagtgataaaaattattaagaatggtagcatttttaaaaaacaagggatttaggcatatgattcatgagctttatgaaaaacacaaaaagtaacagtattttggtgaatctctgctctctaggtgtagactgagtttttactgttttaaacaaatgatgtgctcagagatcagttgctgtttaaatggaaataaaacctacattttaggtgtgatttttcttttttagagacaggatctcactgtgtcacccaggctgcactccaagtggcatgatcacagctcactgcagccttgaactcctgggctcaagtgatcctcccacctcagcctctgaagttgctaggactacaggtgtatgccaccatgtcaaattattttgttttttttgtagaggtagggtcttgctatgttgcccaggctggcattttaattttattccttttgtgtactatccatataatgttttgcacaaaaatcttttccacaaggcattttttacaagaaaatccataacatttggccagctttgtcaacatgtaatatataaggcgaaattattccatttttctccttgataaatcaagaaacacatgtattatcttgcaaacacatcctcttacaatcatagataacatttgacatttttaaggcagcagaagtaagcatgtatactaatgtgatcgaaaggtatttgtaaatcctttcaccctattaactggacaatcaataaacaatcaagactgggcatggtcgctcacccctgtaatcccagcactttgggagtctgaggagggaggatcacttgagcccaggaggtggagaccagcctggccaacatagtgaaaccccatctctacaaaaaataaacaaattaccttggtgtgatggtgcataccagtagtctcagccacccataaggctgaggtaggaggattgttggagccgaggaggttgaggctgcagtgagctgtgatcacaccactgcactccaacctgggtgacagagtgagaccctgtctcagataaataaatagtatcaaaataaggagccaggatagttgtgtgtgtgtgtgtgtgtgtgtgtgtgtgtgtgtaaaaattatgtttcatgactcaattttcaaaagatactcttggctgggtatggtggctcatgcctgtaatcctggcactttgagaggccgaggtgggaggatcccttgaggactggagtttgaaatgagcctggacaacatagtgagaccctgtttctaaaaaataaaaaaatagctgggctggtagcatgcacctgtcatcccagctactcaggaagctaaggcaggaggattgcttgagcccaggagtttgaggctgcaatgagctgtgatcagaccactgcactccagtttaggtaagagtgagaccctatctcttaaaaaaataaataaataaaataaatatatatatgtatatatataaaattatgcttaaacattatatattcaaaggttattcattaatattagttcaaggtcttaaagattttgaaattataatttaagttgatattataacacaggagcaaaagtttatattaagagtttgttaaagaaatattaaacatatttaccttgatactgtaatggaatagctaagttgttcttttttttttgagacaagatcttgctctgttacccaggctggaatacaatggcacaatcacagctcacttcaggcttggcctcctgggctcaaacgatcttcccatgtcagcctccagagtagctgggactacaggtgcaagccacaatgcctggctaatttttgaggtttttttaagagatgggtctccccatgttcaccaggctgtagactcagctcttgtgatccttattattatagaaagttcagccgggtgcagtgactcatacctgtagtcccagcactttgggaggctgaagcgggcagattgcttgaacttaggagtttgagaccagcctgggcaacatggcaaaaccccatctctgcaacaaatgcaaaaaattagccaggcatggtagcaaccacctgtagtcccagctacttgggaggcagaggtgggagaatagctcaagcccaagaggtcgaggttgtattgagccaagattgtgccgctgcactccaacctgcctgaaaaagggataccatctctcaaaaaagaaaaaagaaagttcataagagcaaacatttttttaaaagcatcagttgttttcattcattcgatttaatgtaatttttatattttaataattttaaatattttgtggaaatgataactcctgtaattcatataaatagttacataatttaggaagtttaaattaattaagctttccatgagaaaataaacccaaggcttatttaagttagaatagtatgttaaaaatcaatgtttatactgtgataaagtcaggaaaacacacatagatatttataaatccaaattatcaaactacatagtctgatttctccagggattcatcttcattagaacattacctgaacttttttcttccctttttcctttttttttggagatggagtcttgctccgagacattacctgaacttttttcttttcttttcttttctgtttttttttttttttttttttgagatggagtctctctctgtcatccaggctagagtgttgtggcacaatctcagctcactgcaacctcctcctcctggattcaaatgattctcctgcctcagccgccctagtagctgggataacaggtatgtgccaccacacttggctagcttttgtatttttggtagagacagagtttcaccatgttggccaggctggtctcgaactcctgacctcaggtgatctacccaccttgacctcccaaagtagtggggttacaggagtgagccagcgttcctggcagaacttttttctgtgtttatatattaattaaaaaaaactttcataaagtttgtttcaaggtactggaatttttttccatttttctttatttgatttttgtgttttgtttttaccatgttttcaagcttcttattttatattctaccattcacagccattaatttaactcactgctgatttttccctgaggtacaccttcagcaaggatttgagagttttttgttttgttctgtttttcgttttactgtttccattttttaaagagaaatttatgggtagctagtaggtgtatatatgtatggggtacatgagatattttgatacaggcatataatgagtaataatcacattagggcaaattgggtgtccatcacctcaagcatttatcatttttttctgttataaacattctaatcataccctttcagttgttcttaaatgtacaataaattattactgactataatcaccctgttgtgttgtcaaatactggctctttttcattctgcctaactatatttttctacccattaaccatccccacttctggctccccccgctctaccccactacgcttcccagcctctggtaaccatcattctgctctctatcttcatgagttcaattgttttaatttttagctcccacaaatgagtgagaacatgcaaagtttatttttctgtgcctggcttgtttcactgaacataatgtcctctagttccttccatgttgttgtaaatgataggattgcattctttttcatggatgaatagtactccattgtgtatatgcactacattttcttttccgtttgtctgttgatgaacatttaggttgcttctagaccttggctattgtgagtaatactgcaataaatatgggcatgcagatgtctcttcgctatactggttttttttctttggggtgtatacctagcagtggggttgctggatcatatgatagttctattctttgttttttgaggaatcaccatactgttctccatagtggccgtactaatttacattcctaccaacagtgtatgagaattcccttttctccacatccttgccagcgttcattattgcctgtcttttggataacagccattttaatcggtgtgagatgatatctcattgtagttttgatttgcatttctctgatgatcagtgatgttgagcatcttttcatatactgtttgccatttgtatgtcttcctttgagagatgtctgttcagccgggcgcagtggctcacgcctataatcccagcactttgggaggccgaggcaggtggatcacgaggtcaggagatcgagaccatcctggctaacacagtgaaaccccgtctctactaaaaatacaaaaaaattagctgggcatggtggcgggcgcctgtagtcccagctattcggaaggctgaggcaggagaatggcatgaacccgggaggacgagcttgccgtgagcggagattgtaccactgcactccagcccgggcgacagagtgagactccgtctcaagaaaagaaaagaaaagagagatgtctgttcagatcttttgcccatgttttaattggattattagatttttttcctattgagttgtttgagattcttatatattctggttattaatcccttgtcacatagatggtttgcagatcatttctcccattctgtgtattgtctcttttattttttttgagacagagtctcgccctatcatccaggctggagtgcagtggtgtgatctcagctcactgcagcctccacctcctgggttcaagcgattcttgtgcctcagcttcctgagtagctgggattacagatgcacaccaccacacccggattatttttgtattttcttttttcaattgagacagggtttcgccatggtgaccaggctggtctcgaactcctgacctcaagtgatctgcccgccttggcctcccaaagtgctgggattacaggcatgagccagtgcacccatttcattggagtattttaacataaaactaaggataattgcataacttctttcaatgtagctatcccacgtaaggtaaatctggccttacaagaacagggaaaaaagctgggcgcagtggctcatacctgtaatctcagcactttgggaggtttaggcaagcagatcacttgagcccaggagttcaagaccagcctgcgcaacatagggagacctcgtctctatagaaaaataaaaaaaattagccggatgtggtggtgtgcccttgtagtcccatctactcacaaggctgctgaggcaggaagatcacttgaactggggaggtcaaggctacagtgagccataatcctgtcactatacttcagcctgggctgcaaagtgagattctgtcttctgtctcaaaaaaaaaaaaaaaaaaacctggatgcagtggctcacacctgtaatcccagcactttgggaggctggggtgagtggatcacgatgtcaagagattgagctaatcctggccaacatggtgaaaccctgtctctactaaaaatacaaaaattagctgggcgtggtggtgcatgcctgtagttccagctactcgggaggctgaggcaggagattcgcttgaacttgggaggcggaggttgcagtgagccgagatcgcgctactgcactccagcctggcaacagagcaagactccgtctcaaaaaaaaaaaaaaaaaagaaagaaagaataaagaaaaggggaaaaaaaggaatccttgataccttcctcttcaagtccagcatctggttctttaaatacacatctcatgtgacatggaaacgatcttttgaaaaaaacagccatggagtagtttctcttgctgccaccaagtgtgtcccttggactgaaaatgagaaagctgagttttgtgtgtgtgtgtgtgtgtgtgtgtgtgtgtgtgtgtttttaaagagcagcaaatctaaaacatcagaagtttattagaagttttatttttttattttcttcctggaaattcttttttttttttttttttttgagatggagtctcgctctattgcccaggctggagtgcagtggcgcggtctcagctcactgcaacctccacctccggggttcaagcaattctcctgcctcagcctcgcaagtagctgggactccaggcgtgtgccaccatgcctggctaatttgtgtatttttagtagagttggggttttgccatgttggccagggtggtctttaactcctgaccttaggtgatctgcctacctcagcttcccaagtgctgggattataggtgtgagccaccgtgcctggcttcttcctagaaattcttgagttttctcattttatgtttagctacttgattattagtcttcatagtgaatcaaaacagagatgccattaaatttaacagttatgccatctaaacttttcaatctaaatcattaatttttttttggaaataggcaaaattatgctaacacttctgctcagaaatgattgcattcatctcttcccacgtactcaatggaagaacctcatccagccctcaggcaggctggggaactaagcaggattttacagctgggtgtttgcccgttcatatgtgctgtgctctgtaatgcttgttcattcatattgtgcattaagtagaggaacagcttctaagatttattaacacctcattgttggcacatagaactctcccttgcattccagcttggctcatttatatatttccttgggatatcctcattttcttttgagaggagaaaaagtcacccacttcgaactctaaatttttcagaaggttatgaaactccagacaagtcatttccatttccattcaggcttattcccaaagttattaaccaaaccaagcaaaacctttggaaagtctcttcttttgctctaaaacaatgtaaaaccagttttaaaacattttgatattttaaagtttagtaagagatttttgggcctgaatatatatccctatactttattaagtctctaaaagttttgaaacagagaaggccagtgtgagagtacacgtgtggatcatccccttctacagaaaaggttatgattattaaaggccattatcaaaactggtttcttttgtaagaaggaggaaagtacttcttacatctgtggcttgttggccatcctcactttggggaaattttcaacctttattctgtcttcaaatattacttctgtttcatcccttctctttcctttcctctggaacaatgattatacatcagctgggcgcggtggctcatgcctataatcccagcactctgggaggccgaggtgggcagatcacctgaggtcaggagttcgagaccagcctggccatggtgaaaccccgtctctactaaaaatacaaaaaattagccaggcgtggtggtgcgtgcctgtaatcccagctacgtgggaggctgaggcaggagaatcgcttgaacctgggaggcggaggttgcagtgagccgagatcacaccattgttctccagcctgggcaacaagagcaaaattccctctcaaaaaaaaaaaaaaaaatttattagactttttcactgttttccatatagtctgatatacttttttttttttttattaaaaacatttttttttgagacaggatcgtgctctgttgcccacactggagtgcagtggtatgatcatagctcactgtaaccttgaaccccttgactcaatcattcctcccacttcagcctcccaatcagctaggtgaggagacagggtcttgctttgttgcccaggctgatcttgaactcctggcctcaagtgatccacctaccttagcctcccaaagcactgagattataggcatgagccactgtacgagcattgaaaacctgtgaaatataacatatgcagagttgcatataactgcccacacagggtatcaaacagttccatgacactgaagagctacctcgtgttattcctttgcactcataccctttcctacccctaacctctggcaaccacttgtctgttccccatcactataatttggtctttctgagaatgctttttttttttttttttgagatggagtcttgttctgttgcccaggctggagtgcagtgttgccatcttggctcactacaacctctgcctcccgggttcaagcaattcttgtgcctcagcctcctgagtagctgggactacaagtgtgtgccaccatgcccagctaatttttgtatttttggtagagatggggtttcgccatgttggccaggctggtcttgaactcctgacctcaagtgatctgcctgcctgcctgccttggcctcccaaagtgctgggattacaggcatgagctaccacacccggactagtatataaccttttaaggttgtctttttttcattcaacgtaatgcctttaagagtcatctaagttgttttaaaaattaataatgcatagactttttagtactgagtagtattccacttatgtatatgccaccattaattttctgttgactcatttaaggacatttggaccatttttggtttttggtgattgtgaatagagccactataaacattcatatatgggtttttgtgtgaacagatactttcaattttctagggcagttatgtaggagtggtattgctgggtcatatggtatgtgtacttttaactttataggaaattgccaaagtggccgggagtggtagttcatacctgtaatcccagcactttgggaggccgaggtgggaggattgcctgagctcaggagttcgagaccagcccgggcaacatggcaagatcccatctctattaaaaaaagaaattgccatagcgatttccagagtgattgctgtcatctatttttgaaaaaatttcctaaacttaagcagttccgagtttcactcttggctttcctgcctttgtgacaaatgctggagttctaagcgtatgtgtctctcacgttagaagcataggtgtctctaaggtagtttgtgtggctcactttgtgtgctctacaatttcaagaactgcacctcagatgttggaggatgacagcaggtgtggacttgaatggattggctcctaggttttcacacagctgccttttttctttgtgaccttgcacattatgtcgtttctttatatagcctctacatttgaaaaagagattaataacatatatggttgttacaaagattaaatgggaaaaaaaagttctaaatatatgtctgaaatgtaatgagtagtcaggacacttcagctcttgttcttaaattacctgcaagatgtaaacgtgatacaaaatcaaacacgtcactctgaattttcagctctaaaggtcatttcgtaatcaaacctgttgacagtgacctgccgcgtttagtggtcctcataaagtccagaaattctcctgtaatgttttagaaatagaaagggaggtttctttgtgtctctgtcacagtgcgtggttataggagctgaactaaaaatatgttgttgaagtgtatctttagaggaccagaagcaatgagttcaaaggctgtgcttatttcagtagaattttttaatggcatttatttcacaaatgatcttgcttgctctcttctagttctgggattaccgccagcctcggaaatacctcaatattcttccttgccaggtgcctgtctggaaggccagatacacagtgagtgagccaccctgcctcttgataagaaacttctttttgggtgttccaaaaagaaggagcccggggacattttctcttattttctttgtgaggtgattttctctttctctgttggtttagtggtgggacaaacgtgataatgatagcttaaatgctgttaactacttaaaattttattcttggccgggcgcagtggctcacacctggatcccctgaggtcaggagttcgagaccatcctggccatggtgaaaccccgtctctactaaaaatacaaaaattagccaggtgtggtggcatatgcctgtagtcccagctacttgggaggctgaggcaggagaatcgcttgaacccgggaggcagagcttgcagtaagctgagatcgccccactgcactccagcctgggtgacagagcgagactccatctccaaaaaaaataaaaaaataaaataaatttattcctggagtgttgggtaagtatctacatcagaattgctgatcaaagctccacagagaagctaggccatgtaaagatactcactaatggtagggccggcagcagggtagatggaggagagggtcaggaggcttgaggtctgtgaattgtggtggaaggaactctggctttaaattcagaagacctgggctgggggccatgctctatcatttaatactggtatggccttgggcaagccatttgatgtttttgagcagaaatttcctttactgtagaatatgaatagtaatttttactatgccctcctttttttaaaattgtgataaaatccaccaaagtatacaattctgtagttcacaagctgactttcttttgaaataacttatatgaatgtgctttctaaaccattaaatgctacaaatagagtgggtaggctgttatcaaccttctagtaattttccattgccacacgggtgagagataatgtatttcctttaatgtcaatctgaaagctagcacagggatggataaagctacctttatacattgggctgtcaccatggagcattgtggagcaaaaaaggtaatttgggtattaagttggttttgtacctgggatcgcttgccaagaaatcagacactcttcttaggaactgaaatacttttctggattaatatgtttgctttaaaaaataaacagaaaagtccaagagtgctaccaggaggggcggtgaagataaatgtgctctttggtgactgtggtttattccttaaataacagagtctaattatcaactgaatggaacccttagctacccagtagtttgggttttgccaagtaaaacatgtcagtcctgaagcgagcaagttttcctttgagcagttgcagtgccgggggggcgggaaggtgatgcttcatgtggatggcgtttttctggtgcatttccacgtggcaagaattaggtctgctgctccagggattttccctgtcagccctgcatgctcattctgggaaagcactcagtatctcttgagtggtaactcatggagagtagctaggatgtgaaacagtgtgtttcattgcatagcaatcagtaccatttgcttattttagaattttcaaagttcttcaagcgcttgcctcagcctgagttttcacttgctttggtcccttccataagcaaagagaaaagtagacgcgatgtgcagcctatggtgtttgggaaaaatttctccagatgagttggggccttccattatctaatttattttacttaggaagaattccaggtttggaaactcaagactcagctgattctccctgaaataatctaatcacctgcttttcccttccctgccttagcctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaaggtgagtgggagaggcctgctgcccactttccttctgagctctggtgacagcggtgccagtcagtgttgccatggagtccagtaaagaagacatagagagagctgggctttaggaaccagagagccagggctgttgccacctttcgtcataggtgagtaaagggactatataaggctgctgttactcttccaaattctgtcctcttccacaattgtcagcgtagtctctcttgcttggaagagatatgctccagtaagagacggaagatagagatttgctgttggattgtttctgggactgaaagactctgggctcagaagtccagggcatttgccccttgccactctgttgatgagggagacccaaggtggtctttagtactgcctactacataccctcagttgtcttcacaagcatgtagtgctctgtctcaaaaaagaaaaaaaaaaagaaaacagatgatgtgatttcctcagtccagtggggaggggttgaccggtagttttggatggaaataaagtttttaggaacccattgttagttacccatgttgtctttaagctggtgggtgagttgtgtaaattggaactgcctggccagtagcaaaattttgagtacgagttactatttaactttttttttgttttaactgtggaagaggggaataataaagactggggcctacttgaggacggagggtgggagggggagaggatcagaaaaaaataaccattgggtactaggcttagtacctgggtgatgaaataatctgtacaacaaacccccatgacaggagtttgcctttgtaacaaacctgcacatgaacccctgaagctaaaatgaaagtttaaataaaaaaaaatttttttttactgtgaaatatatcatgtatttgaaaattatatggaacatgtatagtgtaacaaataattataaagtgaaaatctatgtaattgccatgcaggtcaagaaagaaaacgatgccaagagccccgaagctacctggtcaccatcccctcccttccctgagagtagtgactcctctaatgcttacgatagccattgctggatttttcctttgtggtttcactgcctatttttgaatccctaaaagtagtttaggtttgcctgtttctgaaccttttgcaaatttaattattatgcatgtgtttttatgcaggtgttccttatgatggggttatgtcccgataaacccattgtaagttgaaaatatcataagtagaaaatgtattttaggccaggcacagtggcttacacctgtaatctcagtactttgggaggctgaggtgggcggatcacttgaggccaggagttctggccaacatggcaaaaccccatctctgctgaaaatacaaaaatgagccaggtgtggcagtgcatgcctgtagtcccagctacttcggaggctgaggcaggagaatctcttgaacccaggaggcagaggtttcagtgagctgagattgtgccactgcactccagcctggagacagatcgagacagtctcaaaagaaaaaatatatatatatatttaacccacctaacccactgaacatcatagcttaagtagcctaccttaaacatgctcagaacacttccatcggcctacatttgggctaaatcctctaatacaaagcctattttataaaaaaaagtgttgaatatctcatatactttattgaatactgtgcattatgttaaaattgtgacagtttcacgccatcataaagtcaaaaaattgtaagttgaaccattgtaaattgggaaccatctgtattttacttctttctcagctgaaggttgttccagtttacttttactgccatgtcttcgacatcaattttttttttttttttttttgagatagggtctcgctctgtcacccaggctagcgtgcaggcacgagcatggctcactgcagcctcgacctcctgggctcgagcagtgcttccacctcagccacctgagtagctggcactacaggagtgtgccaccatgccagctaattttttgtatttttgtagagatgagtttcaccatgttgcccaggctggtagtcatcaatttttattggaccacttcatgctttgattttcactgtggggaaggatttctcaaagaggtaggaagtgagtcaggatattgtggccaggggacaaggatgcctcctgagggaagcagtagtccttggtttcaggtgttgctgatagatcaaaatgtagagtaagagaaaagcatttaactgaccaaataggaagccatataatcattaagaaaggagttccaggccaggtgcggtggctcacgcctgtaatcccagcactttgggaggccaaggcaggttgatcacttgaggccaggagtttgagaccagcctggccaacatgatgaaaccccatctctaccaaaatatattaaaaaaaaaaaaattagccaggtgtggtggcacgtgcctgtaatctcagccaccctggaggctgaggcaggagaatttcctgaaccaggaggtgcaggttgttgcagtgagctcagattgcatcactgcactccagcttgagtgacaaagtgagaccctatctcaaaatacaaaaaattaaaaaaaaaaaggtgttccaagagcaaattgaggagagaagccagatcatagggtggcatgaacaggggcagcaggaaccggttttagtgaatgaagtaaccctcaaaggcaaggcgtagaattagccagttgggagaggctgctgccctctctgttggaaggcagggagaagatacaagggagtcggggaagcaaagggccccttgggaccagcgggggaggcacaggtcgaggggttgagttaatttataacatttagaaaggaattaggcataccttttcgtcaaagtcaggggcaggaagagaagccagatgtagggtcagaagattgttgatgtggacatgaggcaagatggtggcacttgtaacaagccgtggttcagaatagttgctgtctggctggctgtgcctagtgatgtatgaaatattgaagagtgaatttttggttgaaggtggtgatgcagagaaggaaccaataagaactggcccttgttttcctgcccactcaccctgtgaccttggacagatcatattctcttgcctcagtttccccatccataaaattaagaaattggatgaaattatttctaaaatctttgctctctgaaggtggccatgaaggagattctagatactgcataattatccgcaaatgtcctgatctttcatgaagttatttcataaagcaccctgaaccttttcaggataatttccctttgaccagagttaagatgaaaatatgattcagtcaattaagtacattaaggattgattattcattttacaaagagatacatcactttaccaaaaaattcttttgaatggtaagatgccatgatgcatttgaaataacccgttttgcaaaaatatgttcatctccagctcttcgagagcatgtaaaaggacgaacatttgcagaggtgaaagtttagtgtgacattaaatcccagcatcgctctttacctgctaatttgccagttagtatttcacatcatttaagtttctgctcaaatgtgatttccttggggagttctatctaaaaatagttccaccatcagtctctgtcctcttatcctgtgttattctttataccagatgttttatcagatatttgtctctttctaccactggaatgcgagatctataaagatagaaattattttattcatgctgtagtcctggtacctagaatagtgcctggcatatgagaaatgttcagtagatgtttgttgaatggatggatgaatctcactccatttcaacctctagcaaatagacgttgaatccagaagaatttccaggattcttatttggtgatttctagggtccaaggactatcaactggtgacgtggtcccgggatcagaccttgagaatgtggcgggtggattcccagatgcagagggtatgtatgcagtgctattgtggagaaatgtacctgaatccaccaaaaagtgtaagattcaggatttgcggaaattagaggttacaggataaacaattttttttttttttttttttttttgagagtgcgtctcactgaatcgcccaggctggagtgcagtggcacgatcttggctcactgcaacctctgcctcccgggttcaagcgattctcctgcgtcagcctcctgagtagctgggattataggcgcccaccaacacactcggctaatttttgtatttttagtagagacggggtttcaccaagttggccaggctagtcttcaactcctgacctcaagtgatccacctgcctcagcctcccacagtgctgggatcactggtgtgagccaccttccccggcaggatagacatttaatacatacttactggttggctgagtagctggtgtgtaccacaccaaggctttgaggtctttaagaaccaacttcagtattcagcactttaaggccagagagcctctaaatgtctttcccctccttattctagcataagatagtatgggtagctccctgagtatgtgccctgtgggttcatttctttctcttctaaatgggctaagaagcctacccttgtacgctgcaaatgcttggaggcttctacatctatcagcaacactgcttttatgaagctgtttgtaattttttcccgataaatgatatctgtttcttacatgaaccacacacagtagtacctggcatgagctgctttggtggcccttgctctgctctgccttatcacagggttctgtcctctcctcatttgatggctaaatttcttgacagtgggaaggtgtctcacttgtattggatctcccacagcgcttggtacattgctttgcacagaatgaatagaaaatactggataaaaatttcaacactgcttagtatgaagtcactcttgagcagtttgatcaaatctcattaccttattgcattttcaatctgttttttccaaaaggtacaatttgcaccaaatgccttgaggttatggttttcgtttttttttttttgagatggagtctctctctgttgcccaggctggagtgcagccacgtgatctttgctcactgcaacctctgcctcctgggttcaagtgattctcctgcctcagcctcccgagtagctgggactgtaggcgtccgccaccatgcctggctagtttttgtatttttagtagagacggcatttcaccctctaggccaggctggtctcaaactcctaacctcaggtgatccacctgcctcggcctcccaaagtgctgggattacaggcatgagccactacgcctggccggttatgatatttttgctcctggattagctgaataactccatcaaagcttggagtttaaattaattttttttctgaggcttgcataaactctgaacatgatgaaaaaatttccagtgttgaataatagagtctgttatccctggtgtttaaccagggagagttggcaatgggtaaaatctattttgattatgtcagctcttggctgacacatccccatcctttgcccttcccatttttaagtcagaactctttaatcagacatgacaatcatttccacggacttctctagaactacatcttctaccctttgttgcagctttgtgcaaatgacatattagatggtgttgatgagttcattgagagtatttcccttctgccggaacctgagaagaccctgcacactgaagatacagatcaccagcacactgcaagccatggggaggaagaaggtaatttgtcaaactgatgtctcaggtaaggtgccactctacgcattgcagagttgtggcagataccccagacctgttctctgtttcattttcaaaaatgctttccaacattgaacttctctctcctgctagccctaaaagaagatccccctagaaatctcctggaagagaggaaatcagatcaactggggctgcctcagaccttgcagcaggaattctccctgatcaatgtgcaaatccggaatgtcaatgtggaggtacttagtttaatcaactgtatctcatgtttgctgatggcagtttgtgggagagggaaccatttcagcaatgatttcagttagcaaatagctttgcagctttaacagaactctctctgcttgcttttttatttcctgggttttctggccaggcgcggtggctcacgcctgtaatcccagcactttgggagtctgaggtggacagatcacttgaaaccaggaagccaggagttcgagaccagcctggccaacatggtgaaaccctgtctccacttaaaaaaaaaaaaaaaaattagcctgtaattccaactactcgagaggctgaggcacaggaatcacttgaacttgagaagcagaggttgcagtgagccaagatcgcaccactgtcctccagcctgggtgacagagcaagactctgtctcaaaaaaaataaataaaataattaaataaataaataaataaataagtaaataaagagatgcagactttctttctacccctattcttttctcctaagatgagccaaaggagaacctgatgctcgtgtgccttagctcctccttagatgctccagcatctcattttactgtagaggaagatacttaggccctggaggcttagtgatttggcagaggttgctgctgaagttgggaacagagttgacttgggaagccaaacctccagcccgtccagggcactctgtgctgtgctgtgctgtgctgtgctgggctgtgccatcttctctcacaggctggccatttcctggtaatttagattcacagtaagaaggcaaccaaaacttctttgttcgcttagcctgtggaacagttacttttttgggggcaagtattgaaagtctttgcttcagaaaattgagtatctctccagaaaggagttttaaagcttgattagtttttcctttacccaaatatgtgctgttacataactatctcatgtggcttttaaaacaagtctgctggccaggtgcggtagctcacgcctgtaattccagcactttgggaggccaaggtagacggatcacaaggtgaagagatcgacaccttcttggccaacatggtaaaaccccgtctatactaaaaatacaaaaattagctggtcatggtggcgtgcgcctgtagtcccggctattcacgaggctgaggcaggagaatcgcttgaacccaggaggcagagcttgcagtgaggccgagatcacaccactacactccagcctggcgacagagcaagactccgtctcgaaaaaaaaaaaaaaatagtctgctgtaagtggttttagcctcactttacagctgaggaaacggagacatcaagagaagaaatgtccaaggtcagcagctatttggtggaagaaacaacatgtgaatccaggtctccagatttgccacatgtggttcttttctctttactccagctgctgtctctagttggcaacacaagaaatgaaaagatataaaggattctttgcttaattagtgatctatatcaagtcagtttatactccctttgtcccatttgaggacagtgtggatacctagtgatctagtttaagatcttgattcctttcttcgagagtactttaaaaaaattattgagatataattcacacagtataaagttcatctttttttttttattgagatggagccttgctctgtccgctcagactggagtgcagtggtgctaccgtgactcactgcaggctctgcctctcgggttcacgcgattctcctgcctcagcttcccagatagctgggattatgggcgcacgccaccacgctcagctaattttttttcgtatttttagtagagatggggtttttgccatgttggccaggttggcctcgaactcctgatgtcagttgatctgcccaccttggcctcccaaagtgctgggattacaggcgtgagccactgtgcccagccaaaattccgctttttaaagtatataatctggctgttgtgggtatattcacaaagttgtacagccattaccattgtctgattccagaacatattcatcattcccagaagaaaccccatacccatgagcagtcactccctatttccccttccctcagcccgtggcaatcccgaatctactttcttcccctatggattttcccaggagcactttttaagttgagtctggtatttaacttcttcctgctttattttcccatctcaaagtaaatataacaagtttcagtctaccccacagctttgggagggaggaagctttgttaaagtcagaatactttgaacttcgtggtggctcatgcctgtaatcccagcactttaggaggccaaggtgggtggatcactggaggtcaggagtttgagaccagcctggccaacatggcgaaaccccatctctaccaaaacacaaaaagcaaaacaacaacaacaacaacaaaacaaagatttgctgggcatggtggcctgtagtcccggtatttgggaggttgaggtgggagaatcacttgaacccagaaggtggaggttgcagtgagctgagattgtgccacactgcactccagcctgggtgacaaagtgagaccctgtctcaaaaaaaaaaaaaaagaatactttgtgttgggaacaggccccctgaaatctggccataaactgaccctctgtgttgtttgtctttgtatagtctgcagatgtggatcttgactcctgcaagaagtagctcaccgtgacaaagctgcctttgcttttatcactttgcaaatcaaagaagggggacatgttgggaacaggcccccccccccaaaatctagccataaactggccccaaaactggccataaagtctctgcagcactgtgacatgttcatgatggcggtgatgcccacgctggaaggctgtgggtttaccggaatgagggcaaggaacacctggcccacccagggcagaaaaccgcttaaacacgttcttaaaccacaaacaatagcataagcaatctgtgccttaaagacatactcctgctgcagatagctagccacagcccatccctttatttcagcccatccctttgtttcccataaggaatacttttagttaatctataatctatagaaacaatgcttatcactggcttgctgtggataaatacatgggtaaatctttgttcaaggctctcagctctgaaggctgtgagacccctgatttcccactccacacctctatatttctgtgtgtgtgtctttaattcttctggcactgctggtttagggtcaccccgaccgagctggtctcggcaactttgagcttattccattggtttgaaaattttaagaatctggtatgaaaatttaagaatctttttgaaaatgaattgtcttccacacacatttgtctttgtagactctttcccttcattcaattaccaggaacatggagcgttcagttaaatgtgcttgcatcgaaagacgctttatggtttgtttctacagcaattgtggatttgtctcttgcagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaaggtgggggtctgggttcccaaattctccttgctgttctgcatcattgtctagatggattagtaaagaagaatgaaaactccagtagatgagattcggaagtcatctgtttcgtacacacactagtattagcaacgtaacctctgaacttgccatttactttgtgcagaaaacatcagagcagtggttcttaaccttttttgggtcatagacttcctttgaattctaatgaaaattatggacccttcctcagaaaaatctgcacaatgattgcatatgatttgagaaatattgcctgtaaatatgtgaattgcatagaatctgcccacagatctcattaatactatgcattcatctccggttaggagatttgcaatccaatttcatttagcagcccaggttaggagccctgcagtccaatttcatttacctgaaaacaacaagcaagatgtattctgaagctaaaagatattttataattagaaaaaaacatatgtaaggtcataaaaaaaattttatcccatagaaggagctggtgttatcctagagacaggctggctagctgcacagtaggtgtccaggtggaggcaccacagcctggcatctgtgtttaattctgcagattcagagatttaatgcatcagttcatccagagcaaatcaggtggaatctccatgacaaagccccatgagcctcttcatacccgttcagtctgagcagtgtcacaagtgaagggactgaagtattctgacaaactcaggccaagctgaatgttgctcattttttgtccagtttgggtcgtggacacttgattgttccaccttgttgggggtatcacatggaaccaggaaattttcaagtggcttaaggatctctgaaatgccagtaactcagatcttgtggtatttgacatgttaaacttggaatctgaatatgccgttgcctagtttggacatacaaaaaagatagatttttctgttagtataaaatgatacgattaggttgcaaactcttttgtgtgtgaaaaatcagaccttttccgggtgcggtggctcactcccgtaatcccagcactttgagaggctgaggcgggtggatcacctgaggtcaggagttcaagaccagcctgggcaacatggtgaaaccccatgtctactaaaaatagaaaaagtagccaggcgtggtggcgcatgcctgtattcccagcgactcggtaggctgaggcaggagaatcacttgaacccaggaggtgggggttgtagtgagccaagatcacgtggctgcactccagtctgggcaacagagactgctgaggcaggagaatggcttgaacctgggaggcggaggctgcagtgagcggagatcatgccattgcactccagcctgggcagtaagagcgacactcctcaaaaaaacaaaggaaaaatcagaccttggcgatgactcagcagtaggatataaataactcccacaagcttagtgttccaataatggaacattaggcataaatgggtttaaagtgttaggatttatacttttgaaggacaaaaaatatacattataattttcactgaagtgaaatccatgcctcttgtcactgagagcaatttcaatccaggccagtgagtattacttctaaggtactgacgtttctcatggagcaagtggtgttgggggtgaggaaaagggcagagttcactagaaagaagtaatagtccttctgttactgaaagctgccctctcaaaatccacgtgtgctgccttgattaaggaaagagcttctctaggagggctcaggagtgaatcctgttttaacctcggtagaggtagaaattagattattacactgtgttggaaggcttgacttaaccatgcacctggctcccagcatcacccttgtgtctgaccactttgcagaagaaaagccaatcagggccgggcgcagtggctcatgtctgtaatcccagcactttgggaggccgagatgggcagatcacttgaggtcaggagttcgagaccagcctggccaacatggtgaaaccccttctctactaaaaatacaaaaatcagccaggcatgggggtgggcgcctatagtcccagctactcgggaggctgaggcacaagaatcacttgaagacgggaggcagaggttgcaatgagccgagatcgtaccactacactccagcctgggcaacaaagagagactttgtctcaaaaaaaaaaaaaaaaacctatcagagaaatgtgttcctcttcttgactgtgttttgggccttttctagatcctgaaggacacagccctgcagaaagtgaagcgtggccagagctgcctggagccctgcctgcgccagctcgtctcctgccttgagtcctttgtggtgggaagcatgaaactgtcataccaacttaggctttggtgttttgtttcatttctttctccctaaaatcatgggttttctggttttgtcatactgggtctttattttgtagttcagctttaagacaggttgtggtttttagcttgtggatttttaaatttcagaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggtgggtctctttggttctttgattctagatttcgagagggagcagctaagaatgtcatagattctgtataaacatcttcatcagaaaatgtttgcttttactcccgagaactcaaacgagactttcatggtagcgtggcagggtctgaggcccagtcggtgtctgtggacttatcctaagagggtgcaccagaatgggggtcttaactttcttcattctgatgagcttggatttgagtctttactcagagccctgattcttagcagggggcattcgcctggtagggaggcttagagtcctgctgatgactctgcccagtccacatacatcctctctcctggaccctggagcgctgacctttgttcctggtaagggtgactgcagtcaggagtcttgcagcttatgaaaatgtgtcttaccctcaggtgtacagagatagaagaaagactggccagtcctgcctcaggatttcccacggccagcttgttgacactgatggctcatgtgatgtctcctcctttaggttacctggtatatttcacaaggcccatgacaatgcatcgggcggtgtctcccacagagcctactccgaggtgagtcagggagatgcagaagccgctctacgttcccggggccagaagtggccagagacctgggaaggaccactgagtttgcttttggacagtgcatttcagttcttcagtaaactcccattataagatttatttgagaaagattgaagtcaattaaattgcaaaaaagctgtgatttctgctgtatggttattaccaaaccattagaagaggtagcttgataaaagctattgtcaaaacaaggcaaattctttttaaatgtgcctttcccctattgctagcatattatttattatttgtttttaattattttattattcaatttaactaacattaaataaaactggaaaaataacaaaagaccatctgtagtttcacagcactaatatgccacttctaatattaccaaacaatatgtaattttaaaacattccataagtagtacattgtgaaaacacaaacgtggaagtttttttcttttttctttttttgagacaggatctggctctgtcacccaggctggagtgcagtggcatgatcatagcttacagcagcctctgccttctggctgaagtgatcctcctgcctcagcctcccaagtagctgggactacacgtgtgcaccaccatgtctggctaatttttataattttttgtagagatagggttttgcagtgttgccaggctggtctcaaactcctgagctcaagcaatccacctgcctcagcctctcaaagtgctggggttacaggtgtgagccaccatgcccagcctggaagttttaaattacaacgcaaaagcccttcttttcattttccctgttttagagagaatcatgtttaacaacagaacatgtttctgtctagtcattatttttctgtgcattaaaaaaagtttttctttataggcaatctattgtagcagataggaatatagacttcagagccaacgtgcccagatccaaattttggccctgtcattttatgaccttgggcaagttatctaaacttcagcttcagttccttcaacagtaacatggggatcatcatagcacttaccacctgcagttgctgggaagattaagtccctctaaaaatgtttaaaacaccacctggtacattggaagtgctccatgtttcctgttttgattactggtttttaaagctttaggattatacagtagacttctggttccgcagtctggtgaccaagatataataagttgcaaacctccctgctgcaaacccctgaaggcgctggatacagtgtaatcagcatagacattgtattagtccgttctcacactgcaagaattgcccaagactgggtaatttataaagaaaagaggttagttgactcacaattccacatggctggagaggcctcaggaaacttaaaatcgtgttggaaggagaagaggcacttcttacatggcggcaggcgaaagagagtgtgtatgtgaaggagaaactgtcagatcttataaaaccatcaaatctcatgagaactcactcactatcatgagaacagcatgggggacgccgcccccatgatccaatcacctcccactgtgtccctcccttgacatgtggggattgtggagattacaattcaagatgagatttgggtggggacacaaagcctaaccatatcagttatgaatgaatagctgagctaacaagaaagagagagaactggatgagagaactgtgtgagcagacactgctgttttgccaagaggtggccaatctctgcagtaacctgggcagatgtgacctgggccccatgggaactggggttcagtactagggaacacctacattacacccgattccttattggagtagaaaacagtcctgtattctcaaagggaaagaaggaataactgtatctggactttggattggaggggaaaatgttcctattagaatgttttcccactgacagtcctttactgagatagtttacgatacacaaatatgaagtgtatggcttggtgaccaacactcatatcaagatatagaacactgtcctcacccacaaaggttcccagtcccttttccccgcccttcagcacccagaggacaccactctcttgacttctgtcatggtagttttgcctgttcttgaacttcattgaagtggaatagtgcggcatgacctgttttatgtctggcttactttgctcaacttaatgttattgacattgatccacattgctgcatgtgtcagcaggtccattgtatgaatgcaacacagtttgtttattcgttgtcctgtggatagatagttgcatcctttccagttttcggccattatgagcaaacctggacacatatgttcataaaaagacttgtatattaatttctgcacctgaggagcagaattcctcagtcatcagatagatgtatttttaacttgagaaactgtccaaaagtttgtgcacagtggttgtgccatttaccctgtcactagcaatgtttcagagcactggttgctctgtatccactccaaaactgtattgctagtcctttcaaccttaacccttttgttctgagtgggtcctagtatttcactgtggggttttttttttttgagacggagtcttgctctgtcgctcaggctggagtgtattgactggatctcagctcactgcaagctccgcctcccgggttcacgccattctcctgcctcagcctcccgagtagctgggcctataggcgcccgccaccacgcccggctaattttttgtatttttagtagagaccatgtttcaccgtgttagccaggatggtctcgatctgctgacctcgtgatctgcctgcctcggcctcccaaagtgctgggattacaggcgtgagccaccgcgcccggccgtctcactgtggttttaatttgcatttccatgttgatgatgaatgatgtcgagcagcttctgtgtgcatattgaccatttgggtatctttttttgtgatgtgcttgttaagtattttgcccattttgggggaactgtatcttatttgtttctggttgttatctattttggttgcaaattctttgctagatgtatgtattgattttctcttaatctgtggcttgtctttctccctctttaatgtttttcaatgaacaaattttcctaattttgatgatgtccagtttatcactttttaattttatttattttattttatttttttattttttatttattattattattttttgagtcagaatctcgctctgttgcccaggctggagtgcagtggtgcaatcttggctcactgcaagctccacctctcaggttgatgccattcttctgcctcagcctcccgagtagctgggactacaggcgcccgccaccacgcctggctaattttttgtattttttaatagagacggggtttcaccatgttagccaggatggtctcgatttcctgacctcgtgatctgcctgcctcagccttccaaagtgctgggattacgagcgtgagccaccgtgcccggcctatttattttattttttattttttgagacggagtttcgctcttgttgcccaggctggagtgcaatggcgcaatctcagctcaccacaacctccgcctcccgggttcaagtgattctcctgcctcaacctcccgagtagctgggattataggcatgcgccaccacgcctggctaattttgtatttttagtagtgatggggtttctccacgttggtcaggctggtcttgaactcccgacctcaggtaatctgcccgccttggcctcccaaagtgctgggattataggcgtgagccaccgcacctggccttgtgttttcttttaaaagctttatagaaaaataaataaaaatgaaagctttatagatttaaattccttatttgaggtctgtgatccatttcaaattaatttttgcatgtaatgtgagttaaggggtcaaagttcgttttattttgtagagaaaaatagttgttctagcaccatttatgaaaagatttcctttctttgttgaatttgtattgatgccttggtgaacatcaatagaccatatatttgtggtctttctggactctcttttttcctttgatctatttatcctttatgccaacactacattcataatgtacttttctatagttaagtgtttaaatctgataggtcaagtcctccaattatattattcttgtttagttcaggttggctgttctaggtctttcaataaaattataaaatcaacttattagttcctactaaaaagcctgcttgtattttgattggaattgtgttgactctgtagatcaatttagagaaaattgatgtcttaagaatatggactcttccaatccttgcgtggtatatttctccatcgttgtatgtctcctttaatttctctcatcagcattttgtattttcacgcacattttcaaaaattaaatttattcctaggtatttgacgtgttttaatgctactataaatgagcttttaaaatatttattttccaaatatttgtttctaattgatagaaatatagtagatatttgtaggttgaccttgtattcaaattcacttattctagtagtttgtagattcctttgaattttttatgtctgtaatcatagaagcattctatgcttgtgcagataaagcatttttcagtgttaaaagttttattgacttctttttctggagtttccatcttctcattttgtcttctccttttggtatcaagtgctaagaatagcaccacttggaaatatgacaggactgcagccagtgtggataattatcattttcaactacagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcgggtaagtgccagagccgtagcctttgattcttaccccttctcctggattcttgttcctcatctcctgcctggcgcagcagctagattagtaatcaccctgtagcctttcactttcgtaatcagtttgttcaagaaagtcattactttgttcctttcagttggttttacctgctataaattgtgtgtgtatgggtcggggggccgttcttatggtccgtaatctttactccccatttagccttgtccttgtaatctccactcgtaatctccactccctgagttgattcccattatttcagggtagaataccttagcttcaagtcttccatggtattctgatgtttctcagcaaattaaggaatgcctctggagtcttgggatctcaatatatttggaacttgatggttgtgagaagtcttaaagttaatgtctgaaaggttttttgttttttttttttatactaagtctacatggaaatacctatctgagtggaccagatgatacaaaaatcacctgagcttgtccttatgtgcctagtttcttaaataactcattgtccctaaagtagttatcattaagctgtcagaaacctttggtgccaaccatgtagagaaagttggcagagaaagctttctgtgttgacagattgcaggtctggcttaaacagacttctagctgacatgatgttttaaacagagttaccactgagcactgcacaaactcagtccttaggaattctttgttgttatctctcgctcagtgggaaataatggattgtaattaatatttgtttttaaaaaattgaattattttggacaaaacacccatttctaggaagtattagaagttccttcagttcgattgcagtagaatgtccaaccttcttggtttacactgagagttgaccatctctgactttattttagggttgtatgtgactaaaatgagtggcagcaactggtgtttgagaccagaccagtcttgagcaaaaccatttagttgaatagggaaaatgattttttttttttttctggacactttcctatagtccccttcctcacatctctgatggaattctgcccacttggctagtacagacctccttggaacacccactaatctatatcatttccaagtcctttccattcaaaattgttggttcttttttcccacatgtttgcaggtaactggagagatgatttgataaacaggttggaactaagacattttgttgagatgaaagccaggctcatggttgggtacatgtggggttttctttagtgtcagggccaggtcaaggaggtctttcaatccaagaggcagttctgaattcctctccgatttgtgtcgtgtgccacccatgcttgggttcagattgggcagaatagattgactcgtaattttcactttgtgggggtgtgtaaagcccactctaatcaaaataactccagttccaagatgaggcctcttttaagcctgtgtccatgtttttgatggtatggccttttttactacaaacaccgtaattataaagaggaaccaagagcacgtggataattctctcatcagagaatatctgatagtatctgcaggggagtggagaagagttgtgaaatttcaatttggggtggttcccagtgttctgttctgcacagaaagtgggtggttcgagccccgtaatagacatagtaagtggccttttatgttttatttcaaatagtgaccaaataaactggggtgatgctttgattataatttcatatgaaactcttatattgatatataccaaatacacaaaagttcacaaatcaaagttgtgtatagttcagtgaattaataatcacacaggtcaagaaatagaacatttcaggaacctcagaaaccttggattattggcttaaatcatacgaaattgctgatatttgaccatttttgacctaaacaaagattcatgtggttcaacttaataggttaacaagataaaaatgaataagtcagtcattttgtgatgaatttgacataaatttctctctccttgaagtttgttcacatccatcccgtttatgtaggggccaaggggggaattacataagcgtgatatggccatgatatcttacgtgggctgctttacctcccttacaaaggtcgataatccttgaggagcattttctaatcctcagctgcctagtttcacatgtcaaatgatgtcacttttgttgcttttgttctggaaatgattccagtctactaaatttctgtttgtgttttgtggttttggaatttttttttttttttttaagagatggggcctcactctgttgcccattgcccaggctagagtgcagtggtgtgaacatggctcactgcaacctcagactcctgggctcgagtgatccttccacctcagccgcctcctgagtagctagaactacaagagtacaccacatcacccagttaattaaaaacaaatatttttatagagctggggtcccgctatgttgcccaggctggatttctctgtgtttaggtcttcatttttagcccaaatttttctcctacatatttttattccatggtagatctctgcccctgagagctttaaatgagtgagagtaacagaatggaatgtaactgccttaaggcatagcaatgagggaagtatagtgggtttttggtttgggggctttttttggtctgtgttttgtagagatgaggtcttgctatgttgcccaggctggtctcaaactcctgggctcttgcagtcctcccacctcagcctcccagagtgctgggattgtagccatgagccatctcacccagccagtatagagtttttttgttttttgttttgagacagcattttgctcttgttgcccaggctggagtgcaaaggcgcggtctctgctcactgcatcctctgcctccgggttcaagcgattctcctgccttagcctcccaagtagctgggattacaggtgcccaacaccatgcccggctaatcatggtttcaccatgttggccacgctggtctcgaactcctgacctcaggtgatccacctgccttggccacccaaagtgttgggattacaggcgtgagccactgcacccggcccagtgtagtgtatttttgagataacaaaacatcttttagagccatttagagattattgtttgtttctcttgtggctttgtgtgtttttaacctgccctacttaggttatattgttatgttcacccaaatattctctagatggaatgccaagctttgctcctaaaaattttaaaacgtgtgacgcctcaaaagccatcaaattgctaacattcatttgacaagtgaaccgactcttaatagctgatgaaatgttgttcattcctagggtagatcagaaggcccagaacttaggataagctttaggtattgccttgcatacatttaaacattgttgcaacctcccactcttgctttagtttatgttactaaaatagctctcatgtaaataactagagagatctttaagttaatagaataatttctgatctccgtaaacagatactcatattgttagcaaaggtgctttcaagaaggtctctcctcagcattagccccttccttccccccgtttctccagggttcccatttccccatggtgtcactctgaagatagtcctgcaggcccaatgtcaagacacccaattccctcatcaccccccaaacacttaccagaaaaaatttggtattgagcctattcaagaatgtcttctttttaggaatgagtatgtgctctcaatatatgttctccttcttacctcctacaggggaaaacaggcttctgcctatttctccacttgcacaatgatctcagtgtgtgttagtgttcctcaaacctatttgtagttcctttgtcagaactgtgttgatgtcagcctccatataccttgaaatgtgactaaaagaacaatgaaattgaagctgtgtttggagtgtgatggggtgggagggaggtgagggaagccgaattccgctgtgcttaggttcagattttttagtcgttcccatcccaactgtacagtgtattatggtacattggaatccatcggatgtgtgggaagctttcattttattctatatttttcccttttaattttcttggtgtttttcttccctcctcctgggtgtaacgttttcatgcacagatgtctcctcgctctgcccggcggcgttggtccatacaagcaattaacgacttcccggtactgtgcgctgtgcaaatgctctccttaactaatcctgtctctacccgaggcccaagaataaaatgccacctgcctggctttgaggaacctgaaatgacaggcgagctgttttcaggaccagcaacagtcaattttttgcttgggggagttcagacaccaagggctgcctccttgtccaatcacagagtttcaaatggctaatattgtcagggatcctgaatggactcttttggcaaaggaaagttaatgctgggtttcttggaaagaaccctgattgtaagccgttagcttacccaatttcacttggagcatttgtgtaattttttggagctttcaaaagcctacctttggcatggggggagcagaggaagatataagaggcttccactattttgtctctgcttttacagtcctggtctagttcacagagggaggtgcccacctgcttcattggcataacacggaagctagcttttatcctttgggaagtttctgaaacaaatttttttccttaccatcaatattttgtgtagacagtaaaacctccgctgtggacatcctcttttccttttctttctttcttactcctattggccatttcccctcttctgtcttcctctcccatcccttcatgtttcagtagtgccaaggtgacctcacgctgtgcaaggcagccgtgaggctttgtataaatttcatttggtataaagaatattcaggggaatcatcctatagccttgtcatagaaaaccagttggaatcagaagccccgattagcaagtaccactgctgccaacaacttgtaggtggagccaccaacggggccaccttccaaaagcctgtcccagccaacccgactgctgaatttccactgattgtccaaaagtccctgctcccactgctatttaaatagggactcatttagactccctgcccgctctgcggattatgcattgc

SEQ ID NO: 1385 - DNA, 2201 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgaggtgagtcagggagatgcagaagccgctctacgttcccggggccagaagtggccagagacctgggaaggaccactgagtttgcttttggacagtgcatttcagttcttcagtaaactcccattataagatttatttgagaaagattgaagtcaattaaattgcaaaaaagct

SEQ ID NO: 1386 - protein, 571 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVPQLRRENSLLLWNVFDLNTPVHTFVGHDDVVLEFQWRKQKEGSKDYQLVTWSRDQTLRMWRVDSQMQRLCANDILDGVDEFIESISLLPEPEKTLHTEDTDHQHTASHGEEEALKEDPPRNLLEERKSDQLGLPQTLQQEFSLINVQIRNVNVEMDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPR

SEQ ID NO: 1387 - DNA, 45152 bp, Mus musculus
  misc_feature (1)...(45152): n = A,T,C or G
gggcttatggtatttgtacttgtgagttaactgaataactccactaagacttggaatttaagtagattttttttcctcagcatttttactctgatcatggtggaaaaagacaatatgataatagagtcaattatcctttttatttaaccaaggaattttggtgatgggtaaaacctatttgagggtacaagttcttcttcttcttctttttttttaaaagatttatttattatatatgtatatatttttgtttttttggttttttttttttttggtttttcgagacagggtttctctgtatagctctggctgtcctggaactcactttgtagaccaggctggcctcgaactcagaaatctgcctgcctctgcctccgagtgctgggattatatttattatatgtaaatacactgtcttcagacactccagaagagggcatcagatctcattacagatggttgtgagccaccatgtggttgctgggatttgaactcaggaccttcagaagaacagtccgtgctcttaaccactaagccatctccccagctcgaggatgccagttcttgactactctctgtcctttatgattcccattttaaagaaagaactcttgagtcagacacagtgaccatttctcttacatctctagccctacatctttatccttatgttttggttttttggtttttggtgttgctgtcaatcaaacgcagggttttgggcacactaggaaaacacttcagcattgacgcctactctgcacaccaccctttgcccttgctttcagctctgtgccaatgacatactggatggtgttgatgagttcattgagagcatctctctcctgccggaaccagagaagaccccacatcctcaagacatagatcaccagcccagcttaagccatggagaggaagatggtaatgtaactgatgtcctaggggagggaccccactctgcgttccagagttacatagcagagaccccagaactgactaaaacatttctaaaacatttccaatattgcctgtttctcctggtagccataaaggaagaccctcccagcagtttgctggaagagaagagatcagaccaactaggcctcccccagactctgcaacaggagttctccttgatcaacgtgcagatccggaatgtcaatgtggaggtaaggcagagttatacactgagtctctgtcagagtctctgtcagagctgcccaacacaggcactgagaactctggccctgtggaagaacaagaagcacacttaactgctgagccatctctctagctccagtcttcatttttaactcacacgtttctgtagaaatagaagttttaaaaacatagacattttttgaagctcatgtaccatagcatctccgtagcacccagaattctatccccttattttatgatattggctcaaggaaggcctgctgattgtcaggaaacggggcaggctaaggcagagctgagtttggagnnnnnnnnnnnnnnnnnnnntttggagctgcagctcctgtctctccatgctattatactgtgctcttccatctcccctttgtgagctagtttcctcttctgtaaattcagagtgagaagatgaccaaagcctcttgttcacttagtacttggagcagacctggatcagcaggttgttcttcagtgacagaatctaaggagagtgaggccagaagatgagacaataaagaaaacgttaacctgggatcaggaggtcttgcacaagctatgtcttaggctaagcaaacttactaagaaatacagcatctcacatatacagtttccaggggagacatgggatgaagtcagtagaaactggctgtcacacaatgggacaaagtccacaagatgctaatcaagctgctgtgttgcacgaagggagcctggtctgcaatgtacttgtgataccccatgctcagcacagcggccttgggactgataactccagtctcttcaaggggaaaagccaagtacccaggaaccaaaaccttaacttgtttgatgcccagaccgcagccccagactaaaccttgccaagtctgctcctgagcaaggacataacataaaacttggttctttttgttgtttcagcggggcctctgaaagccttggattggcctggctctcaatgtggaacagtgtgtgtgtgtgtgtctgtgtctgtgtctgtgtgtgtgtgtagacttcaagaatctttgtttcagagacctgagtatcactccaagaagggctttgggagctcaggtattcacaataggaatgtgtactacagtgctgtgatttgtttagtctttaaagctgttttgtaatgcagagttatcacgcttcacagatgaagaaattgagacacaaggtacaaaatgacttcaaaggccagcagctgtttggtgggaagacataatatttgaatatttaaatgtagttgaatagttgaggtttttaggtttagctctcttcactaacttgacttcagttgctttttctagttggccacaatggaaatcaacagacctaaaggctactttaatggcttctctgtatcagcttagcctgcactgctgttgtcccagttgagagcagtggtgatctggtgagagcagtggtggtctactgagaacagtggtggtctactgagagcagtggtggtctactgagagcagtggtggtctgctgagaacagtggtggtctgctgagaacaatggtggtcagccttcagaaaggccttgattggggagttgtgcagcttccaccattgcctaattccagaacaaaagacaaaacagaattcaacaaagaaacctctgtgtcttagttaggatttctattgctgtgaagagatcctgcaaccatgccaactcttataaaggacaatatttaattggggctggtttgtagtccagaggtttagtccattactgtcatggtgggaagtgtgcaggcagacatggtgctggagaagatgctaagagttctgcatcctgatttgcaggcagctgggagagaactgatttgaacttctgacacacttcctccaacaaggccacagatcctaagagtacaactctctatgagccaagcattcaaatacaggaatctatggggaccacacctattcaaaccaccacactgtaaccagcaagtgtggtagcacacttctgtagtctcaacactcagggacgttcatgagttcaaggtcagccttagctctatatcaaattccagactagcctggagtacatagtgagacctgtctcaaaaaaaatttaaaaactcctttatgcaactatagagatggatcagaaattaggagtactagccactctctcagaggacccaagttaggttcccagcactcacatggcagctcataactgtaactctaattcaggggacctgagtccctccccaagcctttgtgggtactacaagcatgtggcacacatgcatacagatagaaagtcttttaaaagaacatctatacctgttatcagttactctccattgcccctgctcctacccatcccacaccccattgcccctggccccacagtcactattttattttctgctatccattctctcaggagtttttaagttgactcgggttatgtctttcaacttcttgctttatttattttttttcatcacaaattaagtatacaagttttagtcagcattgcaactttgagatgctttttttttttaaagataaaaatattttgcgtttggggctgaagcgatagctctctggttaagagcacctgctgttcttccagagggtctaggttccattccagcacccacatgatggatcacaacctctataactcagtttcagggaatccaatgccctcttctgccctccaaaggcaccagacatatgagcagtatacagacatacctatacacataaaattaaaaaataatatatatatatatatatatagaatttatttaaaccagtannnnnnnnnnnnnnnnnnnnnnnnnnnnnnnnnnnnnnnnnnnnnnnnnnnnnnnnggacatgacaggtcttgcctattcaaggccggcgttgaggctcagcccccgcaaaagacgatgcggcacagtatgataaggtgtgcaggtgcctctgcagtccctttgctgtttgtcttgcagatggacgctgcagaccggagctgcacagtgtctgtgcactgcagcaaccaccgtgtgaagatgctggtgaccttcccggcgcagtaccctaacaacgctgctccttccttccagttcattaatcctaccactatcacgtctgccgtgaaggccaagctgctgaaggtgaggctgggctcccagcgttagtctctcctcgtggctgtaacaggccgtggcgagcttgaggacaaacgtggagcagtggctgtggaagctgcccattccccgaatgctgcagttcctgcttcatagccactgtcctggctgcccacttggtgcagacagcggcaaggcagagtttctctgccttgagtttctttggccagagtaaccctggccatcctggaacatgctctgtagaccaggataaaataattttaagatgaattaattttaatagtacttttctttaacctggcacattttaaaaatattaccatgccaacatataattagtgaaaatgagccagttagtatagtcctgtaatccaagcatctcgaatgggaggcaggaggatcaggattcaaggttatcttcagctacatagtttgaggccagcctgggctacatgagaccctgacacaatccctcaaatgagatattttacactttttacttttgatatcaagccttctatacagttgtgaattttatatgtgctgcagctgtgagtctgaaggaggcgcaccaccgtgcaggcagtgacggcagtggtcccgttaatgtgtccgtcttaatgcgggtgtcagtttatatctctgttactgtttagtggataaaaatataacaatatgttttaacttttgctgaatagaagtctctgccctggcctatatcacttgaagcagttttctctgcagcccagtgacggtgtttttaaaacaatgagatttttcatgtgtggaaggaaactgtagaactcactagaaagagagagtagtcattgtagtctgtgtaaggctctggaaacctcttcccttgagcacctgtggggaccactagacgccccaggcctggccgtgtgctggctcctgtgccgtcacgctcccgggcactttgcagagtatagccaagcaggaagcatatggatggctgattctctccctgatggaggtttggtttttttccagatcctaaaggacacttcactgcagaaagtgaaacgcaaccagagctgtttggagccttgcctgcgccagcttgtctcgtgccttgagtcttttgtggtgggaaccatgaacttgttgagccaacctgtgctttagtatcttgtcccacttcttatcccaagaccctgactccctttgtggtactgtaccattgttttgtaatccaacttagagatacactgtgggttctagtgtgcttatctttgatttcagaaccaagaggacagtgcttctagcaacccatttgcactccaaaactctgtcacaccacccttgccgacatttgcacgggtgaccactgcctacggctcctaccaggatgccaacattccctttcctaggacctctggggccaggttctgtggagcaggttggtttctttgttgttctttggctctcaactctgagagagtgtagctaagaaaggcttatattctgtattaattatcagaaaatgtttgctttttacttcccaagaactcagaacaacatatggtgcaatgctaaattggtatctgtgagtatagcctaagaatgtttacagggaacctggggagatggttcagcaggacagagcactcgctgctctttcaggggactcaagttcagttccctgcacccatgtccagcagcttacagccacctgaccttccagttctaggagatccaacatcctttttgggcctcagcaggcacctggatacacaatcgcatacacatagagagacacatgaacatgcatataagtaaaacaaataaatttttgtaaaaaagaatgtttgctataatccaagtcttttttttttttttttttttttttttttggtttttcgagacagggtttctctgtgtagccctggctgttctggaactcactctgtagatcaggctggcctcgaactcagaaatccgcctgcctctgcctcccgagcactgggatcaaaggtgtgcgccaccacgcccggcctgccataatccaagtcttaactatttagttctgatcatcctgagtttgtgtctgcttaaagccttaattctttcacctctcctagatctagcagacccttacttttgtccctttaagggttagtgtagtcacaagccttggcagtttatggagatgtgcctcaggtatactgaaatagagaaaaagcctgcccaagctggtggtaagaatgcttggcatgtgtgcatgccaatccccagtaccaccgaatttatatatacattttaagtatagttattaatcctggcatggaggctcatgccttaatcccagtacttagaatgctgaggctggaggcttgctataatttccattccagcttgcccttgctagtgagaccctgtctcagagaacaaaaggattacccagtcttgctgtggggttcccgtgtccagctcactgacagtactcatgtgtctcctttgtcaggttacctggtgtacttcacacgacccatgacgatgcatcgagcagtgtctcccacagagcctactcctaggtgagtctgggagatatggcaggaatctgcatctctgagtctctctttgcaaagttcatttcagttcttcagttaattaaattaacttatttctactgtatggtgacaaagtaactttcattcacttgctgtaattgtcatataagctcacccgttctaggtctttctggtctctggctggctgttacaactcagctgttctaactcaaactcctctccaagctgactgattcaaactggcttctctcagcttctcactgaacttattcttggtctcaaatgaactctagcaatctgttctaatcttctgcctccttctcattctctgacccgtctgtcttcacctgtgtccagcttgttctctctgcaaagtgtctcgggaaaactgcgtcctctctcctgtcctttctcttgaaagttgggtgtatcctttctctcaaatctttctctgattcgtcactttgtctctcaagtagaaataactgtttgggattaaaggtgtgtactaagggtctgtctataatccacatcagagcagatgctgttgtttgagggggagggtgtcaggttctgtattagaccaggcagatggaaccttgattcatgaggactgaggttaaatacccaaagtcctaacacccagtcttcaagggaaaccatgagtagtggtctggacttgggaccacatgccctcgtggggaccttttccagtgagtctttcattgacgtgtaattggcaatgtaaaagtccagagtttactgctcagggacccacattcagatcaagatatagaacattgtcctaacctctaaaagctcctggtccctttgccaagtccctgaagaaaccactgtcctgatgtctgccaccctcttttagttttgcctatttttaaacaaaattgagttagactcatgcagcatgaactgttttatatttggcttacgctgttcaacttaatgttattgaacctgatttgagtggctgcgtggatcaatagttgcattgtatgaacataactcagggtgattcattcttctgttgatggattcttggatcatttcctgtttggggctattaagagtaaaatgaaatatacaagtctctttctttctttctccctccctctttctctctctctctctctctctactctctctctctctctctctctttctttctttctttctttcttcctgcatagatttactaatttcttgacccaaggagtggaattgctgattcatagggataggcatgaggttaactttgaggaagtctgtgctgagtggagagtgcattttgtcttcctctcagcaaagcctcaggattgatgactgcacagcttctctctgtgttgccagcccttcagcttctgtccctgtggtgggtagggagtattgccttgtggctctgatttgcattcccacaataatgactagcggtgtgagcagcttctgtgtgtggctcatcgaccatttgggtgtcgtcttttgtgatgtgcctgttcaagtgcctgcactgtcttccttatttgtggtagctatctattttgattgaacatcctttgctgaatatatgcattggctctgtcctaaggtatggttggctttcctccctccttaataatgtccagtgatcatgaatttcaattttgatgctgcctaattcatcattttttaattttatggttagtgatttttgtattgtatcaaaagaaaaaagcctcagtcttcatcgaggtcataaagatgcctggcgcatcttcttctgggagcctgtaaactcctcggttaaggtccatggttcatttcaggctctttggtgttccagcatggtgtaagggtggacatgtgttttatttaatagaaataaacggtggttccagcaccgtgtgcagcctgccttcctttgcacatgaaaattggccgtctgtttctgcaccctagttattcttttgatctatacatctctcaccatgtctcatcactccgaatgtagccttctatgctaagtcttgaagtttggcgatgcaagttctcgaaggttattccctttagttttttgttggctattctaggccttcacacctccataaaactgtgtcagcttgttagtgtctgcagtgtctgctcatgttggaattgcagttacactgactctgtgcattcgttgagagaaatctgatgttgtatcggtgtagaatcttgtcatgcctttttatagtatttctccattttcttgtatcttctttttattttttcttaaagatttatttattattatacataagtacattgtagctgtcatcagacacaccagaagagggcatcagatctcattacgggtggttgtgagccaccatgtgggtgctgggatttgaactcaggacctttggaagtgcagtcagtgctcttacccactgagccatattgccagcccatcttgtatcttctttttttttttttttttttttttaaagatttatttatttattatatgtaagtacactgtagctgtcttcagacactccagaagaaggcgccagatcttgttagggatggttgtgagccaccatgtggttgctgggaattgaactcaggaccttcagaagaacagtcgggtgctcttatctgttgagccatctcaccagccctttttttttttttttttttttttttttttttaaaaaatttatttattgattatatgtaagtacactgtagctgtcttcaaacaccaaaagagggcatcagatctcattacggatggttgtgagccaccatgtggttgctgggatttgaactctggaccttcggaagagcagtcgggtgctcttacccactgagccatctcaccagccccttgtatcttctttagtgactcttttttattatatttgttcctaaattattcaactattttttttgagacagggcttcgtttaattactcagactgccccaatttttttaaatgctttttacatttgtgtgtgtgttggattccctttttcttcccatgtccatattctcagtttcattaaatgctaagaatatactcaagtatagagaatacagttagtatgggtaattctcatttcaaccacaggtctctctcagccctgtctgcttatcatactggtttgattgcaccaatgaagatccgcaccgaggcccctgggaacctgcgtctgtacagtgggagcccaactcgcagtgagaaagagcaggtctccatcagttccttctattacaaggaacgggtaagtgtccgagccattgcctttagttcttaccccggctggattctcgtttcctgtcccactcgtgccacgcacagtagttaagttagtaatccctccctggtctttcactttcctaattagtttatgtaggaacagtcattgctgtgatgctctcagttggtctgcactactgtaaacgatgggtagaggtggtcagtgcttacactagactgtgacgtgtgtcttacactgtagtataaagtatctgtcctggcaatccccattagttgaattggttcccatatttcaagtagaataatttgactttgggtctcccatgatatcctgatgcctgtcaacagacagaaagctgaaagcttctgaaagctggagatcttgatggagttggagctttgtagttgtgggtgtaaagctgatccccagaagggtttctacttctacttaagtctgcactttaaggtctcatttgagtggatcggctgtacaaatgctatgtggacttgcccttatttatttatttttttaaacatggggggtctcagtctgtaactttgcttggcttggaactcatagagatccacctgcccctggctcctgaatgctgggattaaaggtgtgtgccaccatgcccagcttttctggggttcttaaggatgcagtgaccctaaaatacttagcattgagctggcaggagcctgcagatctggggaatgcctagaagtctgtctgctgtcaagctgagaaccaggcctcaacactgacaatcagtatttctgctgacctaccgcacaaacgtggccttaagaattcttcagcttcccacaaaacagggataatgactgtcagtaattagaatttgctttaacaacggaatcatttaaaatccaagggatagtttttccatcaagtattgcaagtgtccccacatgtgttgcagtggtgtgtcccccagctcctactgatggctgaccagctctgactgtctcggggcttatgtggctgacatcaggggcagcagctgacatttgggactgaccaatcttgggcaaagccatccagccaaacagggatgtggctctagttattgtcatgcctgccttcagtcctccacactccctctccccagctcccgggtggaattctgtccctgtgtctggcacagacctccttcaggcacccaccaaactctatctcccacaagtcattcatattaaatcaattagttcctttcccccttttcctgcaaggcagctgttacctgagtagatttgataattgggggagttagctggcctaaaagccatgtaaacttactgttaggtaaatgaaggctttatttagtatcagggctagtttgaagagatcccagagtcagaggcaattctggatgcccctttgattcttgtcccgtgctgccacccatgcttgcaatttgattggctaaaacagactatgtagatatttggcttggtgctcatgcaaagcccatctgtagtcagtgcccgagctcctgagccaggcaccagtgatgcccacattcatagttacaatggtctggccccttccctgcccactctgtgttcatgaggaagcacgagagagcatgtggctaaccatcctagcagctagaaaggactatgaaatttcagtgtgggccagctcctagaatgctgcttctccacaggaaatgggctgttctagtctgctctgacaaggaaagtagcctttaagtattttacataactgccaaataaaatggggagcacttttttttttaaatcacagtgtagcatgaaacctttgcactgatgtataccatatgatgtataccatatgatgtataccatatgatgtataccatatatgcacagtgaacttagctggttatagatgtgtagcttagagaattcacaggcacccaagtcaagaatggcatagaataattgtggaggtaaattgtgggcacttgcttatatttaaccactttcgatctaaaggtttcatgtggttcaatgtatttacgatgtccaaaacagatgtcagttgttttgtggttaatttgcaaccaccgcacctctccctgaggcttcctcatgcagtaatgcagtagtctctttaagctgagcaggctgacggagtggagcagtgggagccccatgctctcctgtgtgtggcctcgccctcgctgtggaggccgatgagtccgtcctgaggactgttttctcctcaggaggcctgcatccgtattaccgaccacttttgctctggaagtatttccagctaactgaaattttctgtgtccacatttttcttgtgtgcacttgacctctgcccctgagagtattcggagagggaggcagaaggaccgagatgggcctgcattaaggcctagcaaggagcaagtgcactgggctccccaggtctcgtgcagcctcctgcagaccatggtttatttctcttgtgtttttaatctgcctgacttaggttgaatttgcattcacccagtgttctctagatgaaattatgtttgctactaagaacttaagtgtaagtgacctaaagacctgtcaaatctcatatagatcagaaagcacagcacagattaggccaaagaaatattgtttattctggatcttctaataaatattgagcattgacctataggcattttccaaattttgcagcctctcatctctgcttcagtttccattactaaaatagctctgatgtaaataactgaagaggcctttaagttaatggagtaggatctgatctccacaaacagtatggtatactgcttatctgatgctggagtactagggagtgccctctcagcttagctcctgggtcccctggcattgttcaggaataggttttgcagtcctggtactaagacattcagtcaccaagctgctccccagccgcactgggaacagagcctaggaggaacaagagtgtgctctgctgtgttcttcacacctgtgaggcgacggggaaactctttgcttgtttctccacttgcagcaggaccttaggcctgccagagtccctcatcccttcttctaggttcctttgtcagagccctgttggcatcagcctccttatatcctagacagtgactagggggcaacaaaactgaagctgggcttgaggcaggtgggttgggggaggggaggggcaaaaacccctcccacctgtaggctcagcctttccagtcatcccagttcccatttgcagcatatatacctataaatccatcagatgtgggggaaactttcattttattctatatttttcccttttaattttcttggtgtttttcttcctcttcctgggtgtaacgttttcacgcacagatgtctcctcgctctgcccggcgacgttggtccatacaagcaattaacgacttcccggtactgtgcgctgtgcaaatgctctccttgactaatcctgtctctaccagaggcccaagaataaaatgccacctgcctggctttgaggaacctgaatgaaaggctggctggtgttcaggaccagcggcagtaaatttttcacctggcgggggcaggcaccaaggactgcctccttgccagtcagggtatttcaaatggggacacacttagggatcacctatgggcttctttgcgaatgaaactcactactgggttcttggaaggcaccctgaccgaatggcttcagctcacctgataccacttggggcacttctgcaaattgcatggagctttcaaaagcctgcctttggcatggggggagcagaggaagatagaagagacttttgccatttagccctgttttgacagcctctgtctgatacagagaggggagacctacttgcttcattggcaggctgtatgagttgattttatcctttgggtattttctggagcaaattttccttcttaccctggtattttgcattcataattaaatttgctatggacattctgtgttccttcctccttttcctactcattcctattggccatttcccctcctctgtcttcctctcccgcccccttcatgttttagtagtgccaaggtgtcctcacggcagccttgaggcctcaagtcaattttatttgctataaagaacgtttagagcaacacatcaacacccctgtcctagaaaaaccagttgaaaccggagcctgagtagcgagaaccacttctccacagcttgcaggtcgagccaccagcatggcctcttttcctcaaacatttgcttctatccggctcccttgctgagtttcactggtttcccgaagcccatttcccaccgctcttcacataggagctcatttggcttcctgcccactctgctgattatgcattgttgatggggttgctgcgaagcggttggtggcttattcttgggctaattttacatttaacctatttactggcattgatgttgcctcagattgtagcagtaacagtagaggtgcagtcacgagctggatagtgcttgtcacttagtggctccctccatccagcccccgcttccctgtcctctttgccatcttccacaaccacctcccaggatgtccacagggtcccagagcttatcgtgcaataacctgtctgccttgctttgtctctcttccctcagtctcttcccatgccatctatgaggaagggcattttctgttgatggagcactgaaagaccttgtctcccagaggtacccatttatcagtacagaaaggaatctatcttgagacctatcagaatgggactggagcagtgcagaagggcaaagggcaaagttttagaccatggtgcccttccatgacctggacagagtaaccgcacctcagccttgtagctccttgttctccataagcagagatcccaagagaaacttggtgatgttacttgacagctgtacagacagcaaagacccctaaagtacttcaaggtattaaggagaaagttaggcttagggaaaacagatggggtaggaatgtttcttattactcaaagtgtaggaaactctctaaaaaaattcttcatcttctcatcatggacatccaggacccaaggccctaactaacatctgtttgaaaatgtatcatatcttcatttaggaagccttcttacatttgaatttcaagaataactggccatttggtggctcactgaatgatccctgtaacctgaaggggagacgttagaactgccatgctacaaaactaaaaacaaacaaaagtacagcgaccactgctttgcccctgtgcgctgtcgagcagcgccttacagttattctttgctaaattcaaccagataagtaaataaaccaaaaccccacagaaacgaaaccatactacacttttgcgtttgtctcatactacacttagaatttcatccctggtggcagctacaatcacagtgacggtatgttggggaatctcctccattgcaggctgaggtagctgtgtgaggttccacagtcgtcttgtagacatccaatatgtagcagatggaaattcctggaagtttgttgtttggaaatggacagaccaatttccataattcaatgagggataattgcagaaggttgctgaataccactgcctttctgtttccaaggaattggcagctcagatttgtttgttttactgatctctataaccctgcaattgggattgtctgcagatgggagaagaatcttacgacatctctttggactctgatttttcttccctgatgcctaatcttaataaactcacaaagggtcacatacacagacacatccacacacaggcatgcatggcatattcttaagcccagcgggaagcctagcattcttgtgtgaatctggcttttacccagggacaacactgtgtcactgttctcttaaaactaaagactcagccgggtatggtggcacatacctttaatcccagcacttgggaggtagaggcgaatttctgagttcgaggccagcctggcctacagagtgagttccagaacagccagggctacacagagaaaccctgtcttgaaaacaaaacaaaaacaaaaacaaacacaaactgaagactggcaatagagagcctggtaagcaccgctgttaacagcaaacaaacaacagggcctccttcagccaacggccctgagttagcagcatacgctcacaatgcctgagagggaagtgactgggaaagtagtcacagaaggatgcttaagggtcagcatcccatgtcctgatgctgatctgcttaaagacagaccacactactcacattactggcacattagattagtgagggcttaattttttacctttgttgattcttaaaataacagtcagtactgaaaagcaagtcagcaaaagtggacttagctggggtagggtatatggcttaggtggtaaagtgcctgccacacaagcgtgaggacctgtattggatccctggcaccagtataaaagccagacccggtgatcaggcctgtggctatagccctagtcttggagttgggcagagacagattattggccagccagtccaccccaatcttgtgagttccaggttcagtaagagactctgtgcctattcccccaatagtataattgagggggaccccagaagttgacctctgcacacacacagaggagcgtagcagcttgatagacctatttaaatttcagctccataactgtgaccttgtgtaaggttcatgtctccatttacaaaatggaggttatgcccctctcccacggagctgcagtgagtacctgctggctcggcatgaacagtccagagccagaactaacacacactaacaccaggaaagtctttaaatcctaaatcaaataccgggacacttggacttgttccaatatctgttgccaagtgagctagtctccttgcaaatgagctgctcccagcacatgagccttcatataattagtaaaatgcttttgttaggtttgctttcaaagtcaggaaagcagggttattttcagtgcgctctaaaagcaggccccgtctgcccttcacaaggtctccatttctttcaattgtataattagatgagcttttgtgagttgttaacctgttcaagctcttaccccccccccttttttttgtactaaagagccacagtgacttcatattcacagtgtttttagcatccttctgtccaacccagaagatacactaaatggtcatattcccttccaaatggaatcttttttggcatagaaatgaaaagggaagctttttacacttctgtgtgtttgtgcactcgtgtgcacatgggtaaatgtgtcactcttggaagggcagaggacaaccggtgagggtcagttttctctttccactaaatgggctctagggatcaaatcatgattgtcaggcttggcagtaactatcagccaccactgaacgacctgtactcagaccactcacatactcagacctgtgggtgtgtagttttcgactaattaagcatttctgtgctgctctgtaggatagccatatactaagttatccctgcagccggccatgcatcgcatgctcctgtggctacttctgtcttgtctcagttaacactgcctggctccagcccactctgacatgtccttcccttatgtgagcggccccaactggataaaaggatagtagttctggagtatggacatagttcttcttcaagaaattggggcctgtaggagactggaggcttaccccataataacaggtcaaggctcccctgccccacccctccccctttgaagaatcaagaggtgtggataattatgatgaacaattcataggtgtttcagctaacctacttcacttacttgtctggaacccaggtggcccacatttagtaggtcccaagacatattgattagtatgggaagtcgattcagtggacacttagagcattggttgaaacgcctggatttaggcgtagacagattcctgaaagagtgattatacagaactcaggagtggaaacgtgagtggtgtggctcctgaccacttacgggcattcacagaaactgcagttctaggttgcagtgttaagtaagtctgtgcatctgcatctgtgtctcctcgctgtaccttactcacttcagactggatagcagagctcagcattagctaataagacaagaaagactgacggctgtgagactaaatccacagcaagtaattaactaggagtagcttgcctagggccatattgaggcagaacacacagtaccttagttttctgatgtcaaactgcaagccccttttagttgctccttatgcctcccctgttgataactgtgtggctcccttgcttaatcaagtgtctttggtgacctcttttaacttttggaaataaaataggacattgctccgataactggttgtctttttgaagatgccagatggggcgacactctgtgactttttgtttcccacgacatttctcattcctcacagccacttcctgaggcagctctgggagctgaaacatgcgcccatggtctcccatgtctgttaactgggtttccccaactaagtatctttgaccttcagaaatgatcgcttatagaaataattcaggcctgctacaaaagcaaggtcttatgttacccagtgtctctgtcttcagacataatagccttgcagagcccacactgtcgtgtctgaattaaaatatcaactaaccctgttgaaactgtctatgaagaaaaaaaaaaacctttgaatcgtttcaggcaagaactttgaacctagtactgaacaccctaaagtcccccttccccgtttgtgggggatctttactaacttctttacctgctatttttaaattaattaattaattctggcttcctggtatctatttttgagcacctgcagaatgtagatggccctgcagtaggtgcttgtttccccatgagggtcttggatcaagagctttgggccatttgttaccttttatttcctacagatgctgatttcatgtaattgtggggcacgatgtaatttaaagtctctgcaaatgaccaatgacccaaatatgatgtactgtgcaactgtaggttcccactctccagaggccccgttagtcacttctggtcatctcccttagaaatcgaggaggtggaagagtaagcgggaaggctctgactccggcaaccgacccattaaggctgctggcaaggtcatcatccaggatgtctcgtgcctccttcccgttcataagtccttgggagagctgtacatgtaagtccatgggcccaggcggcatggggcacggcaccttgggagctgcagagctttgtaaagtcttagacaacttggggaaactcggtgtggtagcttcttgatagtgactaacaaattgccataaactgtggcttcaaagagtgtgcatttctttttttttttttttaagatttatttatttactatatggaagtacattgtagctgtcttcagacactccagaagagggagtcagatctcgttacagatggttgtgagctaccatgtggttgctgggatttgaactttggacctttgaaagagcagtcgggtgctcttacccactgagccatctcaccagcccaagtgtgcatttcttacctcactctttgtgtaggtcaggcacccagcttggtgggccctccttgcccccgatctcacctaactgaaagcataactttgggcccaccgatggtctctgctgaagctcagggtccagcaagctgaatttagagccttcttttattgaaagacaataggagcagaggctggcctgtaggtcttccaagcccttgaacacatcacagaaagtgttatcttttgagatatacccacagcacaatactttttagatggaaatcacagttagtatgtacacatttaaatcccaaaccttgagaactcaacagaaaagctggtagctaattaatatttttcttattgcctcctcctgaaagtggtgagtatttccggtcctccccaggtgggaaccctaagccctgcagcacctgctctaattaacccttcccagcctgtcagatagaggaggtgttttgagtgacaaccaaagagacacttacctaggctggtaaatcaggaggagttcttgggaagttcaagtagaaaccttcttagtcttgtttgttttaatttcagattgaatgtgaacgacactcaggagacatgtcagaagaatgccacttctgccatgcttgtgggaaggaaggatcttgtccaggtactgtcaatctgtgttggtgaggttctggccttgacaattgtcagctagtgacactgataggtgtgcccactatttgaagtttcttttttattttctttgccagtctgccctccctccctccctccctccctcctttcctctctccctctctctcctggaactcactctgtagagcaggctggcctcaaactcaggtctgcctggctctgcctccctagtactgggatttaaggcaagtgccaccactgccacctgtgggtaaattttgttattagtgctaagtggggaagatccttaagtggcttttttcccttaaactatgtgggtttatttttcaatgccacagtgatcattgtcgcctaaatttgagaatctgtctgtacctttgtcatttcacctcaattactttttttaatttttaaaaaaatatttcataagaaagtttaccagcgtgtacttcaaggtagagatgctcagtttaaacatgacttcatggggctggagagacgcagagaaggctggagcacgggctgctctgataggaggccttggttcaattcccagcatccatgtggtggctcacatctgtaattccagccccaggggatccagctaccccttctggcctcctctggcaccaggcatgtgcatgatagacatacctgcgggcaaaacacccatacttgtaaaatagtagtacattgttaaatagtaaaatctgacagtatgtgtaagatgtccgtttccttcatctccggaggttcccatgtattgttcttttttactgagacacgttctgcacatcactagtctgcacgttctgcacatcactagtctgcacgttctgcacatcactagtctgcacgttctgcacatcactagtctgccccttacagtgagatacttagttcctagtgttgtcagtgctctcattagaaaccgtgcagagtgtttttatcacccataaaaagaaactcttgtctttcagtcagttcttcccatcagccctgggcaaccgccaggcccctcctgtctgtcttgctctctgttctctacttgatgacaagactgagctttggaagtcactagcagctctcccagcagctcagagtttccctcataactgagtgagtcagcacggaggccttcccttgattttcatttgattaaaaacatccctaacagaggtccttggtcctgtgaaggttctatgccccagtatagggggaatgccagggccaggaagcaggagtgggtggttgggagggggcggggagaggaggagaggaagggggaagggatttttggaggggaaactaggaaaggggataacatttgaaatgtaaatagagaaaatatctaattaaaaaaatctctaagatttccattcatctagtaatgaatatcatatcatctctcccagaaaccctttaaaaaaactccctaatggtttaatctatttccgtcagccccacccaccagactctgaacactaagaaggcaaaataagctaataggaattagccaaggccagctcagagtcctagagaacaccccaggcannnnnnnnnnnnnnnnnnnncccatgggggatatgaaatcattgaagactgccccaccccaaataacattctctcaacagggttacagcttttcctttaagtattctccctcttccttattctcttcctgcatgtctccgttccttccttctctcctctccccaactcctccctccccagtgcttttctgacagaattggtatggaaggctagaccagtctcagtgatgtggggagacgcttgtcttcatgtgggctctgcttgacttctgggccctgacactctttctgtgtgtgatccccagcaagctgcccagactttgtgaacgtcagggtccctgctataaaatgagccatacttctgacttcatgaggaagtaaatgacataaaacctgtgactgctcctagctgtctggacacccacagctgtatgtgacggtcatttgtgacttgatgatgtgtaaagacagaaatgacctgattgacaaacagtgatgctcaaagaatttgtattgtttttcttcctgcccttgatgaagatgtacttcctgttttgtgtccctcgcatttaccagtgaagcagatgcaagggcacgcttctgttgaaagcctttaggaaatgtgtgttatggagggagactctaacacaactcaatagtcagccatggcagaaaacctgtcctgccatcgttaactttggcgatgagtgtgagctgcatgtctgtacttggagcaatactggtgtgtcactttttgtatgttgcccttgtgctgtatcttacatatctaatgtttgcctttccgaatttttatttgcttgctggtctcaaattatagacttgactcaaagtttgtgtcttcttcctttcgggtttagaatagtgtgttccaggtagtgggtacgatgattatattgctttttcaaaaccaaacaaaacaagccgggcagtggtggtgtacacctttaatcccaccacttgggaggcagaggcaggcagatttctgagttcgaggccagcctggtctacagagtgagttccaggacagccaggtctacacagagaaaccctgtctagaaaaaaaacaaaacaaaaagcaaaacaaagcagaagagattttccaaaagcagtattcgatttttttaaggtctcaaggggttgctcatctctttctgatgggcagtgaaggccttgggcttactagacatttaatggacattagagtggtgattctaagccccgtgcggttggaggccttgggtgatcatcagacttcatgtcaacagaaacaaagccaaggttgtttagttcttggcctgttctttagcttcaaaagagccctaaaactttgtaatggaggtgacggcattctccacccacggcacgaagagcaggtcctcagtgggctgtgggctgctctggtttggtctctgccgaccctgttcaccagggaagcgtcagaagaggccaagcacgctgaagaagctggaccttggactatgatgtgtttgctctctgaagcttgctttgtggaaggttattcttccttacatggcttggccatgtggtgtgggttggggtaaaactcgggatagcctcgcctccaactcttggccgtctcagcctgccaagggctggagttgcaagcgtgagccaccatgtttggcttttaatgaaagttttaaggctagtgtttctcagctttatagtatcgtcagtcactgaggaccctgttaatgcatcagctttaatgcagtaagtcggagtggggcttagcattctgccagcccgagccgtttgcatcctcgtagtgaggtttcagactgtaggaagagggcagacagatggggcccctttgcagggtctgtgcatctcttctgtggcttgaacttgagcatcttcctttggtctgtccaggtttggtcgctggctacggtagctacagatctttgccttgggccgaagtctgacccagatttggaaacaccttgggctcgacatccatttgggcgacaactgctggagtccctgtaggttctgagagctaaaagtgaggagaatgagtggagggggttgtagtctgtaaacacattaaatggtcccaccatggtgaggggagcagaggtgcagaggtgtgaagggaagaaagccctttgcttttagcacagaaacggcctctgtgtagaatgaacttctggcagcatgaggcattaagtaacatttgtcactcacaagagtttgaaacccttatgagtcccatgctcattggagtgctttaggccttcactcacaccactgggcacacgggcctttgggctctggagatggtaagtgtcagtcatggtgctgtgtggtttgccccatgggaacaaggacagagctgtgtgttggtattcatgttctatcaatactaggatcctgttagacagctcataaaagcatcggatttatgtccaacttactactccaaaatacagcaagtcagagcatataaaataatatttaaggcattaagtgagccactcagttattattcctcatagtgaggcccagggtcctggcagagaaaccccactgcttcaagttgaagcttgcttctttgctggtcgaggctagacctggggcagctgatgatgctcccattgcctcttccataggcaggttttaaagcttgctgtagttagcttacagatgcctcttgacagaatccttctcagtccctgagcttggatttgagcgtggtggtcctgagagcgaaaggggaggaaacctgaggtaaacgtgttcctcaccattctcacttagtccaggaacagacatggcgtggtgacagcgttctctgagcggctccgggtagtataaggtcaaagaaaggacacacatagaaacttaccacaaaactgcttgtttgtttgtttgtttttcctggagctggggagaccgagagagcacaagagtgtgtggaccacctctctcaggtgctaggtcagtctgcttggttctgcagacgctgtgttgctttagagcccatgcctgactgccagataaagctttcagattcctagctaggttgctactaacaaaagtaaatgggacccatctcacagttggggaggccgtggacctgtaggaagtcctgtttctgacaaggtcaaggggagggtggaaaaatcctccagcctcgcccctagtaggagtttaatggctggtaaggggtccttccctcattcctaatcttagtttcttctttctttctcttcccatattttacagactggctcactattgccaactccgagatgttcagaccttggctatgctctgtagcgtgtttgaagcccagtcccggcctcagggcttaccaaacccttttgggcctttccctaatcgttcttctaatcttgtggtgtcccacagccgctatgtgagttcatggtgtcctggcttcccttgaggtctgtccccaccgcccaatgtaacttgggaagtgggatggtgttctgatgccactgtgttcctcctcccatctagcccagcttcacctcctcggggtcctgctccagcatgtcagatccagggttcaacaccggtggctggaacataggttggtgaggggatcacccagcccactctggactctggctgttcctaaggcgttctgagggctgttcacatggaagctttgtgctgcactttcacccctacaacctaccccttatccttccacgtaccttgtccccacacctctacccacggtcatctgccacctccaccatccatctcgtcccatgtttccttccagtggagagagagaaagctagcctgaaaccaggtggccatagggtttctttaatgaagtaaatatctttttatttcctggattaaaaaaaaaaattcagactgggcgtggtgctgcacgcctttaatcctagtactctggagcagaggcaggcagatttctttgtgttagaggccactctggtctacaaagcaagtctaggacagccagggctctgttgcacagaccttatctcaaaaaaaaaaacaaaaaacaaaaaaccaaacaaaaaaagacaaaaacaacaaaaatcaaaacaacttttttttttggaaatgatcttaattttcatgattataaaaatagaacattagccaggtgtagtaatatacacctacaatcccagcttcttagggggctgaaacaaaagggttacccagcccaggtatctgaggatcctttgagcaacgtagcaagaccttgcctcttagaaaataattccagtactcaggaagtgaaggcaagaggattgggagtttaaggctagcctgggctatacagaaagatatgtgtacacacacacacacacacacacctactctcgaatatacatgtccagtaaagaataaaaactatcagagaaaaaaagtaatgattgctatctcagtgtctctcacttaataattccagaacattgtcttctcttccccaccacaccctcccgtgtgtgtgtgtgtgtgtgtgtgtgtgtgtgtgtgtgtgtgtgtgtgtgtgtgtgtatgtgtgtgtgtgtgtgtgtgtgtgtgtgtgtgtacgggtagtcatttggtttatgctgttttgcattctgcttttattttattttattttattttatttttttgtttttttcgagacagggtttctctgtatagccctggctgttctggaactcactttatagaccaggctggcctggcctcgaactcagtaaatccacctgtctctgcctcccaagtgctgggattaaaggtgtgcgccaccaccacccggttctgcttttatttttatcatgagcattttctcatgatatttagcaggtctttataatgaattattgcatagaattctcctatatcactacatcataatttgcttgactatcatgtgtaccaggctctcttggtgataaatccctagacaatgaggtagactaggaaagaggactgtagggctccatccatctctcagagtcttgagtttggcttatttggcttccggagaatccagtggacacacagtggggcgtgggaggtgggaggggcttcctatttctgtgcctccccggcctccatctttcttctcttttgcttttctttagcaggaagagagacagaacacatatcttcaccttggggggagtcttcgccagaggagctccgctttgggagtctgacctacagtgacccccgggagcgggaacgagaccagcatgataaaaacaaaaggtagccatcttccccagaagggctgccaccttccctgtggcagctacagaattctcagcttcagaattacactcggggctcacgaagatggagtttagggttaaacgccattaggtaaggagctccctcttcccctaaggaactgacgggaccttttgggtttatccaggctcctggaccctgccaatacccagcagtttgacgactttaagaagtgctacggagagatcctctaccgctggggtctgagagagaagcgagcagaagtgctgaagtttgtgtcctgccctcctgaccctcacaaagggatcggtgaatatgactttgtgtttcctggcaccattgggaaggccttggactgtgtttgcccataaccttagggtggagggttgagctcattcataggcccaagattccgagcgtttgagtcttttctaaccttctgaaaatggcagctatataaccattacaggattcactactataatggtggcatgtcttggacatagtactcagtgtggacaggaagtagagatgattattcatccagctattgtttatcaagcccatggtaagcacagtggagcccgtggcagagaagaggggaaatttaagcaattagaaataatgatagccatactttggctagagagatggttcagggccgaagagactggttgttgttcttgaggaactgggtccagttcccagcaccaacatggtggctcactttggtctataactctacccagaggatctgaagctctctcagtgctctgtgggtactgcgtacatgtgcttagcaagcaaacacacaggtaccagaacacccatacacataaaatgaaagcagcagactcagccgggcgtggtgtcatctgccagcactcaggagacaagtggatctctttgagtttgaggacagcccattctacagagtgagttctgggacagccaaagctacacagagaaaccccatcttgaaagcaagcagaaagaagtacacttagtatcattgcgtttaactcagatatggattaaggaagagagacaacactttagtgatgctctgggtttccaactagtgagttgagctgagcatgtaacagtgttaaaccccagatagaaacagatgggagaactggagctcagggtctccaggggtcacaagtggggctctagaaaagtcactctacagttggtatgtaagcctgttagagtgcaggtgttatctaggcagagtgaggtatgcctttctttaagcccagcactcagaaggaagaggcagggggatctcggtgagtttgaggccagctaggggatacttagtaagaccttgtctcaaaaacaataaaacattaaaaaagcatattttatatgagagctgaggatggaaaggacgaatgcagggagcacagcggaggggcttcccagcctggacccttagagaaactgagcgctcagtgtccaagaggaagacaagaactcaggagactgcagtgacttgatgagaagccagagttttcttcctgcagagattccctacaggaaggaatggaaggcttcagagggagcgggctgacctcacacagtctctctccctcctagaccctggcaggcctctgcacagggactttgtgaaaaggtgttaactacacagggaaaagtaaggttagcaataaattcaaagccaggaaatgggcaagttattggcagctgacttactgcctgagcaaaccaaaccctgagcttttagtcagaaaacaggccattacagaaccctgccatggcttaggaatcgggcctgcctggtgctccaggagggactcggagatgaaatttaaaagctggtcttgtttgatgaaccttggaggatgctctagttgcccctgccagggtatagaacaggccatgaacccagcagcagactgtaagcttgttctgcagagaacagagccacgtttgcagactggagagctccacccactgcaatgagtgcagaaagatcggggacccagaacgcttccagaaaaagaaatcagctcagctatgaaggaagagaaagtgaacggcatcagcgctgacagctgacagtgtccctgggaaactcagtggccaggcagcagactccggaatctccaggaaaagaatttctaacctagaattctgagcccgagtaatcagcagtgtacgaagtaaagtttgagtgtacctaagaagcaggactagattcagcccaggaactgaagggatcagaaaagtgatcaccatgacagacctggagagagaccaggaccaacaggtgctccaggagccctggctccaaggagagaagttgaaaaatgtcgaatatatttcactcttgagtatatttatagaaggcacagacatctgagggagagtttggtaatgaattattgataagtacatagcaaactaagcaaatgaaagaatgaggcagttactaattctgggagaaacaaaatgtgcaagaaaggaaaagtgtcatagacatggcttgaataatgtttgcttaggtaaataatgtatgagccaaatgtggtctagccacaacagagctagggaagacagagccaggtggtgctgtctgtggtcgggggactggagggagaaggagtttccactctgggaagccaatagacagtgcttggatatgatacttaagaattcactttgtgttgggcatggtgggataaatctttaatctagctcttgggatacagaggcatgtgggcctctgaattctagaccagcctggaccacacagtgaatttcctgctagctaggtctacaaaaggagatcctgcctctgatagatcgatagatagatagatagatagatagatagatagatagatagatagatagatagatagagttttgctcaccttgacagcacataacacactaaaatgagaagatctacagataaggtaaacatgactcttgctcaaggaggataaattcgtaaagcttttactgtttgttgttgtttcgtggggtgcatttggggagctggggggagtgtcttctatatggctgtgactgtcctggagctcactatgtagaccaggctggccttaaactcacagagacctgcctgcctctgcttccagagtgctagaaccgaaggcatgtgccactgtgtctggctgcatttcctcttttcagtcagtatatcatgggactccttgcacatcaggggttattgcggcacgatttataatagcttagttatagaaccaacctctgtccatcagcagagagtagctaagaatatggggctggaaagacagctcgatggttcagaggacttactgctctttcagaggacccggttcagttcccagcacccacatggcagatcacaactgtctgtaactccaagattctgacacgctcacacagacatacatgcaggcaaaataccaatacaagtaagatacaaataaattcttagaaaaaagaaaatgtggtatctatacacagtggcattgcagtaaagcaggaagagtgagtggcgttagtgcagggagttgtgtgcctggagattatccttccacgtgaactaattccatgtctataatcaaggaattccacgtgtctctgccttgtggattctagattttagtatacataaaaccatgcatgcctatgacatgatagtagaaatgaaactgccttagggatagaggagtgaggtagagaggaggagatgggccatacgggacagaataggctcagaagtgcattctgtatttgtatgaatatgtccttatgaaatactcatttccagagagtagagcagcgggcagtataaagtggtctttagagaggagacagtgaacaaaaacagtggactcagtaggtaaggtctcctctagcgagtgacagggaatgctgggctttgacaaggttcataaaactctgtatgtcatatgtgtccctagtttccatttgaaaaaaataaactagagcaatatttataagagatgaccctaagtagcagggttattttggtaagctatgcctacgaatacatgcttgaaaaaaatacaaaaatacaaaattctaattttgacaatgtggtatttttttcagagcttctaaatacatgagagtgtaccaagaagagattaatgatagccgggaacaacttgtcttttgaaattagtttttaggaaaacatgaatcacagtgatatggagctgacgtatgagccaaacccttgttgacatctcctgctctgaagcaccatgcgagactgcaggcgacacagagaaatagatgtgggtggtgtgtgtgtgtgtgtgtgtgtgcacacgcatgtaattcacagagcttgaaatatgagacagataactgatactaaacacttttattgctaggtgtgagaatacacccctgcagtcctggaacttggaatcaggaactcaggtccggcctcagatggatattgagtttgacagcatgaaaccctgtctcaaaaacaaaaaacaaaacaggataaaaacctaaagaacaaagagagaatgaatgtaatatcctagggccaatataaacagtattacaggattgtaaaaagggagcaagaggggtctgaaagagactcagacaaaatgttaacatgagcagtgactgtaagctgcaccgaggagtcagtccatctggatttggaggaagtagctgcacgtggagaaatccagagctcagcaagggctggaggaaatataccctccagtctcccgagacaacggccatctccctctgtggaaagatcagtttcctctctgctctgtctgtaagttaccagatcagcagacagaaaacaaaaaatctattaaatcagctaaatgtgtttacacatacctgtaattctagcccttggtgtctggagaaggagaggagtctgaggccagcctgtgttctatagcaagagcagtgttaattcaaaacagaaacaaacacaagaaaggagggaagatattcaggatctgagaggagtttgtttccatagggataattccttcactaaagattcagatctgcccacatagatttctttacattaaaaagatgtttattttttaatttaattatattttaaaattctggtccttttttttttttaaagattaaaaaagttatgtgtatatgcctgagttgattttatgtaccccgaatgtaggaggccagaagagggcattggatcccctaaaactgaagttataggtggttgtgagcctccatgtgggctgagaaccaagctccggtcctggaagagccacaagaagactgaaccacagttgtcttctgacctcccacacatgctgtggcatgtgtgcatctatgcacatatgccccaaacaagcacacgcaataagaaacccagagctggtttacaacagtaaaagacagtttgcatgacacaggaccatcgtctggggtcaacttagcgaggtctctccatgtgtgatcatttgctacagtcttcctgtccttacgtctccctgtgcatcttataatccatactgagatctactgttgggtcttttttcttactaagttctagagggctacctaaaatagtcatctagaccattaaatagcgagctgagccattcatgtttgatttcaaattatataacttaagatgaaggatagaggggaagaaaagaaataagattgagtttttttatagttttactctttttttttttttttttcggtttttcgagacagggtttctctgtatagccctggctatcctggaactcactctgtagaccagactggccttgaacttagaaattcgcctgcttctgnnnnnnnnnnnnnnnnnnnnttgtgagccaccatgtgattactgggaattgaactcaagacccctggaggagccaccatttctcttacgcactgagccatctctccagccttgcctacatgtcttgcctacatgtgtacatacaggaggttttaaccaccatgtgagtcctgaggaccaaacccaggtccttagaaaaacattagtgttcctcactgctgagccattactccaggtccagttgttcctcctgtcagaaaggagggaggagccatcagcctctggaaatttgcaaaatgctggtagagatgaaggtgtctcacaatccccatttaagggcttccattttttttttttttttttttttttgggaaatgagaagagaggatagctggtgagagacagcagcagcagcagcagccaaggcacgtggaagaagtttgcacactatggcagagattcagtgttgtagcttgaggaaggaagaaaagcagggttacaccgtgcccaggcccttctctgccagtgagcctaaagtcaaacacgtttgataaggttcctccagctgcctctgctctccagagctgatgtgcggtgggtgggtgggtgctgtggctaattcatggtctcagcttggccaggcgttaccaggaagggagatggagctgaggatatttgcaaaaaacagggtcatgaacttagtccaggtacgccaggttggccaaagagaaaagtgcagccaaaaagggcaagtagattaaagaggcaggtgggcaacagaggcgggtgggcaacagaggcagatgggcaacagaggcaggtgggcaacagaggcaggtgggcaacagaggcaggtgggcaacagaggcaggtgggcaacagaggcagatgggcaacagaggcaggtgggcaacagaggcaggtgtggactagagtggtcaaaaggctagagaaagctgttgaggtttgatctgttgctaatgtattgtgatgctaaattctgtacagtaggtctaggctgacaagtgaagtctcacatttaccagctttttatttttctttttggtttttcgagacagggtttctctgtgtagccctggctgtcctggaactcactttgtagaccaggatagcctcaaactcagaaatccacctgcctttgcctctgcctctacctctgctggaattaaaggactaagttcatgaagctacatttaccagcttttgttgtgcaaatcttgttccttaatttaaagctattggttaaataaaaatcgccacagccaatcactggaggggttagaggtaacagaggctttgtttttgttgtttctttttgttttttgttttgtttttttttttgttttttttttttgagacagggtttctctgtatagccctggctgtcctggaactcactttgtagaccaggctggcctcgaactcagagatctgcctgcctctgcttcccaagtgctgggattaaagctgtgccaccacgcccggctgttgtttctttttttaatgtatatgagtacactgttgcagtttcagacacaccagaagagggcatgggatcccattacagatggttgcgagccaccgtgtggttgctgggaattgaactcaggatttctggaagagcagtcagtgctcttaactgctgagccatctccccagccccagtagatacgtttttgcgttacgtggttgaccagggagaaagaaaatgcatgaggatgagagagaaggaagaaatgactgatctgccagagcctgacagggtcctgagaggagtcggtatccttacccagccagactcagtctgcttttattagaactaatgtctcctcttgctttgcccctgtccacccatttgcagagtttggtgtgtactgcagtcactgtcggagcgaggtccgtggcacccagtgcgccatctgcaaaggcttcaccttccagtgtgccatctgccatgtggccgtgcggggttcatccaacttctgcctgacctgtgggcatggtggccacacgagccacatgatggagtggtttcggacccaggaggtatgtcccacggggtgtggctgccactgcctgctggagagcaccttctgaacttaaaggacagtggcacttccggaaatcccagaggactccataagtgctggagaaggctctctgctgctgctggtggaaagtcctagaaccagggccatcctcgtgatttaggatggagagtatcctctcacagactgtcacagcatccgctcgtgatcctgtgtgttcccttctccttggctgccgggcacggatggtgctggaagaagggagggggacgcacagagctgaccctcctgtactgtctgttgagtccacagtggatgttttcatgaggaaaagcacctgtttccagagccatcagagctagcatcagccttcaagattctgtccttgaaccaggaatggaccctccagatgccagtacaaaggcacacagcagctgcaaaacagactcctgagccagaagacgctggctcttagtgccatccacaagtgagctatggtatctgtgacttagaagttggcaccttgatgatggccttataaaatacaatactaaagtgtaatatatgatggacatatattcagcattctttttcttggtacagggctggaactcagcgccttgcacatactggtgagcagccataccactgagttacattccagccccataagaaacttaagatgtatatgttttctgtttctcttcatctgctttcctttaactaatagaagtttgtacttgtgtgtgtgtgtgtgtgtgtgtgtgtgtgtgtgtgtgtgtgtgtgtgagtgagtgagtgagtgagagagagagagagagagagagagagagggagagagagaggatgaataaggaaagtgaccgtcttagtgactcattttgcattgtacttctggttgaagggaactgttttggaccggactagaattagtctcatgacttgtaaaggaaatgccatttgactttgatcatctgacagaggaaacggaatctgacattaaggttctctctagccgcaagagtctcataattatttcttctagcacaggggaaatgagattgcatttcagcactgataccagagtctctctctgcctctgggcaggctggctgggctccaggggtactttttacttgaactcccttgcaaactcatcatgattttcaggggtttcacttgtctataccagggaagagagtttaaaaaaaaaaacaagacccactatactgaaatctctctctcttagaaatttaaattccttgggcctgtcataaggctcagtgggcagaggtgcctgccactaagcttactaacctcagttttctccctcgcatgagccaccatagaagaactgactcctaagagttgtcctctgacttccacatgtgtgctttgatatgtgaatgtacacacacacatacaaaaaatgtaatttaacaattttatgattccaaactaattaaccggagacacataagtaatttgtgtcattggattatggttgcacgtgtttgtagtcccttcactcacggggctgaggtaagagggtttcaagtttgagaccatcctgggctacacagtgaggtgatggccagcctcacttatatatgaagacacttacaagcaaacgtcataaagaagatctggagaatcgcttagtaatcaaatgcttggctagcatacaggaggtgatgtgtttgatcctcagcaacacacacactgacactcaaactaaaacaaaacaaaatactacatgttccataataggtaagtgttgtatatcactttgtttgaaactatgatttaagactcatgaatggattaggaaatcagttctcgtagataaaaaccaacactttctattttcaaggattactttgtgtgtgtaaatctctgtgtcttcaagtgtatgttgtgtgggacagaagagaccatctggttccttggtgctaggattatcagtcttttcaggacaccttgtgtcatgtgtgttcagggatcctaacttggatcttcatgattgcaaagtcagaactgttttgtctccagcccccaaactgtcatataaagaaagtaaaataatgtgggtgagagacaatcgtgtactaacacagtctgatgtcctttggttactagtgcgtgcgcgcgcgcacacacacacacacacacacacacacacannnnnnnnnnnnnnnnnnnntttcaaggattactttgtgtgtgtaaatctctgtgtcttcaagtgtatgttgtgtgggacagaagaggccatctggttccttggtgctaggattatcagtcttttcaggacaccttgtgtcatgtgtgttcagggatcctaacttggatcttcatgattgcaaagtcagaactgttttgtctccagcccccaaactgtcatataaagaaagtaaaataatgtgggtgagagacaatcgtgtactaacacagtctgatgtcctttgtttactagtgcgtgcgcacacacacacacacacacacacacacacacacacacgtacttatatctcatggtggcaggtgggcctcacctctcccctgtattactaattggtcatgagactccgtggcataagcttgatcttgaactatgtgccaggtttggtaccagtgcctcagcagcacgtgtagtccggtgtgctgggatgggggaggaagggccgcaggtatctgagtgtattacactgtactcctccagcctcgtttgtgtcgacactgccgtgatgctggtcccacaacaggcggactgatgtgcacagacacagatctgttgggtcctctgtgagttcacaccatttacagagagcggtctcttcctctaccccaccgtgaagctaatggaagccctgtccctgtttagaatgacatagttttcttgtgtggattatttctgtaagaacattgtcttccaaaacaaaaaaaccttcttagtgactatgaagtcatttcaagtttaacatgtttcatagggggctggagagatggttcagtgattaagagcactggccgctcttccagatgcaagtcccagtaaccataagccaggccacagacgtttgtaactcccattccggggatcagatgcctttctctggcctctgtcagcaccagacatgcacatgctatgtagacatgctggcaaaacactctttatgcataaaataaaaacaagacactatgtaacatctctcaataggtcagttctgtttgcatttccaagttaccaggacaaaaacttagtatttgtgagaaatatccctgtttggaaacacagtggtctggatgctggtggggtcagcagcctctctaccatagctaagtcctcttggtttggtttactgtgctcgtctgaggtagggcaccgttgtgtttcccagctgaccttgaacttgagacctctgactgccagagtgctgggattccaccacacctgggctttatttgctctttaaaatattataacctgtgtcctaaacacctttgaatttgccagggagaacactaggcatgggcatggtggcacacgcctctaatccgcatttgggaggcagaggcaggaggatctctgagtttgaggccagcctggtctacaaagcgagttccaggacagccagggctgttcttacacaaagaagaaacctatcctgaaaaaccaaatccaaccaaacaaacaaaaactttttgccatgggaaagcagtgctagctgtccagggtaccaggggctctttagccccctgccaagcagaatgggccatgcgttctaggtgaccaccagcttgcatttgtcctcccacctcaagctgctcagaccacaggacttaacactttcctcatggacactatggagagtccattatgcttaattttaataagtttttctactctatagatgcatacaatctgcatttgctgatccacagtgggcatggcagcccttcccagtgctgctttgaagggctagtagaatcgaggggagggatctagggtttttgttttgttttggggatttaatgcagcaggagctaaggagacaacagcctttcattctgccagaaaaatggatgtggtgtggacacccataggtgagggcttaggaaaatcatccaagcaacagaataaattttgaattagttctgttagccatggaacagaagtttaggaaatagggttctagatcacaggcccactacttggtgctcactcctctcattccatcttcagagccagcagcagcaggtgttacacacactcaaaggataaaacattgtttgcctcgtgctcagactctagcgttcttgtaagaatcagaagcgaacctattctgttggtagtccatgtactggcaagtctgtgttgacacattattaagttgtttccttttgaaatctcagaaggcctagtttatttagcatgtgtttaatgtgaggtgagcactgtgacagaggtggatttaggaggaaatgtggttatgtctctacctgtgctctggcatctgtgggggaaaaaaaggaataacagagttgaggacatggaatgtttcaggatatttgatcacactgtgcactctgagccttttactgacaaaccctgttcctggttgtggtgtggctcagcccttagcacacacctttaatctcaaacaatgaagataaagttggtttgtaggaggaagcagccatgcttgaaagtgatgtctaattgagtggcagacaaagtgaccaatcagagaaagatgtgacaaataggatctgcctaactttcacaggaagaggggaaagggaagctatttgaggggcagtgcagagagagagggggggggcatatttactgggacagttgaacagagacaggttgtaaagaacaagctagacacaggtgaagacagagcgagccagagaaggagaaggagccagattagaacatactgccaaagttagtctgaggccaagcagagagcaattcaggagaggcccagagagaagccagactgaattcatcaccttggagaggtgtttgagccagatcagctgagttgaaccagccaaccagagctcagagagaactaggaaggggtgaacttattcagcagccagcctcggcagctgaaaacattctaggctttgattagattgtacggaggctagaagctttcaggactgggcctaggttagcagacggtggaggcagtgaacctcagaggtgacaattacttcaagagaataaaagttacatttacaagggcatccagggctgtgtatgtgcgtgtgcgcgtgcgcgcgcgcgcgtatgtgtgtgtgcgtgtgcgtgtgtgtgtgtgtgtcagtatggctgaactgctttgaaggatgagtgttttcagtgggaaagagtaggcgagcacgtgaagggcttagccaaggacagggagaaggacatcactgaaggcacctgcagtctcgcttatcagcacaacacaggctggagctgataaacagggctggagaggtgcaagaaccagagcgctgtgccagggaggctgggctttatctgtagcctggagtctcgagctttacgctgctaggctttgcccttctccctacccacttggccttcaggcttgggactctgcagcccacctgcctgtgcagagtggtgcgagtatccagtatctgttgcttcatcctttccatgcccaggacgagcaggtagctaatgcccatttggactcctgacatagtacacatcgcatcctaggtgcaggctttgtaccccatacagtgagacattctccagcgaatgccaagcaggcacccttggttttcttttagcgtctaaagatacaggtctttgtctcacaagaccactccacttcagatgcctaactagagtctttaggtgtgatgctcttctgtctccttggtccgataagtaaggccagggtctggggatgcagttctgtttatctcgcatgcatggagccctggggttggttccccagcatccctgaaaacagctagtcatggaaacctctgatcttagcgcttaggaaacacaggcgaggatctggatcccaagatcatcctggtcaacagagaatttgcggccagcctgggctacatgagacctcgtctctggatgtgagagccaggggcctggggaaatggtttagttggtaaagagccttcttcacaaacatgagcacctggatttggattcccaggacccacactaaaaaattgggatgtggtgggatgtgtttgtgacccgaactgggcatgggggaggtgtggcgtagagcttcccgtggagaaaagtgggtttccagagctcattgacctgcctgtgtagccagccaagcagtgagctctgaggttagggagaaaccctgtctcaaaaatatgaggtcggagagggatagagcctccatatacgcgtatacacataagcacacacagagaacttgtatgtacacacatgtacatgtatgcttacacacaggactcaggaaagtgctttacttacatgtgacacttagtatgaggatagtataagagttccagctatctggatgaagaggcgcacgtgacaaaggacatgggaaggacaaggagcttcccagcgctcccctgaacatcagcctctagacagacacctccacatcttcagcaacctggaagctccccaagcctattgtgtgggtatgactaatatggttgactaaattgtcagccactggttaaacattctaccttaagcccttcgctaaggtcaagggtagggcctcccatgatacagttggtttccctggcagctggtctgtatcccgtggctacccaggtgtctaagagtcaggaaaaatattgctatcatttcaggaaatggcagaggtcataggatctctgtgtcaggaactccagccaggaccagatactgaaaatattcttacagtggccctattacaagggaaataacaagagcttttgaaccctgtcgggaaccagaacagagaccaaatgtacacagcttattaaataactaggggaggaaaactatctcgtattcagtgccacatgcttatttttttatttttatttttgtgtgtcatgcatgtgtatttgtgtattcgcaagtgtgcttgcctgtgcgtagaatccagaggtcaacagtgaatgtccttcacattttttcttttctttctctccccccgccccccaccgtagagacagggtttttctacatagccctgtcagtcccagaactcactatgtagacaggattttgctctgtatctcagggtggccttaaattcactccgtggcccagaaagccttcagtttgcagtaagcttcctgctccagcctcccagatgctgggattacagcctgagccaccccacctggcttatgagaacatggaggggctgtcggcatggctcagtggtgaagagcactcgctgttcttccagaggtcccgggtagttataaccatgcgtgactctagttccaagggatctgacaccctcttctggcctctgcagacaccctcaagtatgtggcatatattcatatacacatacacgtacacatgcacacacacattgatcgaaataaaaataaatcttcatttttttttcagagttaaatgctaaaatccggaaacaaccctaatgccctcaaggtgctaaatggccaggtacactgtgcactcattggtacattagtgaccactcagatatacaggaataaaacatgaatatagatgacaactgccctgggtgaaaggtcagtcttaaaaagttacactacaattccattctcccctttcacacacacacacactccaactcccatcaggacctcctacaaccaggctggctttagataaactggctgaggatgaccttgaactcttgacccccccccccccccaactactgggttgtaaagtgtgtgttactgtgcttaggccatcttagaacattccggaaataagaatatcattattattattataatatctactaaataaattactgtctgggcagtggtggcacacgcctttaatcccagcacccaggagacagatgatgggcagatctctgagttcaaggccacgtagacgtctttatattgtttttttaaagttgtaggtgagtcctaggcctggcggtgcacacttgtctgtcacatttgggatgcttaagtaggaagaccatgagtttgaggtcagccttacgctataagtgttaaagctctgatgggaaaaggcttctcccattaaagtgttacagctctgaggtggatatccacatgtgagagataccctggacaggtatagataagaacttgaggagaagagagcaagtttagctaggaaagatttttggatcagtttcagattgtgcagtggcagaagttgccatcattgaaagtcaagcatgccagcactgaccactgaatgtaccgaagccaaagccaaagtgtttgtggttttaataaagtctaagtccatggaggggagaggaaagagatgcaaaagggactctgctggagggagtttctgtaagccccaagtgggagcccagaggcaaagcagcctgggagggcatgaggaagctgtgagacttcccggatggagctgagagacagggcacaaggttgcagaggcccatagaggccaggaagggcttaaggaagctgagggacttatcggacagcttctgagaggaggagacaagggaacagggagggtcccagtgaagggagaggagcaagtgtcttaagaactagagagcctctggacacgcctttaatcccagcacagaggcagaggcaggtggttcgagaccagcctggtctgcggagtgagttccaaaacagccagggctacacagagaaaccctgtcttgaagtcccccctccaaaaaaaattaaagaactagagagctgccctcacagtggggccccagaggacacagcaggctccaggagccagagagagaacacttacccatagacgaggagaggcaggtggttagagcagatggagggaagaagctaccaaagaggcagactctagaattcggaaccaaatatggatggcagaagccagcagaaactaatgacccgcacacacttctagagagtcagattggcaacttgagtcagtttgaaatgctgagacattgtgataaaaactgcatggtactgacaagtagaccaatggaatagaattgaagacccagaaatgaacccacacacctatggtcacttgatcttcgacaagggagctaaaaccatccagtagaagaaagacagcattttcaacaattggtgctggcacaactggttgttatcatgtagaagaatgcgcatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacaccgtcaataagacaaaaagaccaccaacagattgggaaaggatctttacctatcctaaatcagataggggactaatatccaacatatatacagaactcaagaaggtggacttcagaaaatcaaataaccccattaaaaaatggggctcagaactgaacaaagaattctcacctgaggaataccgaatggcagagaagcacctgaaaaaaatgttcaacatccttaatcatcagggaaatgcaaatcaaaacaaccctgagattccacctcacaccagtcagaatggctaagatcaaaaattcaggtgacagcagatgctggcgtggatgtggagaaagaggaacacctcctccattgttggtgggattgcaggcttgtacaaccactctggaa

SEQ ID NO: 1388 - DNA, 1162 bp, Mus musculus
gtctctctcagccctgtctgcttatcatactggtttgattgcaccaatgaagatccgcaccgaggcccctgggaacctgcgtctgtacagtgggagcccaactcgcagtgagaaagagcaggtctccatcagttccttctattacaaggaacggaaatcgaggaggtggaagagtaagcgggaaggctctgactccggcaaccgacccattaaggctgctggcaaggtcatcatccaggatgtctcgtgcctccttcccgttcataagtccttgggagagctgtacatattgaatgtgaacgacactcaggagacatgtcagaagaatgccacttctgccatgcttgtgggaaggaaggatcttgtccaggtttggtcgctggctacggtagctacagatctttgccttgggccgaagtctgacccagatttggaaacaccttgggctcgacatccatttgggcgacaactgctggagtccctactggctcactattgccaactccgagatgttcagaccttggctatgctctgtagcgtgtttgaagcccagtcccggcctcagggcttaccaaacccttttgggcctttccctaatcgttcttctaatcttgtggtgtcccacagccgctatcccagcttcacctcctcggggtcctgctccagcatgtcagatccagggttcaacaccggtggctggaacatagcaggaagagagacagaacacatatcttcaccttggggggagtcttcgccagaggagctccgctttgggagtctgacctacagtgacccccgggagcgggaacgagaccagcatgataaaaacaaaaggctcctggaccctgccaatacccagcagtttgacgactttaagaagtgctacggagagatcctctaccgctggggtctgagagagaagcgagcagaagtgctgaagtttgtgtcctgccctcctgaccctcacaaagggatcgagtttggtgtgtactgcagtcactgtcggagcgaggtccgtggcacccagtgcgccatctgcaaaggcttcaccttccagtgtgccatctgccatgtggccgtgcggggttcatccaacttctgcctgacctgtgggcatggtggccacacgagccacatgatggagtggtttcggacccaggag

SEQ ID NO: 1389 - protein, 387 aa, Mus musculus
SLSALSAYHTGLIAPMKIRTEAPGNLRLYSGSPTRSEKEQVSISSFYYKERKSRRWKSKREGSDSGNRPIKAAGKVIIQDVSCLLPVHKSLGELYILNVNDTQETCQKNATSAMLVGRKDLVQVWSLATVATDLCLGPKSDPDLETPWARHPFGRQLLESLLAHYCQLRDVQTLAMLCSVFEAQSRPQGLPNPFGPFPNRSSNLVVSHSRYPSFTSSGSCSSMSDPGFNTGGWNIAGRETEHISSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQE

SEQ ID NO: 1390 - DNA, 95960 bp, Homo sapiens; identical to SEQ ID NO: 1384
  misc_feature (1)...(95960): n = A,T,C or G

SEQ ID NO: 1391 - DNA, 2201 bp, Homo sapiens; identical to SEQ ID NO: 1385

SEQ ID NO: 1392 - protein, 571 aa, Homo sapiens; identical to SEQ ID NO: 1386

SEQ ID NO: 1393 - DNA, 27920 bp, Mus musculus
  misc_feature (1)...(27920): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggcctgtagccaaaataataataattgctaacttatcattatttaaactttaacttttgacttattatacttcagagctcagatctctgaggtcagctacttgcattttcctgtgaagctctaatgataaatgacatgggcaaagctaccaggcagtggccagaaagagtcaagttaacgcttaactcaatagttctgctagctttctgcttctgcacattgcacacaatgactctcctaagagtcccagtgttttgacttagttttactaatataagattttacatatcctatacttgcttatccaggaaccactctcaaattttacgtaaaacttatttcataacttcaatagttgttttttctttcttggggtcccaatgttgactctatttcattttctaataatttcttcaaactttcttttttttaaagatttatttatttattttatgtatgtgagtatactgtagctgtacagatggttgtgagccttcatgtggttgttgggaattgaattttaggacctctgctcactccggtcaaccctgcctgctcagtccctgcttgctctggcccaatgatttatttattattatgtataagtacactgtagctgacttcagacacaccagaagagggagtcagatctcattactggtggttgtgagccaccatgtggttgctgggaattgaactcaggacctttggaagagcagtcagtgctcttagctgctgagccattttgcgagccccttcttcaaactctctttgcaagtcaagcattaatctgaaactaccattgtgcagttattacattgtttctaagatgagaacccacagcatgcacctgggccattaggactgcgctgtgctgtgccctatgccttagtttttaattgtttaagaatcattacatcagggaacatctagtttcgcagaattcaccatagcagaaggagaaagaagtaagaaaatcagatataatagaataattatgcacatcaaggccaactgaaaagcagtcatccacaaataaaatctatacagccattgtctagggctaaggttaggaaaattgggagcaactgctttttacgaagagctgccacgggttgctgagatgtctccatcccggctgactacaggctgtccctgtcattgtgtgctgtgtgactgtacagctgagccatctctccagtggttcagttttttaaaaactaactttgagttgcgagccttcctagcaggtttttggttagggtttattgctgtgctaacaccatgaccaaaagcatcttcgaaaacagagggcttatttcagcctaaggtttcacatcatagctcactcatcaaagccaacgcaggaactgaaagcaggaacccaagtggaagccatggaagtacgctgcttactgccttgctttttctcttcaaactgtacacttttgtatttctttttgcccgattgttctttttcattataaaccagctgaagagtgcttaataataaccatatgacagagtcggtattaagctgtcttgaaatctcctctgctgaagaaattagttcattacttttaactttgcttcaggcaggttcttagaacgagggcagaaagcagactttgccaaatcgtcccaaggaccggctctagcccagttgctaatattgttcccctctgaaacctcttgagccagacctccacaatccacatagctctcagcactgtcgtcttccagcctcctactaggatggccaattaagctctgcatacagcatttaaccactttcctagttcaatgtcccccctaattttccacattccttcaaaaatatggtcaggtatgtcatatcccatgaacatgataccaatctctgtcttagttacttttctatggctgtgataaaacactatgaccaaggcaactgagaaaagtgtttaattgtgcttacagttccagggggttagagtccctggtggcagagcaaaggcatggtggcaggaacagctgagtgctgcatctttttttttttgtttgttttttgtttttatttgtttgtttttcaggacagggttttttgtatagccctggctgtacctggaactcactttgtagaccaagctggactctaactcagaaatactgcctgcctctgcctcccgagtgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggcacagtgacacacttcctgcagctaggctacacctcctaatccttcccaaacagttccaccgactgcagaccaagaattcaaatatatgagccctgggaggctgttcccatccaaactgccacacagggtcaaggtgaaggccgtgggatgagtcagagacaaacttttttttaaaagactttatttattattatagtaagtacactgtagctatcttcagacacaccagaagagggagtcagatcttgttacggatggttgtgagccaccatgtggttgctgggatttgaaccctggaccttcggaagaacagtcgggtgctcttacccactgagccatctcaccagcccccagagagacaaactttttgtttgtctcttttgatacaagatctctcactactgcaccctgaccagcctagaatttgctctgtagcttcaaactcagacagcagagagctggaaccaaagacatgtgccaccaaactgagctacaataaacattttaaaaccacttaaacagtgatggtacctagttgatgatggataaaatcctcagccaaggagttgtactccaataagagaaaaaaacccagatccaaagcctggaaaactccctcagatgtcagagggtagaggaccaggagtgagtgacagacagatgtcagtagcaactgcagcagggagcaaggcaaagtgccatgttgtggcataactgttgtgccagctatttggggggtggcagtgtgtgtggcaggagacagaaggatcttttcagctctggagttcaaggctgctctgggcaacatagtgagacctcagagaccttgttgaaagaggaggaggaggaagaagaggaagagaaagagaagaaggaggaggagaaataataatctctctctctctctctctctctctctctctctctctctctctctctctctctctctccctctccctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctgtgtgcgccctctcaaaaccttcccccaggacgcttcctgtgtgcgccctctcaaaaccttcccccaggatgcttcctgtgtgcgccctctcaaaaccttcccccagcatgcttcctgtgtgccagtttctgagcctcgacaattacctgcctatttactgcacccaatagagtcccccactgccactgaccccagagcgacttgagaaagatccctgacactgctcaccttgcacacatgaacacaaagccagtgtcctgccactgtggccaatacccaagacagcatagaaaaagaaaggctctggctcacagccttggaggctccattccgtggtgactcggcccttgtggcgaggcagcatagtatggtaaagcttcctactttacagctaggaagcggctgatcctactgtcaccttaaaggcattcccaaagggacctgaacacctcccatcatatcctagtttctaagggatccacctcctagtgtcacaacagtggcttatgcctacactataccgacctttagggacactgatccaaaccacagtaccatcccattctgtctgttactgatggagttttgttttgcttgatacaggctcgtagatagcccaggctagcttcagactctgaacttgtgtgtctccagtttctaccccctatgcactgggataacagtcaaatgaacctctaagtacagtttatgtggtgctgggaatcaaatccaggcccttctgtgtggtagacaaccacgctgccaagccagttacatacctagtcttattgtttcttgagatgctctcgcgtaagccaggattttccaaactctcttacatgtttgtggctggcttgccttgagctccagattccccctttcttctctcaagctttggggttacaggtgtgtacaccccgcactctgttatttttttgtttgtttataagttcatccatttgttgaggcaggatcttgtatgtgtctcaggctggcctcaaattctcaattcctatgcctcaggctccataatgtcgaaatcacagccatacatcactatgtttggctggccttatccagtcctgttagctgttctctgcagctatttatttcacttattttattagtggggggggggcatgaacatttcacagtagtcatatggaagtcagaagtcaccttggaggggtttgttctctcctaccacatgaatcccagggatcaaactcaggccattgggtttagcagcaagcccctttacctgctgagccactttgacgacccctctggaacttttaaagctgcttcagcttctgttgaggtggcgactcttgcctaaccagtgtgtgcatcaatatctcgtgagcattcctgcagagagagaatgtggccagtttcaaggatatgaacttgtctttccaacccccccacacccattacagaaactcctgggaggacaaatcttaccaccctcactttttgtcttttcctttgtgagttgctccacggcacagcaacgggggggggggggggaagaaatgtaatatgcacaaatgaaagttcagcttggctggtagagtacttgcctagcaatgcacagagccatgggttcgagacccagcatcatatgaaattgggcatgggagtgctatgcctaagaccctagcacttgggaggtggaatcagaggctagcggtcctaggttatccttcatagctatagtaagcatcctctccaccttcagattttaaggcatttcccttcagaaaatgagcctgtgttctaaggtacagtgggtactactgtcctggtcttgtcattggagtcatgacggagggtcagggcggagtaatccagattctcgaacctccagcctgttctagcagcccatccttaagcaggttgcctcagggatgcacagaagtcaggagtcaggatgccacagtgtccatgggccctcagcctcttcgcaggcagggctctccccgcagctgctggcctccttgggttcctcagggcatcatagtctgatggcatctgacactgcctggactctgacctctcttctccttccagtaagtatggaatacgagtcgtcagtggccaagtttccagtgactatcaaacaacagactgtacccaagttgtatgaccctggacctggtaagactcttatccccaaggctcaggcattgtatcaggcctggtgaaattcagagggcatggtggtttgaatgaccagggttccccccaaggctggtatatttgaatgcttagactaatagctggtggaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggtttgctactgtatataccaaggtacctggccctagaccttctagagactctcctgtctccaccttccatctcactggggttacagttatggtattgagacgagctttacatgggagctggggatttgaacttatactctcatgtttgtgcagctggaactttatccaccaaggtatcttcctagtcccgagtgatttttcttttcttttaaaatatttgtttgtttgtttattgtatgtgaatacactgtagctgtcttcagacacaccagaaaggggtatcagaccccattacagatggttgtgccaccttgtggttgctgggatttgaactcaggacctccagaagagcagtcaatgctcttaaccactgagctatctccccagccctgtgatttttctttttaacattgaatctataaacgttcttttagtgattttgctttttgttttgtgaggttgggtgttgttacacagcctaggctggtcttgacttcaccatcctgcagtttctgcctctctggctcccaagcactgggaatataggtgtgagcctgtatacctagcctagcgcttgatatctctctctcacacacacacacacacacacacacacacacacacacacacacacacactcttcttgcaacatatggatcaggatgcaagtcctcagctactgcttcagtgtcatgcctgcttgtctgctaacatacttccagccatgatggttatgaaccatccctcggaaacaataaataagccctcagttaaatgctttcctttctacgttgccttggtcatagtgtctcttcacagcaatagaacagtaattaagatacttgtcaagttatatttgcctaccaactcctccatggtgttgaataatagtagcaggcagttttgtttgctcctgactttaagaagaaaataatagcatgatgccattcatgttgccatgtggcaggtgtttcagggcaaaaaacctttcttcttccatctcctttctaagaatttttattattaatgaatgttgaatcttttcgaatcttaagatttgacattgcatttgtgtgcatttgcttacacacacacacacacatatatatacacatacatactttttttggtttttttcgagacagggtttctctgtatagctctggctgtcctggaactcactttgtagaccaggctggcctcgaactgaactcagaaatctgcctgcctctgcctcccgagtgctgggattaaaggcgtgtgccaccacgcccagctttatgtatgtgcaccacatactcagtgtccatggaggccaggtggctgggagcctgcaggtggctgctgggaacccaagtcctctgcaagagcagctgctgtttattgctcctggtgtttgtatcgtggtgttttttcccgtggaagagctgacccttttccctttgtaagctttttgcttacatgttttgcatacatatgttgtgtgtgtacacgtctgcttgtatatcgatgatacactgtcgggagcaggttgtggggaaataaagggggtgggagagatgacctgcatcctgccatgtggatgtctggctgcgaaaagtcatggaaccccagtttgaaggggtagcgagggagcagtccagggtctctgggcctcatggaggccagagatgagaggttctcagtctcagacatcccagacaccactgtatttcgtggaagagctgagaacaaagtgagggccccaggggcggggttaggggggcagctttgtcagccttgggaccgaagtgggcaaggggagaaggtgctgggtggttcccacacgggcaagagtctggctagctcagactgttagctctgcaggcggcttgggttggctgggtctagcacagtgggtcttgatgagcaaagatggtccatggttttagagctttattgtagaaagtcaaaggggggggaggaagaggaggaggaggagaggccatgtggagagagaggagaaagaagagggaggagagaggtaagagacaagaagagcttaagagagagaggaggggctgagaagcctcttttatagtgggatgggttaccttgctgttgctaggtaactgtgggaaggagcttacctggctatagccagaacaccaggagcttgggacattgtctatgtgactgatagtcacaggcttatgcagttgaggagttgtgacgtcaggcacttgtgtctgggcgcatagcttatggttcagtcccttgtagatttttctactgggtttcccgagtaagcctcactcgaccagaacagactgcctttcatggttcaacaatgcacatgaacacatgcacaaacacatgaagagcaagtggaggaccacgggtactgcctggaaccctcctccatggcacttccacctagttcactgaaatggagtccgagtcaaagccagagctcaataatacagctagtctccctggctagcttaccctggggttcccctgaatccaccttctgaagctagaattacaggcatgctgccacaccctcccaagcacttacgtgggttctggggacgtgaatttgaggaactgcacatttgaatggcaaatgtttgaaccactgagcatctccccagcttctccaattcctgtgggtttcttgtttgtctttacaagtcatgtgctttatggtgaacagcctggtccaggtcctctggtcttcaagtagacttctttctaaccatgccttcctgagatagaggcaggaaacttctcctgtgaagctcttctcagaacggatggcaaaggtaggccatgaggcttttagaccttttcttctctccctgggctctgggcatcaaaacttctagtagttaacgtggaagcaggacacaaggggttgctaacaggcatgctggaaatgaagaatccaggcaacaggaaatggcatagcaaatgcaaccaaggacaaaatgacttcaccaagttgggtaaccttaaaatgtctttacttcccagtgcaactaaaaaaaaaaaaaaaaaaaaaaaaacctctgattaaacaactcctgcaactcctgtgtacagaaggcacgaggccttaggtcagaggataaagaggtcatcagatgatgggagtgtggctcaattggtagaatgctcagcatgagagaggccctaggtttgaatccccggcctggtaggaaacaaaacaaagcaaaacccaactgaacaaaacaaatcgggaagggggctctagcatccacttttacactcttctctagagaggaagatcagaaacctggtgaccattgccacgaagacttttctccgtccccacaagcttaagatcctgcttcagagtattcgaaaatattacccagacatcaccgtgattgtagctgatgacagcaaggagcccctggaaattaatgatgactacgtggagtactacaccatgccctttgggaaggtatgtccccctcagactggggacatttagctcccagaacaagagggacccagattcagttgtttccctgatcatctctgtggcaaggctgggtggagtcgggtggggtaatgggtgggtgggggccggggcttctcttgttctgatgcagagggaaactggatcgatcgttatcccacattaatgaagtgctagtttattctaccttcctcctattcgatgtggaaattgacaggggttcttacaggtgacatatgggatctgatagctgattgtgatgcatggggccatagcagccttttgttctctgtgactgtccccaagctaggctccctctccctccctgtcccatccacttcctttcctctctcctcctatcttccgccaaacatagaaaagggaaggatatcactgagcgcaaatgttccccaaaccaacatctcccaggaggtagaaggcaactgtaagatgagaggggactccagtctattcatagaggtcactggactaaggaaggactttccagtctttgtctcagcctctgatccagaaagtcactgtccctgccatgtctctctgaggcagactgtagttagtcgtcagccttgtctgaactacagaatcccacagattccaagttcacccatggtgggaggcagcctggtcactgggaattcaagaagcccccgaggtgacaactgctgatccaaccccatgctgcctgcagggctggtttgctgggaggaacctggccatctcacaggtgactactaaatacgtcctctgggtggacgatgactttctcttcagcgacaagaccaagattgaggtactggtggatgtcctggagaaaaccgaactggatgtggtaaggaacaatggccaagctcagctggctgccacctgtagtggtgaggaatggtggagaaagaggaagaaatgttagtgtcagagggaggaactgaggggattagggactcatagctcggacagagagcatgagctctgcttttgactcaaccattttctttgaaacaaattttatatgccacactagagaaaagtttacaattgttctaccaaaaaattaacagttaaaaaaaaagcatatttatacaacattttaaattatattcttggactatataaggtttaagaaaaccatgttcttgttcggtcacatttaaaaaaattattttttagatttatttccttttatttcatgtgtatagtagttctgcctgcacatatatctgtgctcacagaggccagaagagggagttggaccccctggaactggagttacagatgggtgcgagctgacacatgagtactggatgggaacagaactcgggtcctctgcaagaacaaatgcctttaaccactgagccatctctgcaacccccctccacattcattttaaatatgaaaacatagttggggctggtgaaatgactcagcaggtaagagcagtgactgctcttccgaaggtcctgagttcaaatcccagcaaccatatggtggctcacaaccacctgtaatgagatctgatgccctcttccggtgtgtcagaagacagctacagtgtacttatgcataataataaatctttaagaaaaaaagaaaatatagttggacctggtggtacacacctttaatccagcactggggaggcagaagcaggagggtctctgtgagttcaaggccagcatggtctacagagtaagcccttagctcaaagacaacaacaaaaccaaacccctaaatttatattgtgtgtggtagtacatacctatggaagcaggatgatgggggctcgaggccagcctcagctacgaagcaggtgtgtatgtatgtgtatacacatgtgtatgtgcgtgcctgcatgtggagatagggattcagtgacccagcagtagtgtggaaagggctgtggccacatggcagagccactgagggtcctttggaggctagatccagagtacagttttttttttttttttgtttttcgagacagggtttctctgtatagccctggctgtcctggaactcactttgtagaccaggctggcctcgaactcaagagatccacctgcctctgcctcccgagtgctgggattaaaggcgtgcgccaccacgcccggcttcagagtacagtttttgttctcgtaaaagctgcagtcctgggaggcttcgcagaggaatgaacactgatctgctcagaccctggtttctgtttgctgactaggtgggtggcagcgtgcaggggaatacttaccagttcaggctgctgtatgaacagaccaagaatgggagctgtcttcaccagaggtggggatcattccaggcccttgacggctttcccggatgcacgttgaccagcggcgtggtgaacttcttcttggctcacacggaacaactccgaagagttggttttgatcccatcttgcaacgagtggcccacggaggtgagaggcttggaggggtgcgctggggagtggggaagggggtcctcctgggaaactccttcttgataccccagggatctttctttcaccccagactgtggaactcatggtccctcttgccgccctcatctcccggtgtctccctatgctgcctctgcccacttgagacacgtttctccgtccttccccgcagctcagccctctacctttctcagcttcagtcttctttcagaacgtcttttccaccaaaaactgcacttagggactgccctctcccttcaccccttcctctccagaacccacagtcccatttagtggaacccagcggacttgacgcccactctccaatctgagaaactgaggttatctgtttctttcctttcagctccagggctccctgtccggcgtgggtggggaaccacagctgtctgtctttagcttccttttgtctcccgttcctcttctctttgcagagttctttattgatgggctggggagactgttggtgggctcttgcccgggtgtaattataaaccaccaagtaagaacaccaccaaaggatccaaagctggctgccttggagaagacttatgacaaatacagggccaacaccaattctgtgatccaattcaaggttgcactccagtacttcaagaaccatctctactgctccacttaaaaagtaccaagaccaggaatcgcaataaacagattagcggcgggcaacaaaaaaaatagtaggattggacattggagggtaccaaaagcagactcctaacaaggggaacagggaacaaagaagctggaagctggagctagggtaggaccctgaagtcggctcaggacccccaagaccaaattctcagcacagagatttatctgccctagagagagaaagggcagggaatgagacaaagacaagggctggaaggtggtggggcacacctttaatcacagcactccgggggcagaagcaggtggatctctgcgcattttgaggacagcctggtctacagagagagttccaggacagccagggctacagagaaactcttatcttaaaaaggcaataagttgatctaaaataatgttatttaaagccagatgataaggttggtgtagtgttgtgatcccaaagcccagtaactgaagtaggaggattgagttcaaggccagcctgggctatgtaacagcccatctttaaatgagtgactagggggctggagagagctcagtgcttaagagcgattaggacagaggacctagattggctcccaggacccacatgatgagtcacaacttcatacctgcagtttcagggaattggaagcatctgcttacctccaaaggctcctgcatatgagtggtgcatacatacacgcaggcacacacatatgcacacaaaatacgctttaaaataaatgaaggaatgagtgaatggctaaatattaaccaaataattccgattttattttgtcaagactgcctggcctagcactcactgtgtaagactgacctcacactcatggcaatcctcctgtctccacttcccagtgctgaggtatgaggtgtgaaccacaatttctggcttggatttttaaaaagaatttacacacacacacatacatacacacacactgtagctgtcttcagacacatcagaaagggcatcagatcccattacagatggttgtgagccaccatgtggttgctgggaattgaactcagaacctctggaaaagcagtcagtgctcttaactgataagccatctctctagtctctagcttgatttttaaactttgacttttaaatatacttattcattataattttttttctttttgagacagggtttctctgtgtagccctggctgtcctggaactcactctgtagaccaggctggcctcgaactcagaaatccgcctgcctctgcctcccgagggctgggattaaaggcatgcaccaccatgcccggcttatattttgattttaatgggatattaagatggatgttaagattgtgagctttcaaccctgtctcggaaaaccaaaaaaaaaaaaaaaaagaaagaaaagattgtgagccttcatgtggttgttggggatagaatctccactcactccagtcaaccctgttctcagtccctgctaactccggcccaaagatttatttattattataattattatacgtaagtacactgtagctgacttcagacacactagaagagtgtcagatctcattaccggtagttgagtcaccatgtagttgcggggacttgaactcaggatctttggaagagcagtccatcctcttaccctctgagccatctcgccagcccatttcaacactctgaacatacttacactttattttttacttcctgaggtaaatattgctctgagctagaccatagaaagccaaacaccagtgggtaaggaggcgaggaatgacatgccagctagttgtggtgtgggcctttaatcccagccttgaattcagagatcctctagccagggctaggcagtgagctctgttttgttttgttttgttctgttttcagaacaaaaccaaaatcaggggctgaggaaatggctcaaaaggtgaagtgtttgttacccaagcatgaggacttgagttcagattcccagaagtaaggcatagctgccagtctgtaaccctgggcattctcacagcaaatgttaacatcctccattttgactgggttgtcgttagcatgctcaaacacagtcttttctctacttcaagatctagaaccatctctccagaagagagagagagagacagagagtgagttagtttcctatgatccagtaacacctcttccccaggaacacaggatgttctaaaaggacatccattcaactcaaagggttcagggactccctgaaacccaccagacagactaggccccctcttttccaagtatattagctgtgaagactgctgagaggcactctcagacaagttgagctgcctgaaacagacattctctaacctgttgagctgtctgcaagttgtacagagggcttcaagtttacagcttttgtgacatggtgagctttcatggtgccgctgtctttcgagtcatttgtgatcctgcggtaacccctcacccatacttctgtctgtaaccccaataaaactcatcagtctgctatactggactcgggtggtgtgcttattttgatccgtcattggttcctgattggagtgagtacatgtttgtccccatcttcccaaggttagtgtcacatggcagggtgatattaagagtctctgagcacaaaactggaacatttcttcctttgggtcttcccgtgtcccaaagcaagtggctcagtgaccaagtctgttaaaacattagccacatttaaagactatgaaggcccagggcccactcttgagactgccagccacatcaagtggagtgagagggcaggttaaaaaacaaaaaacagaaacacaacgaacccccttcctgctaattcatactgcagtaagcaaagacagggaagcaatctttttttttttttttttttttggtttttccagacagggtttctctgtatagccctggctgtcctggaactcactttgtagaccaggctggcctcgaactcaaaaatccacctgcctctgcctcccaagtgctggaattaaaggcgtgcaccaccatgcccggctggaagcaatcttttaatgccaccagaggaacacaagtagggttacagtgagtgtgccagttcgattaagttaagaaagaaggtgtggggaatgcctgggacaaacctgagcatggagaagtggggacacaagggcagtcactgtcacctacacactcgctgtagggatataatcctcttgagaacccataccaggccagtttgtggtgacaatgtcttcgatctctggtctacagagccagttgtggggcaggagagctacagagctatatagtgaaccctggaaagtggaccgggagtggggggggcaggggagggggaaattatgccaatgtgtcctgtgcagtcatgggaccctttcggagggtggggcagatctctatgtagccctagctctcctggaactcacagagatgagcctgcttgtgcccacagagtgctggaattaaagccatgtgccaccacgcccagctcacatggcctttgtaagaatgattcagtgcacaaagctttctacaagatggggaaaaaatcggaaaatgattttactggctggctgctcttagtatctgtggaaaaaatgatgaatgaaaggaaggagttgtgtgataaaatcgaaaggctccagacacaagtaaacgatctaaaagttgctaagtgtgtccttgaggagaatcttctctcttgtagcaatagagctcaagttgcagaaaatcaaacagaaactctcattgtaaggctggctgaactacagcgaaaattcaagtctcagcctcagagtgtgtcgacagttaaagtaagggctctaattggcaaagaatgggatcctacaacatgggacggggatgtgtgggaagaccatgttgaagctgagaattttgaatcttcagattctcaagggtttgccccacctgaggaagtccaaaaatggagggcatacccgtgaggggcttttgcacaatttgaagtaggaagagccacttcaagttcagatcctgaggtaggaagtcacactagagtatagtatatactctatattaatatacatttataatatatgattacttatatacagaaatatttatattatatgtaatagtctattataattaaatatattcatcccataagttgctatcctatagaaccctagtacaaggtcacacagcaaatagactgcannnnnnnnnnnnnnnnnnnngtggggcaggtctctatgtagccctagctctcctggaactcacagagatgagcctgcttgtgcccacagagtgctggaattaaagccatgtgctcccacgcccagctcacatggcctttgtaagaatgaaataagcgggaaaataaatgaggtctacaaatgcctagtgttcaagcacagccttgaggtactgggtttcagacccaggacaagaggctgaggttttggtattttaccaaagcagacctggcctccaggttctcccagcatccctcagtccctacttgaactctgcagcccagaggctgggcttctcctcagaggttcttcactatataatccagacattttgttttggtctgggcatcctgtacccccagccccctctgcatttctcttcccccctccgctctgtctccttgtctgcacggtgacctccctggtctcatttcttgggactggtgaacctgcctaagagctgcctccaataaacctgcctttatactttaacttggcatgagctggctcatttcatcgtcggagataacctatcaggaatctcaatgtcagatggggttaattctcaaaatggaaactctgtagtgttccttctgataatatgcaagagctacaaactacttttcttttcttcttacttttttgtttgtttgtttgtttttggagacagggtttccctgtacgataatagcccagccctggctgatctgaaacttattctgtagactggactcaaactcgcctgcctctgcctccagagtgttcagattaaaggcgtgcacaccgcccgccatgcacacccacactagaaaatctcttatccattcactcagggacaaactgtcagactcttaccaaatgagcgcttggacttggactaactgcattcgtgactgcatgcacagaagaggaatttagcagaatagtggacagctcatagcactagaagggggtagacaaagcaagctcagggaagtggccaagaatccagggactgaggcaaccaggggcccaacaaggccagtttgcttggcatgtcacctgagaggacagtgggcatggcctggctgccttactgcactgaggtcaatggtgtcgaagacaccaccagaactggatccagttttaaaatctctggttcctgggtgtcagttgttggactgagttcaactggccaagctaaagatagtcaggccgacgcacacaaacacacacgcttacacacacacacacgcttacacacacacacacgcttacacacggtctttctttctctctctctctctctctctctcacacacacacacacacacacacacacacacacacagagcctggagaataagtgtatgtaccttggacacagtctagtgtcacccagacttgcaaaaacattggatttctcaagaaagtgagacaagctatttttggatgtcaacttgactacatctgagattaactaaagtccaaaaatggagggcatacccgtgaggggcttttgcacaatttgaagtaggaagagccacttcaagttcagatcctgaggtaggaagtcacactagagtatagtatatactctatattaatatacatttataatatatgattacttatatacagaaatatttatattatatgtaatagtctattataattaaatatattcatcccataagttgctatcctatagaaccctagtacaaggtcacacagcaaatagactgcacggtacatagctcttctgtttgcttgtgtataagaagtgaaaagcgggctggtaagatggctcagtggttaagagtgccgactgttcttcctcaggtcccagcgactacatggtggctcacagccatccgtagtggaatctgatgccctcttctggagtgtctgaagacagctacagtgtacttacatataataaataaataataataataaaaaannnnnnnnnnnnnnnnnnnnccaaaaatggagggcatacccgtgaggggcttttgcacaatttgaagtaggaagagccacttcaagttcagatcctgaggtaggaagtcacactagagtatagtatatactctatattaatatacatttataatatatgattacttatatacagaaatatttatattatatgtaatagtctattataattaaatatattcatcccataagttgctatcctatagaaccctagtacaaggtcacacagcaaatagactgcacagtacatagctcttctgtttgcttgtgtataagaagtgaaaagcgggctggtaagatggctcagtggttaagagtgccgactgttcttcctcaggtcccagcgactacatggtggctcacagccatccgtagtggaatctgatgccctcttctggagtgtctgaagacagctacagtgtacttacatataataaataaataataataataaaaaattgtaaaaaaaaaaaaaaaaagaagtgaaaagcagagctgtttggtttggtcttttgtctcaatacatgtttgggggcgggtaagtggtgccaggggacctctacagagtggtgatctgtaggaaacaaggttgctcaattcaatacaattaagcagccagtgttggttcaaactttgcaagcctgaccccaagtagtttatttggtgaaaacttacctggtgataattaacccaatcacctgtgcacagcacagcttaggacaccactgcactggaactctttgtaaagtacatgtgacatcttccagaaagatagtttctatagactgagaaaaacatgctcaccgataagagtccagggaggaactggtgagatctcagcctatcagtctcaggtcacaggccattacccacatctgctcccagccttctgggcagaagacacgtcatacatctctctcactaaacagacattcctgtgtagttaacattcctggtgtccctagtgcttatctgagcctcgcacacaggttatttcttaaactcttgtagaggacttatacaatagccatcattatggggccaagcctcactatattataataaacaatacatagtccagagcatccttgaagcagcctcgaggcacagatggatgtccactagggtaatgctccgaaggtgaactgctgagtcaaagtgttgactgacctgcagaaacacatttagggaaaatgaaagactagacagtgcagaagtggggattttgttgttgttttgcgggatatgtgtgtgtgtgcgcgtggtgtgttgaatggtgggtgtctgttgttaaaattctgactgggtttttctaaggatcggcacactagaagtttcggtagtccggcctttagaagcgcggggggaagtgcagaattggaagcgccaatctccctacagataatttgcatagcgcggagcaggggctgcggcatccacgtgcggcgcactctccagcatccccgtctgtaccccaggtttcgtccggggtttgaacagctgtgccaccacgtgccagtccgcgtccttccccgctgggccaaagcgtcctcgccacagccctcctgatataaacgcagaaaacaagtagaaagcccaggctgcgtgcgccgaacctcctgcccggagtccgggaccggagccggctttctccggacttggtccgatcggacgaccagccgccctcgagacttggggtcaagagccgggacccttggaggatcaccggaagaggtgacagacacctcggggcccatgaacgtttggaattcgtaaggacatgagaatctcggtggttccgtgtctgcccgccatcgcggccaccggccacgggcccaagccaagtgtagcgaagcttagaaaaggttgcccaacgtcatgtggcttgagaaggctgccgggcgccttaagccgccagcaggtcccatggtgtaatggttagcactctggactttgaatccagcgatccgagttcaaatctcggtgggacctcactgaacctttttttggccttagggattctgttttggggcctgcaggaagtagcaaccaacccgagcctccgcagggaatgcactgacctgtagaatggacgttcagcttccctccctgtgtctcaacacgattacatttcaggaacagcctgggctgggaggcactgcgcacgcgcgccgagtcgggcggaaaaataaacgagttgatggaagactgaacataactttacccaggagggaaaacgaaagaacccgaaggatcccgaggctttcctgtctgagtaccgctgcacacaccgcgcctcggagtccccgccccctaccctctgattggctgctgtgcagaacgcgcggtaggattgctttgtgagccgcgaatgaagtggccggacggggccggggggcgggtaagtggtgccaggggacctctgattgggtacaagagagcgattcccggaggcttgtgcgtttaggggtcataaacccgtgttttggttctgcgttgctcacccagcgaggttgtgtttcaattagacaacagtcacttagtcaggctggcaggcggtcagtacagtttctcaccgtccatgaggtgtttctccgagagaagggcaggaatcgctaaggatttctttagctgcatcgcgccgcgggtggaaaatatgtacagggagtattgtatcttctttggattaagatctgggatttgtgttcgtccctgtgggataaatgacgagggagcctgctgacgcattatggtctccctacagagtgattggcacggtggctataggttctcacccttgggaggatgccatggaaaccaaaaggagcctctcccgactctccgattaattctctaagcatgcctcttgcagacacaacccacgcactctttaaaacatctgaatggatcagtttgaatgaaccatcgcaacctcaaaaagatcaagacgtgagaggaggcacacttgcgctaccagaaaataaagatgcttgttaactgtacattaaagaaattaagataatgtctggatggataaacataccgatggaacagaatagggaagcaagatgcagcctcacctttatgcatagtttataataacaaaggtgtcacaaatttaaataataataaaaggtagcacaacagagttaggggaaaggacctacttgacatcctgctgtgtgcttgcttatagggaaagaatatgaaatcggattcttgttaacactaaacacagcagaaagtcccaagagaattgttgacctgaaagtgacagaagcggtgagcttggctgacgacataggggaatgcctacacctcagtttaaacaaagcccgaataaaacgcacagacgaggactgtgctactccaagtaccatcagaagagtgaaaatatctgggcctgttgctcaatggtgaactgcaaggcactcagggcctggcatactaagagaaaaggtaagccacagactagggatatgcatgtgtaatgcataaatagcaaataaatctaaataaattctcaaagcctgtaagaaaactgcctgccgaaaaatagcaaaacctgtgctaggggcatagctcagcaggtaaagagcttgcatgcaaccatgctggacctgagctccatccacagaactcatgtcagagctgggcatgctggggattgtagtcctaatgctggggaagtgaaggcagaagggtcattggccagccaatgagagaacctgtctttagaaagaaagaaaacacctcacattgaccctggcttccacattcataccaacatatgcacgcctttaatcccagcacttggaag

SEQ ID NO: 1394 - DNA, 895 bp, Mus musculus
cagtaagtatggaatacgagtcgtcagtggccaagtttccagtgactatcaaacaacagactgtacccaagttgtatgaccctggacctgagaggaagatcagaaacctggtgaccattgccacgaagacttttctccgtccccacaagcttaagatcctgcttcagagtattcgaaaatattacccagacatcaccgtgattgtagctgatgacagcaaggagcccctggaaattaatgatgactacgtggagtactacaccatgccctttgggaagggctggtttgctgggaggaacctggccatctcacaggtgactactaaatacgtcctctgggtggacgatgactttctcttcagcgacaagaccaagattgaggtactggtggatgtcctggagaaaaccgaactggatgtggtgggtggcagcgtgcaggggaatacttaccagttcaggctgctgtatgaacagaccaagaatgggagctgtcttcaccagaggtggggatcattccaggcccttgacggctttcccggatgcacgttgaccagcggcgtggtgaacttcttcttggctcacacggaacaactccgaagagttggttttgatcccatcttgcaacgagtggcccacggagagttctttattgatgggctggggagactgttggtgggctcttgcccgggtgtaattataaaccaccaagtaagaacaccaccaaaggatccaaagctggctgccttggagaagacttatgacaaatacagggccaacaccaattctgtgatccaattcaaggttgcactccagtacttcaagaaccatctctactgctccacttaaaaagtaccaagaccaggaatcgcaataaacagattagcggcgggcaacaa

SEQ ID NO: 1395 - protein, 280 aa, Mus musculus
VSMEYESSVAKFPVTIKQQTVPKLYDPGPERKIRNLVTIATKTFLRPHKLKILLQSIRKYYPDITVIVADDSKEPLEINDDYVEYYTMPFGKGWFAGRNLAISQVTTKYVLWVDDDFLFSDKTKIEVLVDVLEKTELDVVGGSVQGNTYQFRLLYEQTKNGSCLHQRWGSFQALDGFPGCTLTSGVVNFFLAHTEQLRRVGFDPILQRVAHGEFFIDGLGRLLVGSCPGVIINHQVRTPPKDPKLAALEKTYDKYRANTNSVIQFKVALQYFKNHLYCST

SEQ ID NO: 1396 - DNA, 56577 bp, Homo sapiens
  misc_feature (1)...(56577): n = A,T,C or G
ggcacatgtttggaaaggcccgtgtgttactttttgttagtaaccatttttcctgctatgaggataataattaagcaaaatgctacagtaactgagattctctgtctgatattccaccccgaggctgctacagcatatagtcctactgcaaatagtagagtgagtaaagcagttcccacagggtggcatagtcgaaaatttccattaaaaggttttaatatttggctgagaaggagaggtaggaacgacaaaaagtatttggtgaagtaggggtgagactgagtaagatgactagttctcacttagttacttattttttatgattttcagcttaagatttcctatttctttacattgatatttaggatgttcctttgggctgtcaggggttgcttcctcagctttccaggctttgacttgagtgtgatgtatccaggagttgattcctgtaacagatactgtctcaattgccctggattccctggactcactagacgtgggggcaaaggattctgggcaccctcagttattagttgtcagtgccagcagtgaagagatttcctcctgtcatggttggaggcttacaggcagcacctgctcaaacagctagttttcagttcatagggctttaagaaagcacagcttatttggaaacttgtagccagaaaagttagaatttaatttaaactgtagaaaataataaaaattgaaaaacatttggcaacactagaatttaataacaggtgtgctatagtttttgaaacataatttcctttctccaatttcccatttttattaaaagacaaatcatggtaggaatggcttgttttattatacttggcttaattatttgcatacagtgcagcaagaataattatttgttacataggccttttaaattggcattgatggaactttgttccatagaaggaatctcagataagactttttaaagctgagcccagccatggaattataccattaaatacctatgagtttccccttgagattccaaaataacttggggttcctggcctatcagaaagtgacattctttacttaccacagatcagaaaccctgtacagggactgtgtacacaaaacgtgaggccaatttcccaagagctttcttggcttcataagtcaggtttgattccttaaaggaaagcacaccattccagccaaagccttggtaaaataaccagtttttccaattgtgtcctgttacaaaagaaaacagattcttattgcacttatgcaaataactatattgccacaacttaagaatactcacagtttccaaattctggagaaaatcaggtagagagaaacaagtatgctccaaattttgttcatgggagtatactaaattgttaaaagctgtcaatagctcaaaagaaaagtttctttgactttgaaaagcaaaacaaaggattagcaatattttcagcaaaacgtcaaaaagatcacttcagtctcctattagttcagttaatgcggttaatttctgtcctgcttgatattaatgaacgttttagctctttgagagtcctgaacgtttttcctctattctgatgtcacaatctccaaagttatcaaaaagctgcattcaagagcacctgttagagctttatagctgattataagactaccttctaaagaggaccaaaacaagacaacaattgtttatggatgacaaaaagttttagggtagccatagttaaagtcacaattgacaaggatatctgttacctttgtggcacacaatagttttaacataacaattataattactactgataacatacactaagatatatcagaattataggagtctcccataactttggaacacataccaataacatatttatacaaatatagcccaaagaaagccaaacaccattttctatttgacaatgcttcctgtatgattttataccaaattttaccattatattagtgtgctattaatgttaagctcaatttttaataaaaccttgtagacaaatttaccgaattttaatgtttgaccataaagtaaagatttttataaaaatctttaaaaatagtctatagacccattataatttttgctaagagcaggttagtgctttaagagaaacctgttgtgcttttattttaatgctcaatttacagaaaaactggatgataccccttcaactttagccaatatgtttacacacagaatttcctttacaattaaccttccaaaaattgcttaaaccttcatttttattttattcaactaaaaacaattctttaaccttttaatctaggtaaaaaaccacattacattttcatgcctccttataatctttttaccaaaactatatgtaaactttttttaatagtcttaaatacatgttacacttaacttttagcaacctttacttttgttggtgagtttgggattttattttatttttatttatttatttttgagatggagtttcactcttgccacctaggctggagtgcaatggtgcaatcttgactcactgcaacctccacttcctgggttcaagcgattctcctgcctcagcctcccgagtagctgggattacaggcgagcgccaccattcctggctaatttttgtatttttaatagagacggggtttcaccatgttggccaggctgatctcgaactcctgacctcaggtgatcctcccgacttggcctcccaaagtgctgggattacagacatgagccactgttcctggccaagcttgggattttaattatgcactaggtgtagagcctaggacctagacagaagtgcagataaggtctgacttatcccagcatttaactccgtgtgtcgccgccatccggtctgggaggtgaggagcatctctgcccggctgcccgtcgtctgggatgtggggagcgcctctgcccggccgcggccccgtctggggggtgaggagcgtctccgccctgtggccgccccgtctgggagggaggtgggggtcggcccccgccgggccggccgccccgtcccggagggaggtgggggggtcagccccccgcccgtccggccgccccgtccgggaggtgaggggcacctctgcccggccgcccctactgggaagtgaggagcccctctgcccggccagccaccccgtccgggagggaggtgggggggtcggccccctgcccgaccagccgcaccgtctgggaggtgaggggtgcctctgcccgaccgcccctactgggaagtgaggagcccctctgcccggccgccaccccgtctgggaggtgtgcccagcagctcattgagagtgggccatgatgacaatggcggttttgtggaatagaaaggggggaaaggtggggaaaagattgagaaatcggatggttgccgtgtctgtgtagaaagaagtagacatgggaaacttttcattttgttctgtactaagaaaaattcttcggccttgggatcctgttgatctatgaccttacccccaaccctgtgctctctgaaacatgtgctgtgtccactcagggttaaatggattaagggcggtgcaagatgtgctttgttaaacagatgcttgacggcagcatgctcgttaagagtcaccaccactccctaatctcaagtacccagggacacaaacactgcggaaggctgcagggtgctctgcctaggaaaaccagagacctttgttcacttgtttatctgctgaccttccctccactattgtcctatgaccctgccaaatccccctctgtgagaaacacccaagaatgatcaataaaaaaaaaaaaaaaacaaactccgtgtgtcctaggacttacctagcttcagtgaaggccagttgtacagctaagagttatagtggcattgtataaagcattcaggaggcctaatcacttttaaatcgtacatttctttttttttctttctttcttttttttttttttttttgagatgcagtcttgctctgtcaccccaggctggagtacgttggttatattggtgcaatctcggctcattgcagtctccacctcctgggttcaagcaattctcactgcagtctccacctcctgggttcaagcaattctcaagctactcaacctcctgaatagctgggactataggtacatgccactacgcccagctaaattaacttttgtgttttcagtagagacagagtttcaccatattagtcaggctggtctcgagctcctgacctcaggtgaaccacccgccttggcctcccaaagtgctgggattacaggcatgagccactgtgtccggcctaaattgtacctttcttgcgtaaattcccttttataaaattttttatgacttacacagacaatttctgatgtgcctcaacttgctgacttgttgtaaacattcctttctttaaacaaccagttaatttacttcaggacaagaatttaccatataagattcttttttatataaattaccttttctttaatttcaagattagaagttaggtatttcactaaacagttcaaggtgtagctatctttattaaaccaatattaatgttcctttatcaaaaaattacacaagcaaagattattctgtttgggctgagttacagttttatagcctctatgccaaattttgacaccttatagcatttggcagagataagtatgaaattgcttgattaataaatgcaaacaaaaatgtatcctggcaactcttaagacatttctaatcttactgtaccagtaagttttaaagattaaagtcatgtgaactgaaggtcccacaacttttactttgtccttaaaaatgtttaagtgcttatttttcttaggccaattaattagagcttttaaaatagatattgcacacataacacatatatagccacacagacaaccagaagaagatccagtaattataagatttaaaaaaaaaaatttccctattggattaatggccttctggtgaggccctttaaaaacaggactaggaaaacagtttccagggcctaataaacaagcatagctggaagacaaagacagattttgagaagcacttattcacctctaattctaggggttccataaggaaaacagatttttcccaaaacgggattcatggtgcctttttgttttcccaaggagtcccaggccaccagaagtcattttagggtctttcatatatgcaccaagaatggcaagacagagtggagaaaagtaattcagttgattgggagaaaacctttcctaggaaaataagatttatgaagagacaaaacataaaggccttttgaatatactcatagcttggatatccattttaattaagctgagcactcttttttttatcaggggtgagggtgaaggttagaattatataaatgtcaggccaggttaaaggattgggttatgtgcgggaattccctgcggtaatgagagggattttcatagaaagatcctaggtatgtttgatttgcaacaaatcagacatggagaaagggcataaacacaagcaatgccttcacccccagccactttccagagagggagaatggcagagatgatttgactggatggagcagtttttgaacgggtcacaggtggagaaggaggggaagcggggtttggggctgaaggcttgcgggcaggaggggccgccagggcagagggttcagatgggtgaggagcagatgcagagggatgagaatgcagagggggttcatctgcagggtcaaaaggagttttggaggaaggagttttgaaggaaggagtttcaggggaaggagagacctggggaaggttttcattaagaaggatttcatgaagggtgcaagcttgagacagagagggtcgggatctaaagtagaagaaagcctggcctgaatagagagaacctcctggcgtttgccattcctggttataaagttgtcattgtccctgagaatttgaaagtaaaaggtgccatatttgggccttcggctcgaaattttaacttgccattatttaatttgtacccgggccaggccgtgttgcaataaaaatctgaacactttggctttatatttcctgtaagccaagttggtgaggttgtgaaggagacagcccagtggagaggatgtgggaatgcaggattgtttggtacccatgtggactggtaagaggaagccgagggtgtctgttttagttctaggcatccccagtcaaaaggcagagacccagaatcctctttataaagaggatggtcaagttgagaagaaactgggcatccccaagatttcttctagcttagtcccactggttctctgaagaccgggatggcagacctgactgtcccgagtaccatgagaaagaaaggggaaggcagatcttaccagttagctggattagtgtctgatgttggatgttccagctggaattggcaaagggcctcttggactggagccacaagaagtggggtggtggggagagaaagagagagacagagagagagagagagatagagaggaggatgagggaggaggaggggagaaagcgaaatacctgatacccattgcaggcagtcagaggtggattcctgagacctgagggttttgagggctcactggagagtagccccagcccgagccttgcaggccctttcaggttagttgtcctcctcatgcaaattgctcaaaaagtaaagtgagagacaagatgggatgggtggccagagactctcaggatccagtgggatgagcagctgctgtccactgcttccttggttgcaagagagcctctatccccaacacccatcctggctttcagcaccaaatgtaagagttaaagaaagaggaaagaaacacaaaaagtggctcaacagtcaaaggtttattttggagaataaacctgagaggggcttctggccgattttttggtcagaagcattctgtcttacagactaggagtatttattggttttagggtgagacagcttatcacaagcttggaatatttctgtgtggggggggaagtttattgcagggttggaatgtctctggtcagaggagaggttatctcagggctggcatgtctctggttggggagggatttatcttatggttggaatgtttctggtcggagatgtcatttgtggtttatggtcatgctaaccttagccattaggctgatgccctttggatttaggtggtttttgatcaaggtgaactttaaaatggtggtgcttgtccaagatggtgatgctcctgtctgtcactcagggtagcagcagggcagctgcttggctgtggtctagacagtcagggaccacagctagctctgccaggcagaaaccctgatcaagctgaaaaagagtaaatattctcctttaatccactctgccttcctgcagtcatccctagagcagggagagaggatctacaaccatagagggttcaccttggaaccacaatcaccaatcacaacactaatgtgaagcaagagttatgcctgaactatcctcttccctgcttccaaaccacagatctgatggaaaagagctttcctacttaaatagagctggtgtggggaaaagagccactttatttcgaatgcgaatctgcctggttaaccccaagtcccaggagtgcctctaaaatgtctagttgggccaggcccagtggctaatgcctgtaatcccagcactttgggaggctgaggtgggtggatcacctgaggtcaggagttcaagaccagcctgaccaacatggtgaaaccctcgtctctactaaaaatacaaaattagccaggtgtggtggtgcatgcctataatcccagctacttaggaggcaggggcaggagaattgcttgaacccgggaggcagaggttgcagtgagccaagatcacaccactgcactccagcttgggcaatagagtgagactccatcttcaaagaaaaaaatgtctagttgtgtattactctttatgtatgaacacttattcattgtaagttttcttcttattgttgcagaaaccatagtttctgcctgtagcccctatgtattccttctagggtacatatgctttttgcccaagatatatgctctgggttgaggggttgtagtatagagatctacctgccttgtggtgtccaggaccacacttctaagttcccttaataaatcacccaataccaacaaactggatttgtctacctcctcctttggtttctcatcttcttcagcatttgggggtctctttgtgtatacaaccctttcacagaacagctggtgatacagggggtttgagggagccagcactggctttagagacacaactcctaggtgaaaatcctagccccattactggccacataagcttgaatgagtcatgaaagatctcataggctcagtcttcacatctgagaagtgcctgacagtgttattacaagagctgaatgaaggacgggaatgaatatggaagctctttgtaagcaaggaggtgttatacaaatgtctttttttacccccctacatgcacgtagtcggtacaacacttttctgattggtcttgtcaaagaggatctcttttccagtctggagctagaaaatagttatctgcatttgttacattaaaactcccttctgagagactccctttctctgctggctgccaaggagctcagacctgaacttgggactcacctgcatcaaagttgtagatcacgctggcatttccttctactcttttccaagactcactttcccagactccgaaaaaaaaaaaaaaaaagcactggccatttttctttttttccctttttttgagatggagtcactctctgtcacccagactggagtgcagtgccatgatcccggctcactgcaacctctgccacctgggttcaagagattctcgtgttctcgtgccttagcctcccaagtagctgggattacaggtgtgtgcaatcaccccgggctaatttttgtatttttagtagagatggggtttcactatgttgcccaggctggtctcaaactcctggcctcaagtgatccacttgcctcagtttcccaaagtgctgggattacacacatgagacaccgcacccggccccattttgcatgcattttgcacgccatatttaaagattcttgccggtcgtggtggctcacacccgtaatcctagcactttgggaggccgagacaggacgattgcttgagcttaggagttcaaggccagcctgggcaacagagtgagacctcctctctacaaattattattattattttttaattagccaggtgcggtcgtgggtgcctgtagtcctagctactcggatggctgaggtgggagaatcatttgagcgctggaggtcgaggctatgagctatgattacactattgcactccaggctgggtgacagtttcaaaaaataaattcttgtatttgtggcagctgggtcattagaatacaatataatcatgcgtgagaggagccatgggaaacactgagcctggcttatgaaaaaggtcctgcaaatctaatttcatctgaagttcaacagactctttcttccaggcacacaggcgttatgtggccgcacgggtccctgcccgttagaaggattcagccacaccccagctttccagttcctggggtcttttgccaggacagtaggtgtggagtgcgtggtgaagtggagggtggaggtgggaccaaggccgaatttagggacccccagcatgagctgcgggtgggtcaaggccgcgaggttggagggcacggggacacagcatagcaaggaaggaacggtagggaccgtggtgatagactaggggtggacgcggggattgtgtttttctttaagcgggagagagaagcccgatcaccggcagcggaggagaaaggtccagggtagacatgggggcgctggtgtgggggcggtcaggagagaagggcgggggccgtcccaagcgtcctgcacctgccctactcgccgagaatttgcccgggtcggtgccagggcggggcagtcggcggcctggctgctaggctccgtgacatccggcagtctgagggcggcgggattcgggatgacttcgggcgggtgagtgtccccggggcagagcagagcgagaggtgaaacttcgggagcagggagcgccgcgggtcctttctggcgtctgcagagcgggcaggtgctggggacgcagacgccggagccagggagcgggcggttggagtcttaagtccaaccggttccccgcataggtggctgcagaggcgaggtgacggcgcgtgcggaacgaactctgcacccccaggaatggggagcgctggcttttccgtgggaaaattccacgtggaggtggcctctcgcggccgggaatgtgtctcggggacgcccgagtgtgggaatcggctcgggagtgcgggcttcggggatctctgcttggaactcagaggcgctgacccagcctggggcccgtttgctgcccacgggaggagccgccgtcaggggtatgtgagtgcccgggcgcggggactgcgggctgtggacagtcggggagcccggcggcttggtctcctccacagtccgcgcggagtcagggaaaagtcggttttcaaatccaggcgcccaccgcagggcagagtgagctgcggttgtgtggccccgcgtgctaaagagcctctacggagtgatataataattaacggggtaaagtacatttgaaagtctaaattaatttttataagctacgaagaaggatcagacatacatttggtattcttttatccgcaaagtttattttgtttgtattttccaaaactctaaaacaatcgctaaacattgacaaagaagtcatctcacaaaaatgcaataacatgtttgtgacatgacatcttgtaagcatgaaaaagaacacgtttggccgggcgcagtggctctcatctgtaatcccagcactttgggaggccgaggtgggcggatcacttgaggtcaggagttcaagaccagcctggccaacatggtgaaaccccgtctctactaaaaatacaaaaattagccgggtgtggtggcaagtgcctgtaatcccagctacttgggaggccgaagcaggagaatgacttgaacctggaagcagaggttgcagtgagccgagattgctccattgcactccagcctgggcgacagagggagactctgtctcaaaaacaaacaaacaaacaaaacaaacaaacaaacaaacaaaaagcagcaacacacgttgaatagaggattggcggaatgggggaaaggaaggcggctttgcatccatccacgtccttggctaaggctttcattccagcgttccccttccccaacttcccccactccacaatccttcatgggtgactgaaaaggaggaagctgggaggcctgatactgatgcggataaatttaaagctggcaaatcctcggcaaatttgacttttcctccacctgtggaatcatgcgtaaaaggtctgcagtttctttttaattgacaaataataatcgtacatattcatgaggtacatagtgatattttgatacatgtagtgataaacacataccatagtgataagatcaggataattagcatatacgtcttctcaaacgtttatcatttctttgtgttgggagcaaacattcaatatcttcctcctagctatttgaaactatattattatcattattttgagatgcagtcttgctccatcacccaggctggagtgcagtgatgcgatctcggctcactgcaatctttccctcccgagctcaagtgattcttccacctcagcctcccgagtagctgggattacaggcgtgcgcacgcgcgccaccatgcccaactaatttttgttattttattttattttttttagacagagtctagctctgtggcccaggctggagtgcagtggcgcaatctcggctcactgcaacctccacctccatggttcaagcaattcccctgcctcagcctccagagtagccgaaattacaggcgcacgccaccacgccctgctaatttcttttgtatttttagtagagacagggtctcatcatgttggccaagctagtcccgaactcctgacctcaaatgatccacccgcctcagcctcccaaagtgctgggagtacagacatgagccacagtgcccagcctgatactatatattattgtaactatgttcatcctacaatgttacaaaacactgaaaggcatttctgctatctagctgaaactgtgtaaccatgcccttggacttcctagtgttcaggaccgtgagccaaataaatttttctgtataaattactctgtggtatacctgtggtattttgtaatggcagcacaaaatggattaagacagtttctataactcgaatagtttaaatgtatttatttttctgggtaccattttagaaaatttagaagttaagatgttacagaaatatgtgacaaagatagtgcaaactcaaattacacatacacacacagagtatttctgagcttcggtttgttccattcacttatttgcttattcctgaattggtaacatgcttttaataactgtggccttatcataactttgctctttagtagtaatatagctatccttcttttttttttttttgacggagtttcactttgcaacctccgcctcccaggttcaagcgattctcctgcctctacaggtgcgtgccaccatgcccgcctaagatgggagtttcaccatgttagctaggatggtcttgatctcctgatctcatgatccacccgcctcggcctcccaaagtgctgggattacaggcgtgagccaccgcgcccggcccatccttcttatttttaatatcttccttgctattcttatgtgttacttctaataaatttnnnnnnnnnnnnnnnnnnnnnnnnnnnnnnnnnnnnnnnnnnnnnncctggcccggcatggtgggctcacgcctgtaatcccagcattttgggaggccgaggcgggcggatcacgaggtcagaagatctagaccatcctggctaacacggcgaaactccgtctctactaaaaatacaaaaataaaataaaataaaataaaaattagccaggtgtggaggtgcgtgcctgtagtcccagctacttgggaggctgaggcaggagaatggcgtgaacctgggaggtggagctcgcagtgagctgagatcacgccactgcactccagcctgggcaacagagcgagactctggatcaaaaaaaaaaaaaaaagaaaatcctgttttgcttttattcatgtggttattatattaaatttataaattactatagagcaaagttacatctctacaaaattgagctattctagtcaagaataaaaagaaggtatctcaatctattcatatatatatttccctaatacagtggtaatttgcttaattctttatttgttcagtgacaaaattaattcttgatcattactaaaaaagaaagaaaaaagagactatagaaacatgttcatttaatagtgcagatcacaattaagaacttgatgtgtgtcatttcaggcatacaatcgaataaagttttaattttttaagggcgcagattttatattttatgtatattcagtaatttgatttttttaaaaggtgcctttatttacttagatgtttaagctctcacattagagtttatttatttatttatttatttatttatttatttatttatttttgagatggagtttccctcttgtcacccaggctggagcacagtggcgcgatctcagcccactgcaacctccacctcctgggttcaagtgattcttatatctcagccttccaagtagctgggattacaggtgcctgccactacactcagctaatttttgtatttttagtggagacggggtttcaccatgttggccaggctggtctcgaattcctgacctcaggtgatctgcctgtctcggcctcccaaagtgctgggattacaggcgtgaaccaccgggcccagcctcacattagagttttacaagctggtgaacacttggcaaattgtttctcccagagaactacaagcatacattcttacacattaaactaatatcaatacacatcacaattttatcaattacatagtaaaacaaattatcaagtatacaaatattaagttacacagcttaaaaggcatgtaatatatcagatgtctgctcagttcattaccagaaacccacttttttttttccccaaagagagattgacaagaaaaggaaaaaattcacacttaaacaaaataactgtaaacaacttccaataggtattttaaaaattacaagctgttcagaaattttatgattaaaaattgctttagttatataatatggtttgaatgtgcccctcagagttcatgtgttggaaacttcatccccaattagacaatgttaagaaatggggccttataagaggtgatgaggccggaagggctctgcgctcatgaatggattaatgccattatcatgggagtgggttcgttatagtaggagtggattcctcataaaaggacaaattcagccccctcttgctgtgtctctcacatgcactcacttgtttttccaccttccaccatgggatgatgcagcaagaaggtccccagatgtggcccctggatcttggatttgccagcctccagaacataaacttctgttccctgtaaattacccagtctcaggtattctgttatagcagcacaaaaccgtacaaaccagaccaaggcagtgtgataacagagcattgtttccttttaaaatgtatttactaaattaaaatgtatgttctacatattctgcacaagaaaaaaacacattttaccaaaaatatttaattgttccctcccattctttttcagaacttaacagggaggcccctgttaagttacccactaaaatttaagcattcgatgaaatgtaatgtctggagatattaaagacatgtgcttccatacagtgtagattttcaaaatgaaaatccataacagcacaagatgagacttagaggaagatgttaaatgatcactgtgagacctgattaaaatccaacaaaaatcagtggttgcacaaacctgatgtatattggtacaaatgcagtagatataaacataaagtgagcaggcaaataatcagataggccccactttcaatgtttgaaatgacaggaggaataaaccatgtaaggtctagagtgttcctagttccggggattttagttctgtgtgatactaaaaatatacaagtattgggcaggccatttaggcacttaatctctctaaatttcctatatattaataagattctagcatggcaatagacttaaagatttataactcaagactgcatgatttcaggaaatgtcggttggtaccaaccataggcacatcttaaatgctaaaaaccaagaatcttttgctaagcgcccaagagatcaagatcatatgggccacctaagagtctgccacataagtcccacatgtttcttcttaagtatctgcctgcctgggtcattttgtgttatgttgttaatttgaagcagatttctgctttcattatgttttctgacttgttggcttatagaaacctttgtagggtagtggttaaaagtgtggtctgcttttgaattctgcatctgtcataaccgagaaagcaggttacttttcctatttagcttcagctatctcatctgatcattgcgtggagtaatcaaacttctctcagccagccttggtggctcatgcgtgtaatcccatcagtttgggaggccgaggcaggcagatcacctgaggtcagtatttgagaccagcctggccaacatggtgaaaccccgtctccactaaaaatacaaagaatagccgggtgtggtggtgggcgcctgtaatcccagctattcaggaggctgaggcaggagaatcatttgaacccaggaggtggaggttgcagtgagctgagattgtgccactgcactccagcctgggtgacaaagcgagactctgtctcaaacaaaacaaaacaaacaacaacaaaagaaaaacaaaaaataaaacttctcttgttatgctgttgtgaggattaaatgagataatgcacacaaagctcttggcagggggtctagaacatactaagtggtcattagacaattattattattaatttttttactatattttgtcaccaggtaccctattaaaatcttactaatagcttctcacctcatacattttagttttctgaatatgtaatcatttcacctgtaaataatactttttatttcccttttcgttatttatgttttattctataagctaatcttactgcattgattagcacttccatgacaatgttagataatagcagtgggcgtttttgttttttttttggagacagagtctccctctgacaccgaggctggagtgcagtggtgcagttttgactcactatatccttcgccctccgggctcaagtgatcgtcccacctcagcctcccaagtagctgggaccacaggcctgggccaccatgcccagctattttttttttcagtagagacattcaccatgttgctggtctcaaactcctgagctcaagcgatccgcctgcctcggccccccaaagtgctgggattacaggcgtgagacaccatgcccagcctattatgtttttagagatggggtctcagttgcccaggctgtaatgcagtagtgcgatcatagctcactacagccttgaactcctgggctcaagggattctcctgacttagcctcctcagtagttaggactataggcacatgccacggtgcttggctatttttcaattttttgtagatacagggtcttgttttgttgcccaggacggtcctgaactcctggcttcaagtgatcctcctgcctaggtctcccaaagtgctcagattatgggcatgagccactatgcccggcgaggttacatttgaattgcattgtcagaacgtatgatctgaacgatttctactttattacagttttctttgtgtcctaatacgtggccaacttttttttttttgagacagagtctcaaattaccactgtattagggaaatatatatgaatagattgagataccttctttttattcttgactagaatagctcaattttgtagagatgtaactttgccctatattaatttataaatataatataatataatttataataaccacgtgaataaaagcaaaacaggattttctttcttttttttttttgagacagaatctctctctcttgcccaggctggagtgcagtggcgtgatctcagctcactgcgacctccgcctcccaggttcacaccattctcctgcctcagcctcccgagtagctgggactacaggcgtccgccacaacacccgactaattttttgtatttttagtagagatggggtttcaccatgttagccaggatggtctcgatctcctgacctcgtgatccacccgccttggcctcccgaagtgctgggattacaggcatgagccaccacacccggcatatgtggccaatttttataaatgttttaagagctctttaacagaatacaaattatatcattttgttgttctgctgctttaaaatatttttgagacttgatcaagtgagacatgtcagcatctctaactatctttgtatttctaatccttctttcatatcctgccattttttactttgtatactttaatgctattattagtggataaaagttcacggctatctgttttggtatcatgcattgatcactataagtggtctttctgtcctatttaatactcttttttattgccttgaatttagctatgctgacattaacattactaaccttttttttttttttttgaggagtctcgctctgtcgccaggctggagtgcagtggcgtgatcttggctcactgcaacctccgcctcccgggttcaagcgattctcctgtctcagcctcccaagtagctggcactacaggcacacgccaccatgcccagctaatttttgtatttttagtagaggctgggtttcaccatgttggccaggatggtcttgatttcttgaccgcgtgatccgcctgcctcggcctcccaaaatgctgggattacaggtgtgagccaccgtgcccagcctctaacctttttttttttctggatttttttgccatccttttatttgtaatttttctaagtccctttgttgcaacttgattctttcctcctctgtttatcagaaatcgattttagtgaccaatataagctatgtgcttagcttacatttttcctgaaattatcagtctcatatacattacataatcaagaaaaaagattttaacataatctgttcttttgtgtcccaacagctcgagatttctgtggctcctcaagatattggtcataatcctggtacttggcattgttggatttatgttcggaagcatgttccttcaagcagtgttcagcagccccaagccagaactcccaagtcctgccccgggtgtccagaagctgaagcttctgcctgaggaacgtctcaggaacctcttttcctacgatggaatctggtgagagactgcgtgttctttctttcaccttaatgcacacatcttccttgctcctcctcaagtaccatgccctactgtgcccattgtacagatggttcccttgctttcctaagcctgtgctgaatgcacaagtgactgcaagccaggatggggcttggtctgtacgatccagtctatgttctctatagcatccagcaaaatcccttaaaactttcgagagcatgtagtttttttttatcaaaactgcagaaaagatgctgcttctctgtctctctgccctccttttatggtggggtgagatacaactgacagtcacgtggctctcagatttaaagaagttaggtgcaggggacaattcaagagaggaaaagtcttcagccttcctctgtccctgcttccctccctttgtccccttgtctctgtgaggggccagtgcaggggactccagggtctcatcatctcagaacagttgggtgtaggaaagaagattttcagggtaaactacacactggattaggactccggtttcctctcacccaccagcctacccacccaatccatgtttacagtcctcttgcttgtttcaggctgttcccgaaaaatcagtgcaaatgtgaagccaacaaagagcagggaggttacaactttcaggatgcctatggccagagcgacctcccagcggtgaaagcgaggagacaggctgaatttgaacactttcagaggaggtaatgcgggtcatgaaggcccttgggttctgagatggaacaaaagccctccctatgtcctgaggttgtgaatcttaagagaaaaagcaggaaggaattctctctcttgcaagggtccctgggaggaactattaggaatgaaacaaagaaggaatcgaggaaatcatccttaaatgaagatttacaaaactttgtatgtacaaaacatttcataacaacaacaacaacaacaaaaagctgggattggtgacacatgtctgtcattctagcactttgggaggtcaagatgggaggatagcttgagcccaggagtttgagaccagcttgggcaatatagtgagacccccatctctacaaaacatttttaaaattagccaggcatgatggtacatgcctgtagtcccagctactcagtaggctgaagtgagaggatcacttgagcccaggaagttgaagctgcaatgagccaggatcacaccactgcactccagcttgggcaacagattgaaactgtgtctccaacaaaagcaaaaacaaaaacaaaaacaaaaacaaaaaaaacaaaaggaatggagatagtttgaaacatctggtggtacatcctccatgcacccaggccatcatagcaggtgattttgtagtcatcaccaaggtgccctattttattcatttatatgttgagagcatactaccctgtgctatatgcaaggagtgtatccctttgttttaaattacaaggggtgtcaacactcaggtgtatcaaccagggttgttggttgaaaaaggcagaatttggctgggcgcggtggctcacgcctgtaatcccaacactttgggagactgaggtgggcggatcacttgaggtcaggagttcgagaccagcctggccaacatggtgaaaccccatctctactaaaaatacaaaaattagctaggcatggtgacgcacgcttgtaatcccagctacttgggaggctgaggcaggagaatcacttgaacccaggaggtggaggttgtagtgagctgagattgtgccactgccctccaacctgagcaacagagcaagactccatctcaaaaaaaagaaaagagaaaaaacaaacaaacaaacaacaacaacaacaaaaacaaaaaaacaaaaaacaagaaaagggctgaacttgattctgcctggcttgtatcaaaagggaatttgttagaaggatgctggggccttaccaaatccataggtggtaggatgtccaggctaggaaatcaggtaagaactaacggagcactgaagaactggtcaggctccagggccatctggtccccatattgttgttgcttctgcaatgaactgtccccaggttactgccttagtgctcaattaactgagcctaactcatgaatcaaaaggaagggaaagggtgcatcagacccctccaggtttgacttttgaagctagccactgtcttagtccgttttctgttactatagcagaatactgcagactgggtaatttataaagaaaaggtaagtttatttagcttacgattctggaggctgagaagtctaacagcacggtgctggcatctggtgaaggcttcttgctacatcataacatggtggagggtaccacatattgacagggcaagagcacatgcatcagctgaggtctctcttcctcttcttataaaactaccagtcccttggttgggcatggtggctcacgcctgtaatttcagcactttgggaggccaagacaggtgaaccacctgaggtcaggagttcgaggccagcctgggcaacatggcgaaactccatctctactaaaaatataaaaattagccaggctgtggtggtgagtgcctgtagtcccagctactcaggaggctgaggcaggagactcacttgaacctgggaggtggaggttgcagtgagctgagatcagaccgctgcactcactccagtctgggtgacagagtgagactccatctcaaaacaacaacaacaataacaaaaaccaccagtcccatcatggggtccctacctgatgaccttatcctaattacttcctaaaggcccctacctccaaacaacatatgaatttgggaattaagtttctaacacatgaaatttggggaacacattcaaaccatagtagccactaccctccaaattacatgcaagtggaaggctccccagaagacagatggaggcaccgtctccatcaggaggtgttgaaagctggacagccagtggaatacacaggtgatgctggcatggatttcaaccctggtgcacctagctatgtgaggagcaactggtcttggtagttaacagtgctgccgcgggaagctgactggctgcattcaggtcctgcatcctctatctgccagctaggtgatcttgggcaagctgcttaatctctgtaaaatgaggatgctaataacacctagctccagttgggcatggtggctcacgcctgtaataccagcactttgggaggccaagacaggcagatcacctgaggtcaggagtttgagaccagcctagccaacatggtgaaaccccatgtattagtcagggttttcttagagggacagaactaacaggggggagagagagagaaagcgagagagagaatttattaagtattaacttacatgatcacaaggtcccacaacaggctgtctgcaagctgaggagcaaagagagccagtccaagttccaaaactgaagaagctggagtccaatgttcgagggcaggaagcacccagcactggagaaagatgtaggctgggaggctaggctcatctcattgcttcacgtttttctgtctgctttatattcgatggcgtctgattagatggtgcccacccaattaagggtgggtctgccttccccagcccactgactcaaatatcagtctcctttggcaacaccctcacagacacaccctggatcaatattgcatccttcaatccaatcgaattgacatttagtattaaccagcacaagtccaccccttgtcaacttgaacccatacacatctcctgagatcatacataatcttcaaataaagacaataataaggttataattatgcctaacataatacaactatcttttgtacgaccagaaacgcaccaatccccaacccaaatactattacataaagttaacaatacttagatgctgatatgaagtcaataaatcttacgtcacatgataaaggaaaaggaaataaaatgaagatattttcttagtacaagtgtgtatatgcacaaacatgtttttaacaaaagaaagaggaaatactcatgacaattacagtcctcatttctgcagctggtcacatggtcgtagctggtattgattatcttcttttactacccattctgtattccccttgccttcagcaagcacctcagcaggtaatgttttttttcctggtggagtgacccaaaccttcattcctgaagggtctgggtcatttgtagccctgcctggattgggctattgtagtttcccattgaccttaatcacagggcatggtaatactaagagacaccctaatggatctcctgtattccatgtgcactcttccttacctccattgtggagtagtagactgattttatcttgatagcccgggtcaatcaccccagctaacacagtaacttccttcttagcctgttgacataaaggtaggaggagtccaaagtgtccaggtggcaatattaacttccactttaatggaattgttgttgtgtacactggtggcagcgttcctccctctggaactaagacctctaggccagcagaacataatgttgcgggaacaggaagcaaaaattttgctagtggatcactaggggtgatggtgagtagtgctacttcccctctttgattcctggacccgtgaatcctggccatgggagaatcagtaccatatattggacactgattcagagcatacatggccttctggagaactttgcctcagccctgcaaagtattgtcacctagttggcattataattgtgacttcaaaaggccattccaccgttctatcaatccagctgcttcaggatgatggggaacatggtaagaccagtgaattccatgagcatgaatccattgccgcacttcttcttcttcttttttttcaagatggagttttgttcttgttgcccaggctggagcgcaatggcacgatctcagctaactgcaacctccacctcccaggctcaagcaattcttctggcttagccacccgagtagttgggattaaaggtgcacgccaccactccctgttaatttttgtattttttatggagatggggtttccccatgttgccgaggctggttttgaactcctagcctcaagtgatccacccaccttggcctcccaaagtgctgggattacaggcgtgagccaccatgcctggcccaacactgtcttttcttaatttccattgctgactactccatagggatcctcaaattctagctaagccatgtgtctaaacattcctgtctgattgagggctccttaaggtgggaatgtagttttcccatcagtccaaggcctctatgagagctaaactgtcctccatcagactggaaggttcatgattacaagggctatgtctcctcccttagactggtacttctaagattgggctctctctccttccttagattagggattccctgaaggttggcactgctcttgcaggatgtcttcagctaatgaaattacatatgataaataacccagaatcatttgctccctggccaatgtcacataagctatataaatctctggagtatatacaggagatgtttcttaatttacattcttcgttacatgttggatgaggtaatctggcaaaattgcatttagagaccacatctgttatcctccggagaatgcatgactgatgtggaaggaatgacccggggatccatataggatgactaattaagaggatgtttgtgcctcttgtctgtatccttgaaattacaaatagagcttgatactggatgagatctctgactcagttgaggctgattggtcaatctgatcctgtgtgttagtgctacattatacttccattaaaaagcagcatgtgtaatgctcctctaagaaaaagttcatttttttcctcttcttttcttgttttctttttctttattcttttcttttctttctttcttttttttttttttgagacaaggtctggctctgctgcccaggctggagtgcagtggtgcaatctctacccactgcaacctccactttctgggctcaagggatcctcccacctcagcctcccaaatagctgggactacaggtgcatgctaccatgcctggctaatttttgtgtttttttgtagatatggggttttgccatgttgcccaggcttgtctcaaactcctgagctcaagcaatccagctgtctcagcctcccaaagtgctgggaatacaggcgtgagccaccatgcctggccagaaaaagtccattttaacccactcccctgaccactaccactgctattctcgtccctttcttaaatgataggttcccttgtaaacctagctaaggagtctgccattatgaatttggtatgtattattccacactatttttaaatactgttatatacatgtatgttatatatatatgtgtgtgtgtgtgtgtatatatatccatataaacatatactgttggttttttgtgtattttagtgtacttggtaccataaaaacaaatcactctgaaatttgtttttttattcaattatatatatatatatatatttcagattataagtttattcaatgcaaaataatcctctgggtgggtgtggtggctcatgccagtaatcctagcactttgggaggctgaggcaggtggatcacctgaggtcagaagcccagcctggccaacatggtgaaaccctgtctctactaaaaatacaaaaattagtcgagcgtgatggtgggcgcctgtaatcccagctacccaggaggctgaggcaggacaatcacttgaacctgggaggtggcagtggcagtgagctaagatcgtgccgctgcactccagcctgggcgacagagtgagatcctgtctcgaaaaaaaaataaaaacaaaacaaaagtcctctccaattttactgaggtggctgaccacatccacaaccaaatctgcctcttactggaatttggttgttgacacagcctcagcctcggcattcttgttggcagcaggctgtgggcttccccacttgtgggtcttgcaggtggctcaccctccagaccttcaggcagagacctgccagtctctggacagctgtggcataaggtggcaagcacaatctctgggggcagatggaggtcatcatggagatactggatacccttgttggtaaggtacgcgtagaaatgtctccaggcaaaccgttcctgcacaaagcctccggacttgagagactgcacaaccttcatgacatgaaggtcgggcaccttcttgtctgccagctccaggtgcttaggcatgtggacatccttcttggccaccgtgactccctcctttaaaaggagttcatagggctgggtgcggtagctcacacctgtaatcccggcactttgggaggccgaggcaggcggatcacgaggtcaagagatcaagaccatcctggccaacatggagaaaccccgtctctattaaaaatacaaaaattagctgggcgtggtggcatgtgcctgtagtcccagctacttgggaggctgaggcaggagaatcgtctgaacctgggcggtggaggttgcaataagccgagatcgtgccactgaattccagtctggcgacagagcgagaccttgtctcaaaaaaaaaaaaaaaggagttgataaatgcattcccgttcttcttaggcatcaacatctcggtggctgcagggtctggggccagaactggaaaggagtatgaaatgtttttaagagctatgtgtatatctagttcatccctctgaattgcaatatagctatgaatatgaatatgctgcattttactaagccacttccctattgaaaggtatttagattgttgaaaaaccttcatgtttacatttacattatttacaataatattacattatatttacattatttcctttttcattaagacatgtataagggccaggcgcggtggctcacacctgtaatcccaacactttgggaggctgaggtgggcggatcacttgaggccaggagttcgataccagcctggccaacatggtgaaaccccatctctacaaaaaaatacaaaaattagctggacatggtggtgtatgcctgtaatcccagctagtcaggaggctgaggcaggaaaatcgcttgaacccgggaggtggagtttgcagtgagccgagatcacaccactgcatcttgcctgggtgacagagtgagtgagacttcgtctcagaaaaaagaaaaatacacgtataaggatgttcatttcaaacaatgctgaaatgaacattcttgtgcttgtcttattgcttacacatgcaagcatttctcctttcacctagcatcttacttgctagatcccagggtgtgccttttttatttttgatagatattgccaaatttccctcaagagggcttgtgtgaactcacactttcatgaagagtgggtaagtgttgcaccttacatacacctaactaacgtttgctatcatcacattttcaaactttaatgaaaaaggtattccatgttttttttaattcacatttccctgattgaagctgagtatgttccatatgttcattgccatttgtatttcctcttccgttaattacctgtttatgttctttaccatttaaaaattttggagtcgggggggggtcagccccccacctggccagccgccccgtccaggaggtgaggggcgcctctgcccggccgcccctactggggaagtgaggagcccctctgtccggccagccgccccgtccgggagggaggtgggggggtcagccccccgcccggccagccgccccgtccgggagggaggtgggggggtcagccccccgcccggccagccgccccgtctgggagggaggtggggggggtcagccccccccgcctgccagcagccccgtccgggaggtgaggggcgcctctgcctggccacccctactgggaagtgaggagcccctctgcctggccaccaccccgtctgggaggtgtacccaacagctcattgagaacgggccatgatgacaatggcggttttgtggaatagaaagcggggaagggtggggaaaagattgagaaatcggatggttgctgtgtctgtgtagaaagaggtagacgtgggagacttttcattttgctctgtactaagaaaaattcttctgccttgggatcctgttgatctgtgatcttacccccaaccctgtgctctctgaaacatgtgctgtgtccactcagggttaaatggattaagggcggtgcaagatgtgctttgttaaacagatgcttgacggcagcatgctcgttaagagtcatcaccactccctaatctcaagtacccagggacacaaacactgcggaaggccgcagggtcctctgcctaggaaaaccagagacctttgttcacttgtttatccgctgaccttccctccactattgtcctgtgaacctgccaaatccccctctgcgagaaacacccaagaatgatcaattaaaaaaataataataaaaaataaaaattttgcctttttcatattaccgtaagtattcactatgatgatctaatcttttttttcaaggtaattaaatgatctcctgcttaaactgggtcccgaaggctaacatttcaaccattgtaccgtagttcctcaaaaagctaatcttgctggatggtgctatgtgcttgcttttgactaaagattgttattggccgggtgtggtggctaacatttgtaatcccagcactttgggaggccaaggcatgcggatcataagatcaagagatcaagaccatcctggccaacatggtgaaaccccgtctctactaaaaatacaaaaattagccgggcatggtggtgtgtgcttgtagtcccagctactaaggaggctgaggcaggagaatcacttgaacccaggaggcagaggttgcagtgagctgagatcgcaccactgaactccagcctggcaacctagcgagactctgtcacaaaaaaaaaaaaaaaatcgttatcaacaaccaaaaaaaccataaaaatagttactctgtttcctctaaaaatattgtgacaacaattactcccatatacactttcttgtgatttagtttatttattatttcagcggtaggagaagttccacctcccttcaggaattggtctacttcttcctttggatattaaggaccatgtgatgattgtcaatcgcttttatcctggttcccacgaagttcagatgtgactttggtgtttagctgctgcagctgggtgggcccctaccgtctgataatttccttcttctatgctggtcatggttttttttaaaaaaaatatgctttgttagccaggcatggtggctctctcctatagtcctggcttctctgacagctgaggcaggaggattgcttgagcccagcggttggagaccagcctgggcaacatagtgagaccctatctctacaaaaaaattttaaaaattagctgggcttggtggcatgtacctgtagtcccagctatgaaaaggctgagatgggaggactgcctgagccagggaggtcaagactgctgcgagccgtgattgtgccactgtactccagccagggtgacaaagtgaaaccctgtctcaaaaacaaaaatgcagccaggtgcggtggctcacgcctgtaatcccagcactttgggaggccaaggcaggtggatcacttgaggtcaggagttcaagaccagcctagctaacatggtgaaaccctgtctctactaaaaatacaacaaaattagccgggcgtggaggcgcactcctataatcccagctactaggtaggctgaggcaggagaatcgcttgagcccgggaggcggagcttgcagtgagccgagatcgcactattgcactccagcctgggtgacgagaatggagggagacagggacaacccaattttgatttctccatattgtcagggcaaggctctgtgcacaggcaccactttgagaacgaaccagggaccagcatcagggcagctgctgacgtttctgttctccttcctgcagagaagggctgccccgcccactgcccctgctggtccagcccaacctcccctttgggtacccagtccacggagtggaggtgatgcccctgcacacggttcccatcccaggtaagtacatccacataccaagagaccccagacaacattctcactcttctaaggcaaaaggagggagaggtcgggtgcagtggctcatgcctgtaattccagcactttgggagtccaaagcaggagttcaagactgcagtgagctatcatcttgccaatacactccagcctgggtgacagagtgagaccccgctgtctcttaaaaaaacaacaacataaaaggggccgggtgctgtgctcacgcctgcctataatcccagcactttgggaggctgaggtgggtggactgcttgagctcaggagtttgagaccagcctgggcaatatggcaaaaccctgtctctacaaaaaatagaaaaattagctggatgtggcggtgggcaactgtagtcccaactacttgtggggttgaagcagaagggttgcttgaacctgggaggccgaggctgcagtgagcagagattgtgccactgcacttcagcctgggtgacaaagtgagatcctgtctcaaaaatagataaaaaataaataaataaaagtatggagcagacattcattggtacctgctgtgtactcagcacaaggcaagaagcttgatgtgattttttttttttttattgcgacggagtcttgctccatctctcaggctagagtgcagtagcatgatctcgggtcactgcaacctccacctcccgggttcaaatgatcctcctgcctcagcctcccaagtagctgagatgacaggcatctgccaccatgcctggctaattttttgtatttttagtagagacgggttttcaccatgttggccaggctagtctcgaattcctgacctcaagtgatctcctcacctcggcctcccaaagtgctgggactacaggcatgagccaccgcgcctggcttgatgtgatttcatttcatgttagccttattgtatccacaactgggaatctcctttagtagccgtgacctcctggggctccaagataacacaggagaggacagaaatctgtgtgcctcaaagaatcttaggacataattggcttttcaatgtcctccatcatcatgggaacaggcaaaacataagccactctgtaaaaagtgcttttttttttttggggacggagtcttgctgtcacccaggttagagtgcaatggcatgatctcggctcactgcaacctcctcctcctgggttcaagccattctcctgcctcagcctcccaagtagttgggattacaagtgcccaccacacctggctaatttttgtatttttagtagagatggggtttcaccatgttggccaaactggtctcgaactcctgacctcaggtgatccacctgcgttggcctcccaaagtgctaggattacaggcatgagccactgagcctggccgggagtgcattgtgaaaagaatatttatgttggttaaaactgccctccatgatggatttttacacacccctctagttcagcatcacattcctcatcagaataaagttgaatattatcagagggaccagaaggatgagcctgcaggcacagatgtcccctcccagtgcagagatgttggattctgtgggtctgtccagtgaagtcttcttctgcttgtgggctcatggcttctggaggcaaacagccccccgaaacctgcaagccccagaaaagacctccaagtaaggtctcggtgtggtgacacctggggatctgacatatctcatggacccagccgagctctctccaggtccagcactgaggagcatgacagatacctgaatttcacaaaccacatctcaaacaggtgagatgagaatgactgcctgagacagagggggatgcaggacatcaacagatggcatgtcccacacagaaggaagggcaaggtcccagacaggggacaaaggggacagggaagcagagatgagagtttagtaagttatcaaaggccacatagagaggatgtacttgaattcaaatttgaattagtcctactatgagaacagagatagattctaaagtaaatgcatttggggtcaagcactagtgttcttgaatagccatcttaaaaactgtttttcattttggatgattcatttcttattgtgataaaatatatataatgggctgggtgcagtggctcttgcctgtaatcccaccactttgggggctgaggcggatggatcacttgaggtcaggagtttgaaaccagcctggccaacatagtgaaaccttgtctctactaaaaatacaaaaattagccaggcatggtggtacatgcctgtggtcccagtactcgtgaggagaattgcttgatcctgggaggcggagtttgcagtgagctgagatcacaccactgcactccagcctggatgacagagtgagattcagtctcaaaaaaaaaaaaaaaaaaaaaaaggactggtgcagtggctcacacctgtaatcccagcactttgggaggctgaggctgttggatcatttgaggtcaggagtttgaaaccagcctgaccaacatggtgaaaccccatctccactaaaaatcgaaaatttgtcgaatgtggtggctcacacctgtagtcccagctactcgggaggctgaggcaggagaatcacttgaacttgggaggtagaggttacagagagttgagattgcgccactgcactccagcctgagcgacagagtgagaccccatctcaaaaaaaaatgtatatatataaaatatagaaacatatatattatattaatgttatataaaaacatatatattattatttataatatataatatttaaacataaaatcaacaacttttttttgtttttgtttttgttttttgagacgcagtcttgctctgtcgcccaggctggagtgcagtgtcgagatctcggctcactgcaagctccgcctcccgggttcacgccattctcccgctcagcctcctgagtagccgggactacaggcacccgccaccatgcccggccaatttttttttgtgtgtttttagtagagacgaggtttcaccgtgttagccaggatgatctcgatctcctgacctcgtgatccgcccgcctcggcctcccaaagcactgagattacaggcttgagccaccgcgcccagccaaaattaactattttaaccattttaaagtgtatacttcagtgacatgaagtatattcatgttgttgtgcaaccatcagtcaccaccagaacttttccatcattcccaactgaaactctgtacccatccaactgaattccccactgtccctctccctggcccctggcaaccaccgttctgctttctgtctctatgggtttggctactccaggtgccttatacaagatgattcattattcatccattgcttcctccccttcagtgacagagattccctgaaggaactgaattaattcacagcctccaaaactgaggacgggcatcagaggttttagaaccgttggggtttgagaaagaccacgaaacaccacttaacagagccctggggagaggcgcacgtgtcagcaaacactctgggcgggaggtgacacttgaaggagctctcaaggatgtgcaggagtccatgaggttggcgagagcagcggggagctgcgatgtctttcatgagcagttttctttccttttccctgtgtcctccaggcctccagtttgaaggacccgatgcccccgtctatgaggtgagtccttctcccagcccctctttgcacttggtgtcctgtcctcattccctcaactgtggctgctctcagcctttgacggagcccctgtccagattcaaggtcagacatgagcccaaggagggaggggatggaagggtgtgtagaaaacttaacttctagccttgggagtggctggagttccagagaggacttcccagaccacactgaagaatgggacccactggctgctgctgcttctggtgcaagaggaagcggccactacagccatgggctctggcactgcgtggcctctgtcagggttagggctggcaggacagacggtgcttgtgccctgccttcctttccccactttatgcagctccacatcaagatcttatggtgctatatctgatcagtgggatgcaaattgtgcccagaaccctaaccaagaggaatctgggaagtgtggttttagttttcccacctttacatgttggtcagaggttggaatgggtgatgagtgagcagatcggcaaggcctccaccacctgtcaccatggagttcttgtttctctatgttgtcttctttttttgagacagggtctcactctgtcacccagtctggagtgcagtgccgcaatcatggctcactgcaggcttgacctcctgggctcaagcaatcctcccgcatcagcctgtgagtagctgggactgcaggcacgcaccaacaaacctggttaattttttttttttgagatggagtctcactctgtcacctagcctggagtgcagtggtgcaatctctgctcactgcaacctccacctcccgagttcaatcgagtctcctgcctcagcctcccaagtagctgggactacaggcatgcaccactacacccagctaattttttgtatttttagtagagacagggtttcaccatgttggccaggctggtctcgaactcctgaccttaagtgatccatcttgacctcccaaagtgctgggattacaggcatgagccaccgtgtctggcccctggttacttattttttatttttagtagagttgtggtcttgccatgttgcccaggctggttttgaactcctgcgctcaaatgatcctcccacctcggtctcccaaagcagtgggattacaggcgtgagccatcgtgcctggctatattgtcttcttcgtagtcctgctctggacctgaattccctgctgcgcgtagttccatgcttatcatctctcttccacgctggaatacaagcttcacgaaggcatttactgctgttttcccagtgcctgtaactcggtttttagaaagtgtctgttgactgactagtatcaacagtgtcgggagtgacactattcaatttcctttaatagataactgcgatgactcacagaaggcaagagaagagagtggctgtgggggtagcaatggggtggagaggagtaagccagttctagctgcattttggaggcagagctgagaggacttgccgccagatgggctgtctgtgtgcagaaaagggtagagcaaggaggacttcccttggggcctggaacaactgagtggatggaggtgccatccacaaggcagagggaatggaggtgagggtgggaggaaacaggtttttagaggaaaatcagtagttccattttgaagacatcaagtttgagttgcttgtgaaaggtcccagcagttggatctcagaaaggtgagctgagacttactacaatgtgaccccatctgcaaaagaacgggttttaaaccatggaaacagatgaaatctagcaggaaggtgtggagtaagaagggaaaagagtctaggattggagtttgagaccagcctggcaaacacggcgaaagcccgtctctactaaacatacaaaaacaaattagccaggtgtggtggctcatgcctgtaatcccagctactcaggaggctgaggcaggataattgctttaacctgggaggtggaggttgcagtgagctgagatcatgcactgcactccagcctgggtgacagagcaagactccatctcaaaaaaaaaaaaaaaaaaaaaggaatccagatcaaggtctgaaaaactccatttggagatatatagagagaggaagaggagttgtcaaagagaggtcaaaaaaggctgtgggtggaataagaagccaagaagaacggaaccctgcgagctgagagatgggaatgtttccagaaatgggtcctttcatccttggggccctaggacttgggggattgggggcgggggcgctagcacagtgactccctgcagagccagccctacactgtcaagggcaccctggtgcttctcccctcacccttatgtgctctgccctggctcctggcctgggtatgtatgtatctttccagggagatattttccaatccctgcattgagcatcattctacctcacccaccctaggtcaccctgacagcttctctggggacactgaacacccttgctgatgtcccagacagtgtggtgcagggcagaggccagaagcagctgatcatttctaccagtgaccggaagctgttgaagttcattcttcagcacgtgacatacaccagcacggggtaccagcaccagaaggtagacataggtgagagcctgtccttggagtgcaaaatgcttagggatccagaagatacctctgggccctttcaaagtcttcctccttcaggaagccttcctgttttttgtgttttgtgtgtgtttgtttgttttgttttgttttgttttttgagacggagtctcactctgtcacccaggctggagtgcagttctgtgatctctgctcactgcaacctccgcctcccaggttcaagttattctcctgcctcaacctcccaagtagctgggattacaggcacctgccaccatgcccggctaatttttgtattttgaatagagacagggtttcaccatcttggccaggctggtcttgaactcctgacctcgtgatccacctgcctcagcctctcaaagtgctgggattacaggcgtgagctacagcgtctggcctgcctgcctgcttttaagattccttccctctttcctctttctaatcccagacacataatttcataattactgtacccagtactatccccacattgccattgaccccatagagccactcgaggagagaacaaatcatgctgtgcgctttgcacctggtgagaaccattcagttcttttcccagtcctctgcagctctcaaagctgaagatttccactgcagtagaggagggagccagcctgtgcctcagcatcttgtcttgggcactaataggaaagaactgggagaactccccattccaagggctttgtctctcccctccttccctcccaccaagaaattctagggagaacaatccctgccactctcagggcagcctgagtttccttctggatgagttaaaagcacccttttctcttttgaccggatacacaggatgcattcccaggacatcaacagaaaaaaatgtaacacggttacagatgatattcatgaccactagctaaagagatagttctccctaccttcagattttcaaacattcctcttcataagattaccctgtgagataaaatagggtgggtatttttatcctggttttgcagacagataaaaaaatcagatagtaaatggtaaagtcaaacttagcccagaccctctggtttcaagcccactccaccctaacacattctcacaggggaagaaatgtgaacttaggagtcattcagcacgttgccccagggacacagcaaggcagaagcctgaatgccagagactctatggggtccttgatctcatcccagccaggactctccccaccaaacctgtactcgcctgtcatggtggcttcccggggtggcatggagtttaatccagacatgatactccctgtgccattatcttatttctccctccagtgagtctggagtccaggtcctcagtggccaagtttccagtgaccatccgccatcctgtcatacccaagctatacgaccctggaccaggtaaggcccttgtccttggggctctgtggtggcaaccctgtgaagctattggtgaaattcagaagggatcacctctgagacggaggagaattgatcaaaatgacagctctgatatgctccctgacaagcttcgtttggaggaaaaaaactctaagacacaatcccctaaaattgcttaattatatttaacttattatgtggttgtgtgctaattttggggaaaaaagctaaaaaattataacattttagtaagtaataataataaaaagaatggtattgaatcaaattggaaatcctgatataaacccaatacatgttggaatttcactgtgtgataaagacatcttgtctggccgggcgcagtgactcatgcctgtaatctcaacactttgggaggcctaggtgggcagatcacctgaggtcaggagttcaagactagtctagccaatatggtgaaaccccatctctactaaaaatacacaaattagctgggcgtggtggcaggcacctgtaatccctgctactctggaggctgaggcaggagaatcactggaacccaggaggtggaggtttcagtgagccaagattgcgccactgcactccagcctgggcaacagagcaagactctgtcttgaaaaaaaaaaaaaagagagaggcagcttgtcaaattaaaggaggacaaatgaacaaattaaaaattggcttttcaaaaaatcacgtgagataatggtgtagctatatgaaagataaaaagttggatccaagtgtgatggcctgcacctgtaatccagctcacacctctaatctcagctactcaggaggcggagatgggaggatcgcttgagcctgggaggtcaaagctgcagtgagccaggatcaccactatactccagcctgtgcaacagagcaagaccctgtctcaaaaaaaattaacaatgaaaaataacttttaaattagaagtaaaacttgaatatatgccacagttcataccaagataaattcaaattgatcagatatctaaatacattttaaagtactagaaaaaaaaacctgtagttaatttttaattagctgggtatggtggcatgcacctgtaatcccagctactggggaggctgaggcaggagtatcatttgaaccctgaaggcggaggttgcagtgagccgagatcctgccactgcactccagcctgagcaacagggcaagactccgtctcaaaaacaaaaaaacaaaaaaacttgtagtttcaaaaaacattcttagggtataaggcatgacacaaaactcagagaccataaagaaaaaattaaaaatataaaatatataaaattttatatattaaaattagcaaatttttttctttttgagacagagtcttgctctgttgcccaggnnnnnnnnnnnnnnnnnnnntgcagtggcacgatctccgctcactgcaagctccacctcccgggctcacaccattctcctgcgtcagcctcccaagtagctgggactacaggcgcccgccaccatgcccggctaatcaaattagcaaattttaataagtaaagtcaaataacaaaggacaaattgggaaaaaaatcttcgattcacattaaagacaaaggtctaattttacttaagagcatctatgactcaataagaaaagaacacccaataatggaaaaatgcacagttcagaaaaaattaaattcagtaacacttttagccattaaaatatatgcccactctcacactgagaaaagtgcatatgaaaactactttcacatcaaaaggttttggacagggctggaaaaacagcatatcaactgtggttaggaatgtaaattggcacctctcgggaggcaatttggcagttcctatcaacattttaaatgtgtatatcctttaggccagcaattccacttctagaaattatcctacagatatttatatctgtgtgaaatgacatttgttcgattgcagcgctgtttgcaatgacaaaaaacagaatgggctgggctcagtggctcacacctgtaatcccagcactttgggaggccgaggtgagcagatcacttgaggtcaggagttcaagatcagcctggccaacatggtgaaaacccatctctactaaaaatccaaaaaatccaaaatcaggcatggtggtgcacgtctgtagtccctgctacttgggaggctgaggcaggagaatcgcttgaacctgggaggtggaggttgcagtgagccgagatcatgccattgcactccagtctgggtgacagagccagaaactgtctcaaaaaaaaaaaaaaaaaaaaaaaagggcaagagggtggcacagggggagggttctggaacaacttctgtccaaacgacttctgatttttgtcattctgggaaagtggctctgtgcactcacccacaaacaggtagggttgtggcttccagcatgcattaactccagctggccccatgccatgcagacatggcaactgcacagtcagatgccagttctccgtttagtggctgaatcccaaacacatctgcagctccagttgtggcatcacggggtcttttccttaggaaagctgtcccctctccagtctcttatacgtcacatgccttaagatggacaattctgtccaggccttgtgatctccaagtatttggagacatttctaaccatgtcttcctgaggatagagatcaggtaagcttttctctaggagttgcagatgatggtagaagcaagtctcaagatttgtagatattttctcctcttcctgggcttcatgaccctccatattgaacccttagatgggcaaagctctgtgcatttcaactctaatattaagatgaaggccagaagcagtggctcatgcccataatcccagcactttaggaggccgaggcaggtggatcacctgaggtcaggagtttgagaccagcctggccaacatagtgaaaccccatctctactaaaaatacaaaaattagctgggtgtgatggtgcatgcctataatcccagctacttgggaggctgaggcaggagaatcacttgaacctgggaggcggaggttgcagtgagccgacattgcaccattgcactccagcctgggcaacagaggcaaaactccgtatcaaaaaaaaaaaaaaaaaaaaggaagaaagcaggacataagcaaagtgctaacaggcaggaggtgtaaaatgaagcattcagacagacagttgggaaatgacatagtggagccaacagaaccaggaaatgcaacaaattgggtatgttgtaaatgtctttattttctaatgcaactaacaaactcttattaagcacctcctgggtacaagaggcatgagacccacagacactgacaggttatggcagaaagaagccatcagatcaaagcaggaaaagacagtgaagcttcctacaggacagagctctgacacccactgttttctgcccagagaggaagctcagaaacctggttaccattgctaccaagactttcctccgcccccacaagctcatgatcatgctccggagtattcgagagtattacccagacttgaccgtaatagtggctgatgacagccagaagcccctggaaattaaagacaaccacgtggagtattacactatgccctttgggaaggtatgtccctctcagattgggtggcacctgcattccaggacaagagggccccagggtcaggttctaccctggatggggccgcttcctcaagggtcttcccaagaaagcagagtccaggagtgggagtgggtgagggctgtcctctgagtcccattgctgattcacagagaaattggtcaccctcacttctctgcattcatgaggtggttattccacctttcctcattttttttttttttttttgagatggagtcttgctctgtcgctcaggctggagtgccgtggcatgatctcagctcactgcaacctccacctcctgggttcaagtgattctcctgccttagcctcctgagtaggtgggattaccagcatgcaccaccacacccggctattttttgtatttttagtagaggcagggttcaccgtgttgggcaggttggtctcaaactcttgtccttaggtgatccgcctatcttggcctcccaaagtttacagatgtgagccatcacacccagcctctcatttctatttttttatttttcattttttttgagatggagtcttgctctgtcacctaggctggagtgcagtggtgcaatcacagtgatcatggcagcctcaaccttaaaggctcaagtgattctctcacctctgcctccctagtagctgggactacaggcatgcaccataatgccaggctaattttttaaatttttttgtagagatggggtctcactgtgttggccaggttggtctcgaactcctgggctcaagagatcctttcacctaggcttcccaaagtgctgggattacaggcgtgagccactgtacactgctcccatctttcctcatttccgatgtggaaatcgattggggtccttataagcgacttgaggtctctgacatctcaaagattcctgacatgtagagaaatctgtcatctccatgattctaccagagctagggtcttggtctctctctcctctttccctctctccctctttctccttgactctctctccctccccactctctctttctctctccttctccctctcttcttcccaccttccctctctcccctacctttcttcctctccactctctctttctctcttcttcccaccctccctctctcccccacctctctctctcctcccacctctctctcactccccactctctctttctctccctctcttcttcccaccctccctcttccccccactgtctctctcactccccactctctccttctctctccctctcttcttcccaccctccttctctcccctcacctttctctctccctccccactctctctttctctctccctctcttcttcccacccttcctctctctttccccccacctctctctctccttgctactctttccctctctcattttcttcctccctctctctcccccttccttcctccaaggacaaaggaggaaacgaatattatacataccagatgtccttcaaacttgacatcttacaggagacaaaaggagagccatagaaactgtcaggtgaaaagggacttcagccaatttatataggccacagagccaaggaatgactttctagcctttctttgtctcagtctttgatccacacagtcactgtcccttccagactttctctgagacatggacttccttcaaccctgtggttcacagccttggctgcacactggattcgctcgcaccaattctaatggaatttgtctggagtgcatgcagcctggctgttgggaatttagaaagctccccaggtgattctaatatgtaatatgggcaaccactcctttaacctcatttcatctacagggttggtttgctggtaggaacctggccatatctcaggtcaccaccaaatacgttctctgggtggacgatgattttctcttcaacgaggagaccaagattgaggtgctggtggatgtcctggagaaaacagaactggacgtggtaagggacagttgccagtttcacccagccacaatctgtagagatggagaagaggggagaagagagcgggaagaaatatataagagaagaggagggggagggaggggagggaggggagggagaggggctggtgcaggaggtgaataggccagtgcaacccaggtggagagtgctgcaccagctcacgcctccatactgacttttctttgagtaaattacacctcctccctcatttgcaattgttttcttttaaaattgtgtgtttatgcagcatttctaactccctccgttgactagtatgagattaaagacaggagcattctggttctatcacacaacattaaaaacagtataaatggtacaaagctttaaaagcacacacggcactaatgacattctaaaaaagaataagaagagaataataaaaacagcctaggtgtgatggcttacacctgtagtcccagcactttgggaggctgaagcaggaggatcgcttgagcccaggagttcaagaccagcctgggcaacatggcaaaacctcatctgtataaagaaatacaaaaaattagccagggatggtggtgtgcatctgtagtccaagctactcaggaggctgaggtgggaggatcacctgagcccaggaggtcaaggatgcagtgagctgagattatgtcactgcactccagcctggacgacagagtgacacctgtctcaaaaaaagaaaataataaaaacatcaaaagtaaattcactgtagaaaagaaaaaggggcatggatgagaaggtaagtggtgtcgtgatcacagttaactctactgcaagtggacaatccccaaaacacctagatcagcaaagacatctcttggcaactcttacagagaccagatcacgataacttaagagagaagatgttccagctcatgtaacaaccacactggcagctgagttggctccaggattatcctggatcagcttctttttcttgttgctcctcaatcctttggtccctggctgcatggccaggaggaagaggggaagaggaagtgaagggagagcaggtttcttttaaggatgtgatgtaaacgtttctcgcatcggttctaaatcataccccttcagccaaaactttgtcacacagtgaaacgttgctgcaagggaggtggggaaatgcaatcttttttttctttaaataataaatgggctttgttttttatttttatagattgagggggcccaagtgcagatagcttatacacatgtattacgtagtggtgaagtctgggcttttagtgtacccattacccgcataacgaacattgtaccccacaggtaatttttcaaccctcacctactctttttttttttttttttttgagacagagtctcgctctgtcacttaggctggagtgcagtggcgcaatcctggctcactgcagcctctgtctcccaggttcaagggattctcttgcctcagcctcctgagtaactgggaccataggcacatgccaccatgcccggctgatttttgtatttttagtagagacagggtctcaccatattggccaggctgctctcgaactcctgacctcaggtgatccacccacctcagcctcccaaagtgctgggattactggtgtgagccaccacgcccagcctaaccctcaaccactcttaacctcctaccttttgtattctccagtgtctattattccacaccgtatgcctgcatgtacccattgtttagctcccagaaatgcagtctttagctgactagttgactatgtcgtgaaactcagaagggtcatttattaaaaggaagagggaaagaacgggtgatgggggacaatgagcagactttaccacatcacccttagaggattatgattctttcagaaatagatgtacttgctcatctgttgtgctcaggctcaaacatgaaaatgcacatctcttccatgagtgcatggataggcagctccaagaggtaagccaggagcagaaaatactaggaagacagctcgagacaaacagctccctgcaagaaatctagcaagtggaaactccgcaaatggaccagtgcacacaggctgcctcttacctgtactgcagtactcctctcccagtggaagggagtgagttatcttcttctggaaagataaccttctttggtcttgggtaagggttactcacgccaaggagattttctggggtaggcaggaaatgaaagagcccagggacccaacagtggtatagtgaaagccatggccacagcagcaacgagggagtaactgagggataatttgaaggatagacagagaaataacaattcttgttataaccgaggtgcagtccagcgagtcttcctggaagaggcaggatgaatattgatctgcactctaacatggatttctctgcctgctggctaggtaggcggcagtgtgctgggaaatgtgttccagtttaagttgttgctggaacagagtgagaatggggcctgccttcacaagaggatgggatttttccaacccctggatggcttccccagctgcgtggtgaccagtggcgtggtcaacttcttcctggcccacacggagcgactccaaagagttggctttgatccccgcctgcaacgagtggctcactcaggtgggaaggctgaaagagtgagggagggagctgggctgggaattagctgcagaagtttgttctttccaagggctgtacccggctggctgatcatagtcgcttgcccagtagcagtacatccctttcccctttcccctttctccccagactagggagctcttgatctctcttacctccctcctcacgtctctttgacttctgtgtctcctgtaggctgcccttcttttccttccccttcctttccctacagctctgtcttcttcctcctttcccatgctgcttcatattctattttttcagaaatcctttcctattaactgctctctctttccctcttactccatcagccctggagtccgcagttctgtccagtttgaaagccaatctgtgccactctgcctctgtgcccatatctctgcctgagaaatgagcttatttatttccttccaactcatcagcagggacaggctcctagagttaagggtgtggcttcacgtggggctgaacctccccagtgtatgaactgtgtcctctccctgggactctcccccaccagacctagaatagtgcccacttttctgaccgcagctcccacttccttctgctctccctctctttgcagaattcttcattgatgggctagggaccctactcgtggggtcatgcccagaagtgattataggtcaccagtctcggtctccagtggtggactcagaactggctgccctagagaagacctacaatacataccggtccaacaccctcacccgggtccagttcaagctggccctccactacttcaagaaccatctccaatgtgccgcataaaggtgtgagggcataggagaaacactaggctggctggttatggtatctatagcaggccaccaaaaactggactcctgataggtgaacgttgtaccaaaccagctggtgggtagggaaaagggaaatggctcagttactggaagtaccaatcaaaggtgaagggtcactggaaatgaaccagtcactgaccagggcaatggagactgtattaatagcaatgatgatttgtacaatgccctgccttttttgaagcatttgcatgggcagtatctcacatcatctcatctgatatcacacaaagatgacattggttggtgtcctcagtcaaaagaacagctgcctggtccttgatagttgtttggtggaaattctgtcacagtcagaagcatcggatccagcatcactgtcatccctacatttttattaggttctatcttgtagactcaaaaaatgtgaacattccagggtccttgccttgaggaggtttgcagcctggttcagttcagtccaatcacagaattaggcagccggggtcagaggatcagagaagggaaggggtcaccaggtcccaggtggtggaggaagactccgtggagtgaacttgttaggagcctgaaagcagacattcaggcatcagagagggtaggagggccctggggccatcccactgtccaccagaacaaaggctgccctggcatcagactcactccagacctgttccagaatgccagggattgaactcagagcccatgccaaggcatgatggtgaacagacagtgtgagtgtggtgacaagccactaaactccagggacctgaggccagttgctggtcactcaaaactcatgtcatttacagagtggttccatcactctgttgttggataagcctctttctgttgcctgggggttggcagattgccgagaccagcttggtcatggagaccctaacccagtggtgctagaggaattaaagacacacacatagaaatatagagtgtggagtgggaaatcaggggactcacagacttcagagctgagagccctgaacggagtttgacccacatatttattgacagcaagccagtgataagcattgtttctatagattatagataaactaaaagtattccttacaggaaacaaagggatgggccgaaacaaagggatgggctctggctagttatctgcagcaggaacatgtccttaaagcacagatagctcatactattatttgtggcttaggaatgctttaagcggttttccaccctgggtgggccaggtgttccttgcccttattctgataaacccacaaccttcagtttgggcatcatggccatcatgaacatgtcacagtactgcagagattttgtttatggccagttttggggccagtttatggccagatttgggggcctgttcccaacacgttcccctttttgttttccaaagtgataaaagcaaaggcagctttgtcatggtgagctaattctcacaggagtcaggatccgcacctgcagactatacaaagacaaacaacacagattaaaagcacaatcatcattgaaatcacagagcttccaagtgtctttatccactttaatgggttaatatctgctaatctgtctgcagctccttcaagcactccagttcctggcattaaggtcaagtgtgcctgggatgctttaaatatttgttcttttaattttgcaatatgcaaagacaagtttgtagagtgtccttctagatgcttttttattctttcccaaattttgatcttattaacagacattaatagtttccacaaatccttatgtttagcttctacagtggaccatatcatttgaggttgaggtgccactataccgccacgtttccagataatgggaactcttgctgtatttcttaccatttctaccatctgactgttttgtttagaccagctgaacatagtgtggctgtggcacacagactgagaggtgtaatttaagctaaacatccccttaggggaccaatcaataatgattccataggaatcgttgcgcagcacctctacctgttctgcaatgcaatcttcccaaacaagtacattcattatttctggccaggtctaattctatttacaaataggttttgagctgcctttgctttgcctcaattataggagcagatttattatggtaaatattaagagcagaaagcatgtgtaactgtgtcacacagtgattacatccaggcattattgccagccaagattgataaatatgcccaataagtataactgttctctgtgttgttccttgttgaaggaatactcatggcaatggtgatcaccactatcatatctatcattaaattactcattgtgactggttgtcccactttcctcaggttttcttccaccatctgtgacagcttcttgatctgtccccaggtaggtggctgtgttcgacagctgttgctcatgatagttggggtcctcctcagcatcagtcttgacatggctgcaaccaggggatcctcgggatcctcctggaatctcttcctcagcatctggctcgtggcaaggtttcaggtgtcttgatggcacccaaattggctattgattcggtcctggagaaacacaagcataacctctaccccaagttattattttacctatttcccaactttttgttattggatctctccaccaaaccagttgttctgcttctgtctttgcagctggtttctgtagatgctgttcagctgctggcctttaagcaggctcaaaaaatttaaagtcaataatgctagaatcaattgcatatggggtgtcccgtagtccctgcttctccccttttgcttttgcaactgctgtttcagggagagattcattctttctactatggcttgtccttgagaattatatgggatgccagtaatgtgtttaatattccatatagagaaaaatgtagctagagcttggctagtatagcctggggcattatctgttttaatagaagctggaatgcccatcaccgcaaaacactgcaaaaggtgacgtttaacacaggcagaagactctcctgattggcatgtagcccagacaaagtgagaaaaggtgtccacacatacatgtacataagctagtctcccaaacgagggaacatgtgtgacatccatttgccaaagagaattaggttccaatccttgaggattaactcctcctgtaaaagatgaggaatgcaccatttggcaagttgggcatcgctggataatagctttagcttctttccaggtaatgccgtatctgtgtttgagaccagaggcattaacataggttaaattgtgaaagtgtctagcgttagatattgcattagcaactaggtgatcagccatttgattcccttcagttaaaggtcctggaagaggtgtatgagccctaatgtgagtgatgtaaaaaggatgcattctactcctgactgctgtttgcaattgggtaaataaagccatcagttgctcatctgtgtggaatcgtagttgagcattttcaattaattgtgtggaatgaatcatgtatgaagaatcagaaatcacattgataggcctattaaaagcagtcaatacctcaattacagctataagctctgctttttgaactgaagtatagggcatctgaagcccttacttttcaagccagagttagaagctttaccattactagacccatctgtgaagacattttcagcaccttcaagtggtttgaatttagttattttagggagaatccaattagttaatttcaaaaattgaaacaattttgttttgggaaaatgattatcaagaatacccacaaagtcagctaaatgggtttgccaggtaagactatttataaaagcttgctctatttgtgccttcatgagagggacaataatttttccaggaccatatccatgtaatttaacaatctgagttctcccatttcctatcatagtagcgatttgatccaaataaggagttagagtccgtgaattagtatgtggaagaaaaagccgctctacaagatcttgctcttgaacaataacaccagtaggtgaatgccgagttgaaaaaattagcaaatctagagtcttttctggatctattatatttatttgacttgctttttgatgagctgcagctctgcatcagcttcttttgttaattgccgagggctatgagactagcatctcctctaaggttagaaaatggcataggtaggaatgcctagagtaggtcatatccaattaatgtcccctggtaatttttgaaagtcatttaatgttttcagttgatccctacatatggttactttctgtggcacaatgatagtgtcatttactgaagtctccaagtaggagtaaggagtagcagtctgaattttgtcaggagctataattaaaccagcatgagaaatcaaattttgcaagtgatcataacattggagtaatatttctcgagtggggggcagcacaaagtatatcgtccatataatgaataatgtaacactgtgaaaattttttatgagtaggttcaattgtttgccctacataagtctggcaaattgttggactgtttaacatgccttgtggcaacagtttccagtgaaaatgcttagcaggctgcaggttgtttactgcaggaattgtaaatgcaaaccattcacagtcctgctcagctaaggggatagtaaagaaacagtcttttaaatctatgactattaaaggccaattctttggaatcatagcaggagaaggcagtcctggctgcaatgtccccataggttgtataactgaattaatggctcttaagtcagttaacagtctccatgtacctgattttttcttaattataaaaactggagagttccaaggggaaaatgttggagctatgtgtcctttttctaattgttcagtaactaagtcctcttagcctccagtttctctttacttagcagtcattgttctatccaaattggctcatctgttaaccattttaaaggtataggttctggaagcttaacaatggctgccatcaaaaatgatatcctaaaccttggcaggaactttgtctttccgcttgaagtggttccttcaaatcttgcaaattttttcctagtcccataccagggacataccccatttcatgcaccatacgttgactttgagggctatacaattgctctagaattagaacttgtgctatccattgttgtaacaaatctctttcccataaatgtataggtacagaagttataattggttgaatagtcccaggttgtccatcgggcccctcacaatgcaaaatataattactttgatatacttcaggggctttaccaactccaactatgttaaattgagtgggttgaatttgccacgtggacagccagtgctgtagagaaatgattgaaatgtctgctcctgtatctaccaaacctttaaatttctttccctgaatagttatttcacaggtaggatgtttatcagtaatttgattcacccaataagctgctttgtcttgtttatttgtgcttccaaattctcctattcgtttaatttcacttttccccatttccacatacggcacaatcagaagttgtgctatacgctttcctggctctgctttccaaggaaaagaagtaaatataacaatttgaatttccccattgtaatctgaatcaatgactcctgtatgtacttgcactccttttaaatttaaactagatctacctagaagtaatcctatcatccccccggcaagcatccacagacccctattggaactttttgtggggattccccaagcataaggctcacagcttttgtgcagtataaatctactgtggcactactggctgtcgtgggggacagacattgtacaggggtgagggagtgagctataatatttccctgttgatctggggggtatatcctaacagggaactgccaagcctctatatcaccctctcgtctagctggctcaattcctgcctgaatagaactgagagcagtcactcgaggcactgctagaacagtcactggggcaactacttttcacccagtgtcctctggaaaagaaagatctgtagggtcaggtcactctttttcttcaaaataatgagggggtgaagaagagtagggacaaacctcttcctcatttgccgctttagcttcagccagcaaacaaacctgctgtgtcatctcttctgttactttgttatactttccttccttctcatcattagtgtgaaaaggttctaaggtggaacgcaccagagcccacacttgtcccattgttaccctgatgtttccgagctccccttcttactcaccatggggattgcttaagggtactcgggtgtcctccagcttagttccacattctccaaccataactccagcgacccttcaactggggttcaagccccacgttgggcgccacttgccgacaccagctcggtcttggagaccctaacccagcggcgctagaggaattaaagacacacacacagaaatatagagtgtggagtgggaaatcaggggactcacagccttcagagctgaaagccccgaacagagtttgactcacatgtttattgacagcaagccagtgataagcattgtttctaaagattatagattaactaaaagtattccttatgggaaacaaagggatggactgaaacaaagggatgggctctggctagttatctgccacgtccttaaggcacagctcgctcatgctattgtttgtggcttaggaacaccttaagaggttttcccccctgggtgggacaggtgttccttgccctcattccagtaaatccacaaccttcagtgtgtgcatcatggccatcatgaacatgtcacagtgctgcagagattttatttatggccagtttatggccagatttgggggcctgttcccaacagcagattctatgaccacttcagccctgcctttacagtttctgtttacctgtaaactttttcttcctgtggcctagggtagttcaggatcactaaaaatgtgttctgtgatatattaataaaaattcctgaaaaatggacttacagcaaaattgattttggtactcaaataattttgaaaaatattgcatgctatgtctccttcttgtaaggttgcagttcacattagtgtagtaaagcctctgagaagacctgaagtaaggaaatctctttaactttgtttaattcagcatttctgaagtacagttagagacaagcagtcattttttattctcccaaaacagaactgagcacacacctcattcattgtatgtcataaagattatattgctataactttttttgtatagtaacatagctataggccaggcatggcggttcacacctgtaatcccagcacttttggaagccatggcaggaaacttgcttgagcctcaggagtttgaggccagcccaggcaacatagcaagaccccatctctagtaaaaaaaaaaaaaaaagacgaacataggcagcctttgattggaagaaaaaaataagataaacaagcatagatatataggaaaacaacattgcattgtcccatcccaatgcagtcccatatgactccccttagttccaagcaagaagagcacctacctggaccttgtgctctagagtaccttgcatgtcacaaacgtgcacttactgacaaagcccagggcatctctgtcacttaggatccagtgcttggcactagtacagcgtgactggtaaccctaaacatccgttcttgggactaatgctattcaggccccaggaaaatacttctatacttctccacatctcttgccttgtgtcatcaaaagacaattgcatccaaatgcaacgaaagtttgtggacagcgctttggagtactgataggattttggctgcaacgtgcttaggtaaaaggaaaagacaaattttaaaatttgccagattctgccgggcacagtggctcaagcctgtaatcccagcactttgggaggctgaggtgggtggatcatttgaattcaggagtttgagaccagcctggccaacatggttaaaaccctgtctctactaaaaatacaaaaattagtcgggtgtggtagcacatgcttgtaatccccagcgacttgggaggctgagacaggagaattgcttgaacccagaggcggaggttgcagtgagctgtgatcatgccacggctctccagcagcctgggcaacagagtgagaccctgtctcagaaaaaaagaaagaaaagaaagtgttggtcaggcacagtgggtcatgcctataatcccagcactttgggaggcagaggcgggaggatcacttaaacccaggagttcaagaccagcattggcaacatagtgagaccctgtctctatatttaaaactttttttaagtaaaaaaaaaaaaaaaaattaaagtcttgccatgaaaaaacgtcagctcaactaaaaccttgtgcttaggaattctgacacaagcccttatctcattgcaggctgacaacaaagagctcccagaccaggcctcagagcacactttgaatagaattgctttagattagtgatcagcaaacatttttgtaaaggactagatagtaaatatcttaagttttgtaatccacataaggtctctgttacatattcttttaaaaagataactctttaaaactgtaaaagccatactgagggcttaaggggccattcaaaaacaagccataggctgcatttagcccttggctgtagtttgctgctttacttaaaactgttcttagagtacaaattatgtgaacaatcttgattataaaagcataattagtgattttgttgaaataaaagcaagaaaattaaattatgtgggataaatatacgataatttacaaattatatatatgtgtatgtgtctttgtttttttgtttgtttttgagacagagtctcactctgttgcccaggctggagtgcagtgttgtgatcttggctcactgcaacatccgcctcccaagttcaagcaattctcatgcctcagtctctctagtagctgagattacaggcacccactaccatgcccagccaatttttgtattttttgtagaaaggaagtttcaccatgttgaccaggctcatcttgaactcctgatctcaagtgatctgcccaccttggcctcccaaagtgctggaattatagccgtgagccactgcacccagtcaagtggtggtttttttgaacaactaagagtaggcaacatatcaaagcaatggaatttatttatttgtttattattattattattattttgagacagagttttgctcttgtcacccagactggagtgcaatggcgcgatctcgactcactacaacctccgcctccgacattcaagcgattctcttgcctcagcctcctgagtagctgggattacaggcatgtgccaccacacccggctaattttgtatttttagtagagacagggtttctccatgttggtctcaaactcccgacctcaggtgatccgcccacctcagcctctcaaagtgctgggattacaggaatgagccaccatgcccagccaatttaattattattattatacataccttggtgttcagttgatggattgttgatgtttggacgagtaagaacaaatggctcagtgcggtggctcacacctgtaatcccagcagtttgggaggctgaggcgggctgatcacctgaggtcaggagttggaaaccagcctggccaacatggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1397 - DNA, 1566 bp, Homo sapiens
ggcggggcagtcggcggcctggctgctaggctccgtgacatccggcagtctgagggcggcgggattcgggatgacttcgggcggatattggtcataatcctggtacttggcattgttggatttatgttcggaagcatgttccttcaagcagtgttcagcagccccaagccagaactcccaagtcctgccccgggtgtccagaagctgaagcttctgcctgaggaacgtctcaggaacctcttttcctacgatggaatctggctgttcccgaaaaatcagtgcaaatgtgaagccaacaaagagcagggaggttacaactttcaggatgcctatggccagagcgacctcccagcggtgaaagcgaggagacaggctgaatttgaacactttcagaggagagaagggctgccccgcccactgcccctgctggtccagcccaacctcccctttgggtacccagtccacggagtggaggtgatgcccctgcacacggttcccatcccaggcctccagtttgaaggacccgatgcccccgtctatgaggtcaccctgacagcttctctggggacactgaacacccttgctgatgtcccagacagtgtggtgcagggcagaggccagaagcagctgatcatttctaccagtgaccggaagctgttgaagttcattcttcagcacgtgacatacaccagcacggggtaccagcaccagaaggtagacatagtgagtctggagtccaggtcctcagtggccaagtttccagtgaccatccgccatcctgtcatacccaagctatacgaccctggaccagagaggaagctcagaaacctggttaccattgctaccaagactttcctccgcccccacaagctcatgatcatgctccggagtattcgagagtattacccagacttgaccgtaatagtggctgatgacagccagaagcccctggaaattaaagacaaccacgtggagtattacactatgccctttgggaagggttggtttgctggtaggaacctggccatatctcaggtcaccaccaaatacgttctctgggtggacgatgattttctcttcaacgaggagaccaagattgaggtgctggtggatgtcctggagaaaacagaactggacgtggtaggcggcagtgtgctgggaaatgtgttccagtttaagttgttgctggaacagagtgagaatggggcctgccttcacaagaggatgggatttttccaacccctggatggcttccccagctgcgtggtgaccagtggcgtggtcaacttcttcctggcccacacggagcgactccaaagagttggctttgatccccgcctgcaacgagtggctcactcagaattcttcattgatgggctagggaccctactcgtggggtcatgcccagaagtgattataggtcaccagtctcggtctccagtggtggactcagaactggctgccctagagaagacctacaatacataccggtccaacaccctcacccgggtccagttcaagctggccctccactacttcaagaaccatctccaatgtgccgcataa

SEQ ID NO: 1398 - protein, 521 aa, Homo sapiens
GGAVGGLAARLRDIRQSEGGGIRDDFGRILVIILVLGIVGFMFGSMFLQAVFSSPKPELPSPAPGVQKLKLLPEERLRNLFSYDGIWLFPKNQCKCEANKEQGGYNFQDAYGQSDLPAVKARRQAEFEHFQRREGLPRPLPLLVQPNLPFGYPVHGVEVMPLHTVPIPGLQFEGPDAPVYEVTLTASLGTLNTLADVPDSVVQGRGQKQLIISTSDRKLLKFILQHVTYTSTGYQHQKVDIVSLESRSSVAKFPVTIRHPVIPKLYDPGPERKLRNLVTIATKTFLRPHKLMIMLRSIREYYPDLTVIVADDSQKPLEIKDNHVEYYTMPFGKGWFAGRNLAISQVTTKYVLWVDDDFLFNEETKIEVLVDVLEKTELDVVGGSVLGNVFQFKLLLEQSENGACLHKRMGFFQPLDGFPSCVVTSGVVNFFLAHTERLQRVGFDPRLQRVAHSEFFIDGLGTLLVGSCPEVIIGHQSRSPVVDSELAALEKTYNTYRSNTLTRVQFKLALHYFKNHLQCAA

SEQ ID NO: 1399 - DNA, 52256 bp, Mus musculus
  misc_feature (1)...(52256): n = A,T,C or G
agccattcagcaacttgacagccacccctccctcttcctcctcctctttccctcccccaaccccatctctctctttcacacacatacatacacacacaacacacacacacacacacacacacacacacatacacacacacgtttctgaatgttaaggcattttagcacagtcttccaaatccatgccgctggtgaagagacctttttcctcatatgtctatcttgggttaccccatcaagatccatgccaattccttcagcaaaaataaatagatccactctcttgatggatcagaacaccacctgagccactttatttatgggcaggagtcactttgaaaaccaccagtcaaccaagggactgccactcaaatagagacctgttgctcacccagatctgggctctgccaactctcctgctcttccctggagcctccacttcctcggcctcatccccatctcatcatctggcagaacctgtctggtttttaccataagtaacaggctgtcttctcacctccacaggctgatgaggtctacaaagagctgagctgcaggaagcctaaatgcagcagggatgtctgggtgctgagatctgatgatccccattcaaggggctccatgatagtcttggatacatcattagaacctcggaaggcaacacgagcttttctgaaccctgacacacttgctcaacttgttcctggcagagccagtgttcaaaccgagggctatctgctgaaaccatggtgttcttgccaccagcgctagtgatgaaccaagcgtgaccgtactcctcttggcaaaggctctgctgggggtggggtggagcagttagatctgggaacaaggaggatttgatcgtggcagagtagggttggcaaggctctgtaagtggctctgaaatgggctgtcagactgtggaaagtaccggctaacaactctgcaggcagctcctgtcaggagtaagcactgagattcactgggtcaaattaagtgagccgccattgccggttgcttaaacttagaagtgggcgcatgcctttaatcccagcacttgggaggcagaggcaggtgaatttctgagtttgaggccagtctggtctatggagtgagttccaggacagccagggctacacagagaaaccctgtctccaaaaacaaaacaaaacaaacttagaagtgaccttccaatatggtaagccaccaaaatctgcctgccatctaccttccgacgatcttagttcagagttgctctctgagatttctagcgaagaggcactcctgcgggctctaagctcagcctgcacagggagcagggccatatccgcctctccatttacccttggtatctggcctcggggaatactagtgtggcgtaaggaacacaggtttcaggcacttagtcagttttgttctctagctctgcagccttaggaaggtggttgtgctgtcgtcatcagcttccatttcttctgctacaacgtaaagatggtcctacgtctaccatagtagttattttctgtcgctgtgattaaataccatgagcaaagtaatggatagaaggaagggtttactgtggcttgcagttccagtggataagtcaccatcactgtggtgaagggagagcagggggcaggcaggcatggtggctggagcagcagaggacaagtcaccagcactgtggtgaagcaatggcacatggctttcgaaagcccactgctttcctcccagatcggtggtacattcccgcaggtctctatgtaaacgcttctgcatcagggtggcccactctaatccttcactccacaactctgcattactctggatgctgctggcctgttctgtgtgcttctgttctgagaccctcttagcatgtgagctcccagatctagccctttagagagtgccttaatcagggtttctattcctgcacaaatatcatgaccaagaagcaagttggagaggaaagggtttattcagcttatacttccatactgctgttcatcaccaagggaaataaggactggaactcaagcaggtcaggaagcaggagctgatgcagaggccatggagggatgttctttactggcttgcctcctctggcttgctcagcctgctctcttatagaacccaagactaccagcccagagatggtcccacccaccaggggcctttcctccttgatcactaattgagaaaatgccttacagttggatctcatggaggcatctccccaactgaagctcctttctctgtgataactccagcctgtgtcaagttgacaccccaaaccagctagtacagagagagtgtattgttaaattaattactaaagaacaggttaataaacgaagcctatgacctctaatctcttactttatgcctttttccccattttcaacttagtctactcctgactggaaggatttttggtttgttttgcctatcttaatgcacacatatgctgccggtgtgcaggtagtaggtggcgtcagccgcccagagctggagttagaatcagttgtgagccagaaccccacctccccactgtgggttctggaaatagaaccccactaagtggtgctttaaaaatatcagttacttagaataattctgtatgcaaggaaacaagttattgcacaatctgtgtaattaaatggaattttttcatcaatccaaagttttcaaaaagggcatctgcttctcttgctccagatttgtgtgtgtgtgtgtgcatatttgtgtgtgtgtgcgtatttgtgtgtgtgtgtatatttgtgtgtgtgtgcatatttgtgtgtgtgtatttgtgtgtgtgtatttgtgtgtgtgtgtatttgtgtgtgtgtgcgtatttgtgtgtgtgtgtgtgtgtgtgtgtgtgtgtattatcattggggagaaactttgccctgtaggctacgtgttctcaaacacttcaaagcctaaaacagcggatgaaatgctggccatattgagcctgaggtttgcagactcattccaccagagtctacagggtgggagccccagggattacagaacccctggaaaggcagcatgggctgacaggtttatgacattttctgtgtcttcagtgactgtttctcagtgttggtcaggctctcctttctcacagccaggatcacagtatgtgaaattacaggtgacaagggcaggcagggccctttaccgttctgccttgtggggtctggatcaccatcaaactttccatggtttaggaacagaagttctaaggctttgccaaatgcaaccacatgctcttgagctacgatttgaaagtgaccttgggacaagttaaactaaatggattttccctacatcacccagtcgcttgaaacacaaggggaatgagctcttggaaggagagactggagtggggagaaagttggggtaaagcaggggtcaaaggtcagaatcatcagtcccagatgttataaaccattcaggatctcctgtgacattcctacatccctacccggatgcagtcctccatctccagaacagaaccattcctgggctctcagcacttctgaatctggtttctagtaaaggtttatccatgtttcatggctccaacgtgtacttcagaagaccggaaagcaaggctgtattaggcagacctcaggagctaggctctccagaatcgctgtgcctgccacacacagacttgactctcagccgccattgctggggtttttctggcttacacagtgaaggtccagtccatcatggtagtgaaggcatagaactaaataaaaacgggtttgagtgacagatacatttagaggtataggtggtcagaaggcatctttactgcaggagttctccttctgagggcataggacaggcagcgattctcaatgtgagaacgcctctgcttttttactttattatcattttaaagtttttatgattgtgtagtacatgatgtataggtaggtagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgatttaagatgaagtttccagaggacagactgaggcttcctgaggcttctcactgcccagttccgtgtcttgcctgctggtgcactgacagaggtcgctgggacctctgtggaactgaaccgctgttaattgtgagccagaaagactagccttggagctgtgtgtatatgccagtgccgatcactaactttgtctgtccctgtggcgtgtagacgaacgacttgagacatgcagaagaaatgctgtttttctttcttctttactcctcagttggatagactttaattgcttaatttaaaatggaagtttaaaattttgtaagactttgggctggagagttgactcagtggtctcgcaagggacctggcttccattcccagcacccacatgcagaggctcactacttccttaggcaccaggcatgcatgtggtgcacagacatacattcaggcaaagcacacaaatgcacaaataaaataatgtcaaaaaacaaacaaaaaacaaaaacaaacaaacaaacaaaaacaaaaaaccaccaggtagtggagcctttaatcccagcattctggaggtagaggcaggtggatatttgtaagttcaaggctagtctgatctacagagtgagttccaggatagccagtgctattacacagagaaaccctatcccaaaaaactgaaacaaaaatttttttttgtaaaaactttacataatacaactgtttataagattaaaaaggaagtctctagtgagatgtgtaacattctagatctttctatttgcatatataaataataaagttttcccgactgttcagtagttgaaggaatggctgaaaagagtgtatggcatatggagaagagagtaaggcatgctgctacaacctgttagactccacaacggtccacggacggcctctcatgtcagcactcggatctgaactagattcttaaaaatatgtattgacttacctaggtatttattctgtgtgcatgtgtgtgagtatgtctgtgcatgagtatatgcacatgtatgagtgtgcgtgcatgtgtgtgaatatgtgcacatgtatgtgaatgtgcatgtatgtgcatgtgtgtgtacacatgtgtgtgagtgtgcatgtgtgtgagagtgcatgtatgtgagtgtgcatgtatgtgcatgtgtgtgtgtgagtgggtacacatgtgtgtgagcgtgcatgtgtgtgagcatgcatgtatgtgagtgtgcatgtatgtgcatgtgtgtgtgtgagagtgggtacacatgtgtgtgagcgtgcatgtgtgtgagcgtgcatgtatgtgagtgtgcatgtatgtgcatgtgtgtgtgtgagtgggtacacatgtgtgtgagcgtgcatgtgagtgtgcatgtatgtgcatgtgtgtgtttgagtgggtacacatgtgtgtgagcatgcatgtgtgtgagcgtgcatgtgtgtgagcatgcatgtatgtgagtgtgcatgtatgtgcatgtgtgtgtgtgtgtgtgtgagtgggtgcacatgtgtgtgagcgtgcatgtgtgtgagcatgcatgtgtgtgagcgtgcattgtgtgagcgtgcatgtatgtgagtgtgcatgtatgtgcatgtgtgtgcgtgtgtgtgagtgggtgcatatgtgtgtgagtgtgcatgtgtgtgaatatgtacacatgtatgtgagtgtgcatgtatgtgcatgtatgtgtgtgagtgggtgcacatgtgtttgagcgtgcatgtatgtgagtgtgcatgtatgtgcatgtgtgtgcgcgtgtgtgtgagtgggtggacatgtgtgtgagcatgcatgtgtgtgggcacgtgcatgagtgtgggtgtgccacagcacacataaggaagtgagagaacaaccttttgggagatggttgtctcctttcaccctgtggatcctaggaatcaaactcaggtcatcaggcttggtggcaagagaccttacccacctagccatctcatggctgcaacatgtcttcctgtctgttgttatgcatgatttgtgcttctaatcataatttaaggttaatcttaattgttaattgatgggatttagagtcaactaagagatacatctctgaacgtgtttatgagagtagttccagggtgtttagttcctcaccttgtgagggcctccatgcactggctggggtcctgcactgaatataaaggagaaacccctagaggaccagcatccatctctctctgcttcctgacagccgatgccgtgtgacctcatgctccaactgccgtgccttccccatggtgaactgtaccatcaaatggtgagccacaatgagcctctttaagctgcttctgtcaagtatttatcacagcaacaaggaaagcaggaaagtaatgcactaaggttcgtctcgataacgactttaattcctatatttatgtctgtagtttattttgaactgatattttaatattagtcttgctaaccatagcctgtgatcctcctgtccagccttccaagaactgtgattataggcatgtccacttgaactaattattttttattatagttagttattcatttattttttaaagatctatttatttattttattatacatgtgagtacactaccactctcttcaaacgtatcagaagagggcatcagatcccattacagatggttgtgagccaccatgtggttgctgggactctggaagggcagtcaatactcttaaccagtataccatctctccaacccctatttattcatttattgtgtgtgttatttgtgtatgtgtgcatgtgtctggtgggaacatggcagggtgtacacaggcacatgtggagtcagaggttgacactgtcttcctcacctttccatcttagtctttttagaaagagtctctcactgaacccagatctcatcgcattggctacactgttggcttgcaagcccctgagatccaccactcccagccctagatttacatgtgtgtgtcacccggtctggtttttacataggttctgaggattcacgttagagcaccttactgagccttctgtctatctccttgtcttagttagggttttactgttgtgagcagacacaataaccaaggcaagtcttataagaacaacatttaattggggctgacttacaagttcagaggttcagtccattatcatcaaggtgggagcatggtagcatccaggcaggcatggtgcaggaggaactgagagttctacatcttcatctgaaggctgctaggagaatactggcttccaggcagctaggatgagggtcttaagcccatgcccacagtgacacacctactccaacaaggtcacacatcctaatcgtgccactcctcgggccaagcatattcaaaccccaaactcctgaactaattcttatgagtaggataaagtaagaaagggttcatctttgtttctgttttgtatgttgaagttccatcttttttctagcaccacttggtacaaagactttcacaatttttttttctatgctagagtgctctgccactgaggtatatttccatcctagattctttttcaatgattgcataccatgggctattgtttccattctgaggaacaatgtatattcttgaacctagaccactgagcagttggctgtttctgacagttcctcagtcaggtgatacctgtgtttaacaggagttattctccagccaacattcctacctgaaacctataagaggcaggctctgattggcttcgttgatgtgagcctttctcaaatgctaggtgacttccttatggacacagagcctcaattcctagattctgcaggagtccgtccttctaggagggtctgaataagatgattatttctgccttggttagttgggatatcaccattaaaaagaggctcataaaatacactggaaattccctaagaattccttaaagagttcaggcttgtaggcacgtctctgtggggccccaaagggcagctgttctggtggtgactgcatcatctttttatcaatcatatcagttagctatttctgcatctttttctggcacatgagtgacacacacacctggcggtgtaaggtatttgggtgggtatctttgtacccaccatccacagctctgtggattccatgatgctgtctctaagttcaagtttgagtacaattcattccacactatctcttttaacctttccaacaaccctgcagagggaattctctctgtctctcagatgatacagcaaaggcgtacgggggtcagacaatttgtcttctgccacttggagctggatcagggccaagtctaattctgagctgcagagtgtggtatcgtcatactctctgccccagcctcaattcaccttgcctaagaggagcaccaggactcaccagatctgtgaaaccttcccaatgagtctcttacataaattaaagctaatcaaacaactctatggagtagaattttaattgcctgatttttttaaagctaatgatcactataagagtctttacaaactcttttaagaatatttttgggtttttaacttaattttacaattatgtctatggggggctagggtatgggggtggggtacgttcacatgagtgcaggtgctctggagaccagacacatcagatcttctgagcgggagccacaggcagttgtgagctacacagcacgggtgctgggactaaacttttgcctggacatgctcctaactgccaagacatctccagcccctggaattatttttgtctcaggagattttgtctaacggagattaagttgatgatgctgttgctccgagaaaaatcccatattgaatggtccactcgaatgtgcttttactgctcccatctgctttcttttgcatgaggttaaagggttgcagtttctgggggtgggggtggaggtgggggtgggggctggaagtaggggatcttttcatagcaacagctgtttggaattgcaagttccccagcagaaagtcccagctcgacttgcacttttttctggtgggtgagactgtcccaagccaggagcttgtcctccgggagggcagtttataccagagacttgattagtgctagggcaggacacctgtgttccaagtctactgctgatggtgggtaatagagcaagagacccatctgcccttgagggtggtgacaggtaaacttcggagacttggctgtcctctttctcatctgttccatagctgcttaccttagtctcaaaaaaaaaaaaaattctgacatcttaattttaatgtgggcatttgacccagtgcctgagataaatataaccctgtggagtacagagaaggtttnnnnnnnnnnnnnnnnnnnnagagagagggagggagagagagagagagagagagagagagagagagagagagagagagagagagagagagctggcagtcaggacaaagctgagctaggagaggctcccagcagccttgccctctgacttgatattaaccagacctggccagcatggtggtcctgaatccaatgactttgggaatttatctccaactcttcttctgctccatcgtgtctcagccaactttcatcaacagtgtggtcccaatctcagcaggtaactgatgaccgagactttcctcgcttccgtctgcaggggcagaaggggggtgggggactcaagatggtcttgcaatatgtcctgatctttttgccaatctgctgttagcagaggaaggctctggggcgatggtctgtcccccaaggtgcttcctgtcacccgagcttgtctccaaaggcccttctgtcctccttccaaccgtcactactcagctgctcaaagccagactctgagccgttgcttctgtgtccctgtctctgctgctcatttactgcatgaatcattttggtcagggaattgggagctggggatggaaaagtctaagttctagagaagtgagaacttctgtaaggtgtttctataaatctgtctctaacctcctccctgtgtggcgtacctcaggatgctgtgaagcaaatattgctctgtcaaccttgctgaagggcaggggattctgcctggccactgtcagcagggcttgctgtttcctcagccctggttgctctcgtgttgggctctcttctcttcagctctgacaacccatctagaggtgctaaaggaatgatgagggcttccagagggtcagtggacctggaaccagatgtgtcttgcttgctgagtgcagggctgggagattgaagaagccttgcctagttggccagccaggcaacattttctgcaggcaccaccgggctgttgcccttgtcctgcctgacctggtacaggggaagtattgggttactgacatagccttttcaaacctttctgaggaaatctaaatatctccagagggtctgaggaagcaagcagaccccagggcttgctacttccttcacaccctcctcagttcatctcagcccctgctctaaggcacccttagtccttattttctaagcaccgaagctgattctgtgtctttgcctatgaaacccagagagagcatttctccagactcaccacccacctctctccattcataaaaaacagctcccgggcaagccgtgctgccaaactgcaggccctaagggagtggcagggagattgctgtgaggctaattataaaagtgtgagaaacagaagaagcagggaagagacatgaagaagagagagccagagagagtaccaggggaggcagaagaagcaggtggttgtatcgccaagagtgtgtgtcagcagcacgtctctcacgaggtcatctagtctgagggtcattattctctgacccactgggaagtttggtagccgagcacggtgtcacccgcctgggactgttcttgggacgctgaggcagggtggtgtgtttaagactgacctgggttacatagtgagcccctgtttcaaaaatcccaacaggacttggtagctaatttggtctgacctagtgtatgcttctgtgttatatttgggttatagatttctttgggaatctgctgaagactcgaaagaattagggaaacttgcttctctggtttcagctctgcctctaatgagcagtccgacttcctggagaccattgggtatagaccgtgcgtgcaccatgggggcagggatcgtgtcatcttgtgtgcctgtcactctagatgtttccagtgtcagacagtgctggatctgtagatgctcagtagctacttcttgagtaaaagaacaaaaaaaacctttgcatctgtagagtgtgtgtgggtgggcggggcatccacatgctcgctcaggagagaacctgcacgatgtagacctctcttagagaagggtttttgaaggtcgtactggtctgggcaccacagtgacaggatgcagcttagatgtgcccaatgtaaagacttgagtgaagggctcactttcagaggcgcggggtcaaggacaactgtgatgtcgagggacacagggatttctgactggagaaagactttacccctctatgcttgagaaggcgggaaaaggaagtgggggaaaatagatcccccgagccttggtggcctgcaggagaggactgcaagcataagtgatgtcacacagggacccagagcagggaggcgggaactctccgacctctttcctcccatcacaaccacctattgtagagcctcccactggccaaacccaaccccaagccaaagccttgtagtatggagctccttgaagcagaccgtgggatcgatgggtaggcctcccgtgtactggggtttcctgttcatgggactagggccttgaacaagtcatgcaagtacttcatcacagagctacaccccagccacacaaggccctctagatgcatcactaaccctggatctggtgattgggaatgtaggctttgggcatttggccaaacagtggggtcaaccagagaaaccattaccagtctggggtttcctgtgggagtcacttcactttgtccccacatccaaaagcatcatctgaaatgaattcaggccttggaatgaagctgttccctgagtcaggaccataggggtcctttaaatacttaccaacaatctgattccatctgacctcctctactctaagctttgtggattctcaccattttgaagaaggtaagccgtgcagatgccgaaacacagccaccaggaaaaccatttctcacagcctactggaccttaagagagtctgctgtgtgcctgactgtgtgtgcctggcggggtataaagtgcttcagggtttcgctggggcaagtaggatgcagcccctgttctggaggattgtgctggctcggagtcctccaggattttggtggagcaaggtctctaaaaggcatgcaggaagagcttgcccacatggggggtgggcacaacatggaacaggggggaacagatgtgggggatggcccttccttttcttcaggaaggaccccactcctgaaccaccagtagcccccacctctgactcaggtgtatattacctgacagcctccagggcagcagaggagagagcctggcagggagcagaaagcaccaaagaggccaaacttgtgacgtaatatggtaaagaactgtggaatgattttgagaccacaaagagtggctgaggggaatgagaggaactgtttctcgccatgatgatcactaacggtccagtgaacactgaagaactgttgagcttccaaaggtagcaaagtgacagatacaactcagaacggtttctggtaaaagtgccaggagcttagagtgcctcgccgtagccgttcgctggggaataaacttaccctccaacacttaaagctagaatcatttattgctgaagttcatgttctgtgggtcacctaaaggtcacctcatctgatatgctatgggctgaccctgtctgcgctctgtctgggtctatagcccgacttggtgctggtgtccacttatggttagaattcaatagttgcggcttctagaaggataaaacatagacccataggcaatatttctggaggaacagatgtatgtgatgtatgtgatagtcacacacctggggtgggagtggagcaacactcttgcttctttgaaaaagattcctaggcacagagagattagttagataactcacccaaggccacatagctgggttgtgggagatctggagactggaatcctggctctaagtccagggcttctagcaatgtaaacggaatctgcttcaggcctggataaatgtataagtggacttttcagaactgcaaggccgccctccatctatggaaactctcctctatgttcttcatcgtcccttccctcccaccttgtcctctagtggtcagtacccagagttgcaacaaacaattgaatactgacttaggtggttattactgctgttggcttttgatctccttaaattgtccatgcagccttgaactcactacccagcacagagtggcctaggtatgtcaccaccctatcttagccttcttgcccatgtgctaggattccagacacacccctctatgctcagctcggcattgctgcataagtgtgtgcatgacttccccagccacggcttgatctcgctgatatttttgttactgggaacctaaaagtcagaatgagtcagggtgttttggaggatgggaacctccttgtaaccaaggcaacttccacaaaccttttcaggcccgtgagccatcctaccctctgcctacatggacatatgttcctcttccataaagcgtttcccagccaggcaggaaggcaagcaggaactctccagagcaattgtggatccaaatttcagaatccagatcaggaatagacacaaatctgtcacagtagagtgtggccacacggaaggatgtgattctgtgtgggtgctggaatcctcgctgttacttctgtggtctatacaatgtccagctatatacaccctgctgcctggaagtcagccagaccaccatttggggaccgtccagatttttggcactagatcacaggtcatttatctgtgtctgatgctgatcagctattgtttaatgtcccataatgcacttgcaagccatctcctctcatttagcttcccatatttcctctcgataataatatcagagagcgttcttaagttacagggctctctaggaggtctcaggcatctgccacccccatcccaaacctctatagaagcaggggccttctcactccccagctctataaaaacatgtctgccctgggaggtggaaggctctcctttggctatcctgacctccccctctacccctctccattacctttcgggatacccaggcctgccttcctctggtgcataatcacacaaagcaacagaactgctttggagactgagagtctctgacttccatgtgacacacaagatgctggtgactggccttccttaagtgcttctaatgcccatgagtactgcccatgactgttaccaatgcccatgtcccagacctctctattacagagttctccgagagctacaacagtacctgctctttacagcatcccccacagtgaagggtcctgggtttgagctctgaccatcatggttatgaactgagctgtgatgggagtggacttcactggggtgagcctcaaattcctgtctgtaaaatgggcagagcagtctctgtcccacagacatactctgggagaatgtattcattcaactaaattccagtgagagtcaaccatgtgcctacacagacacaattatcccacccaaaggaagcttctgtcagccatctgtgagaacttctcctggatgacttgctggtcactgctcgtcactgctggtgactgccttcatgctttggaccatggagagaacagggttaaattgctttaattgataatgattaaaatgtggatggttttatattttaatatatgtctggcatcttttcaaaacaaatctcttgggatgctgaccgacctggtagtcctgatccctccttttgggatggcacatcgaccatgtgtagaatctgctcccgatcatccagagtctccatttcctcctgcctcacacctgcctcacacctgccttgcacctgcctcacacctgcctcttacctgcctcacacctgcctcgcacctgcctcacacctgcttcattcttttaattatatctgcttctttgggcccctctgggcatgtgactgtaagccccggagctagaagcccagctggcctttccctccctttgcagcctccagcttttctaggtttccaaaggtctgcacagctgaactggagggcagcagtccacagcagtaacccccataacatagtctaggctgggttctaggtgctaagtcccctagcatgggcagcatttcaagttcccctggtgatcagaaggtttagctgttgctaaccattgtactatacccaaaatcagaatcagtgaggggctcgctaaaacaaaggccccggaaccctctaagaggtccttattctgagggttctagagtgggcctaagcacctgcatctctgcaatgcttcaggtgcctccaggctccaggcccacagtccacactttgaaaaccactgctgtagctcactgcaaagttacttcattatcttcctgtgaacatgaaccacctccaactttccaacagttccagaggaccacagtctgaaataatttcccctgggtgggggccaagggcccaagggagacttagttccctcatcttttctagatctaagctgtgcttctcagattctttggttcccagctttctctcctgtgtccacacacagccatgctacatatcgcttctcaagcccccttatcagtctgttgtgtttgtttgtggtgtgaatccaggggcttgtacattttaggcaagcactttaacatggagcgacatccccagcctctgcctggctcttagaaggacacttgcgattacatttaggaacccagataagccaggattgtttcctcattttaagtgtcttagttacccacaatgccccattcacacagaagatagcatttacaaccaccaaagctcagctctagataccaataggagccgtttggtggaccacacttacctcatgctttgtttagatgctatgggatttgaagcagacaggagtgtggctaccagcagttcatcagatctcaaaaaaccccaaagagaccaccaggaaccacaactctgatgcaagtacatgagagtctttattcaggctgttgagcctgggccacaaacctttctgatgatggagcaagataggagggcagcccccaggtctaggggaaaggggtttacacaggaaaaaaacacaggtgggggtttccaagcctcggtgttacatgagagggtaaaggagcactggcctttaagctaactggtttacagcacctggttaaatggcagggagggagcacacatcaaaagggagcacctggacctgggaacgacttaggttttcttagcccactctggtgttatcagccagctgcagatgcttgtctattttgcaactgccagggacatttcatgctttttctcagacctcaagggtggggcccatgcctctctcagggcaagttaacttagaatggagtcttaaaagcaaaatggagtttattctgctacctcagtctcttcaccgtgaagaaaatgaaacttgatgtccctgtgaggtgttttcctgaactagtcaccacatgggtcactgggtttcaatactactgggcatcccaggaagacagggatctgggatagttacaagccaagtcttggggaccaagctttctcttctcctgtgacatcaggagtaacacttccaacactctgctccctggggtttcggtttttatagtggtgtgactataggctaattgctctcatggggctaaaaggatctaagccacaaacacttggtcaggattgaggaggattgttgtgaacatttcagtgccggtcactaccatttgttgcacccaaccaaaaactgaaataactttttgcttaaaacacttagtgaattaaagcaagaagttcatatttctaccactttttgtttgcaaactaggccttaaggaaagctggtgctgggcagctaatcaggcaagaaggctctccttccctagtgacgggcttcccctgatgtcttaaaaatataccctggcacttgtccatgtgtgagccccaggcatttcccgattcacatccatgctcatctccccatggcaaccaatgaaaacatggggggagctgcttgtttgagagctgggaacagctgaaggaagctggtggctggtgtggtctttcagtcaactgctgggataaggactgaaaagaggaaagagcatgaatgaaccgcgcaagcccctccctttccggcctcccccttctgcctccccgtttggacttccctgcaccctcctctgctcatccctcagctgtcttcttttgaagagtttgggaacccccccccccatcagctgtcttcttgcttcagggacttccctctgggactcgtgctcctgggaggcctgcccaacttcaggcagagggtaaaactcagagataggtgaccacagccatcctacttacagaaacctgcgtactcaactggagcacccctgttgggtctaccctagttcagaccagcggtgaacgtgtgccttatgtgaagagcctgcagggtttcactgtcgggagaggtcaaagctggttggtgtaccactttgtgtccatacagggccaatcttccaccagcatctttattagggtagatctcatggcggtccctagaagcttccagatgccccatgatcagacagaaaccaaagtctcaacatggagagctaatgtttggaggggtaaagactccgggatctggaaggcagcagggccttgtgagaaccatattgggttggctgacatactccctcactagtgggatttctgtgggaagcagcagtaaactgcctgagttggctcaaggagagagtcaggcccagtggatgaagtaatggacagttctcagaggaggcaagaatggccaatgaatatatggaaaaatgttccacatccttagccatcagggacaagctaatcaaagctgcgctgattctttcatcctagtcagaatggctgtcctgggataacaagctgggcatggtgacctgcccctgtgatccagcaccagggaggctgaggcaggaggactgcaatgaattggaggccaacctgggctacagactgagaccttacctcaaagaactgaaaaggaaaaggaagcaaatgctgccacgggtcgggcggggggggggggggtgtggaatcctacatacaggtggcagcaaagcaaaactcatgaagctttggacagtgtggagagcttcagcaaacaggagagagccactgtgcggcccggctgcaccactcctgagcccacccagaaggactccgtgtcagcgctcttcagagatgccagcacacccgtgtttattatagccctagtcacagaggccaagatatggaagctggctagatgtccatctacagatgcaaggataaggaaaaggtggcgggtaaacacagtggggtgtttcctcagctgcaaagaacaaaattacaccattttcaggaaaccgcaactggagatcatcgtgtgaagcaaaataaactagatttagacaaatatcatgtttctctcataaaaggactctagacactatttataaatgcagagatatatctatttataattatgtgtataattattaaaacatttattgtacacatatgtctatatatatgaaataggaaggaacctatatggagggaggaaatacctaatggagggaaaaataagacagggtagcaaggaagaaagacagaagataatctctcatatgctgagtctctatttatgtgcagtgtggttgtgtgcaggttctcatagctgcagcgagcttaggagtgcagcagccatgtcaactccacagcacccccagccaccaactcttccatggtttccctgatatttgtgcgggtgtgcaaatggcccgattatggctgacagtcacttactctcagcactttggccagttttgagcctctgcattaaccgctaggagagacagctcctccaaacctgtggatacaaacggaaacattcaagggcagtttgctgcatgaccatttagcaaaacaacagtacaaggctccccgctagggcctgtgccctcccagcttataggaatagagttctgtgtattctctcactcatgtgtggaacacacacacacacacacacacacactcacataagaccaagcaggaaaccaacaagagtaagaagggggacaaggaatggcaagggcaggcacatatgagtaaaattaattatatatatacatatatatgtcaaacatgttaaaaccccattattttgtatactaacttaaaaattaataaaaaagaaaaatttatcctctaaaaagtaaacaaatttacatcttataattaattacaaactagttaaatataaaatataaggataaatgtattttaaatataaaataggaactgtaaaattgctaaaagaaagctttggagttttctttataaataactgaagtggtggggtagagcaaaaattagaaaagaaatggttaaattccactccactaaaaatgtgtttgggggctggagaaatgactcagtggttaagagcacttgtcactcttcccaaggacccaggttcaattcctggcacccccatggtaactcacaagtgcccatgactccagttccagggctcttgcaccctcatacatgcagtccaaacactatgaacacaaaataaaaaaattatagctgggcagtagtggcacatgccttttatcgcaacacgctggaggcagaggcagggattcaaagttcctggttcaaagacagcctggtctaaagaggagttctaggacagccaagactacacagtgaaaccctgtctcgaaaaactaaaaaagaaaaagaaaaaaaagttttaggcctaaacaaactgggagaaaaggaaggaaggagacaaagaggaaaaggaggaagaggaagaggaggagaatagtcatataatgggcataactctccttattgataagaagaaagaattagtccagcagcccccctgaagaaggcctgagagctctgcagcatgtgacagtgtcatccactataacagagacataaatgagagccataggagcatgctatgcctcacctctcatagctatggcagtgggctgtctgtgacagcatcaagacagacagacagacagacacttccatcccctgctcctaggtaagaggattggctgctgaggctgtgtggagtgaagcagacagcatatgtaaaacccatgccctgagtgatgtaaattctctcatacagagcaagtgaagaagcagagggtgggtctgtggcatcaggtacacgccatgagtgtttgccagccaccccattgcacatcaaaaggaaaagagcaaacatattttggttcttcagactgaagaagtattatgaagctgtataaaagaatgcaggtgcattttatactgtgtgggagcctctgcaatcctcagccagcagcgtagtgatccacaggcggggagaaggtagtgtggttcaacgtcactagccagtgtttgctcagacttctggagtctgacctcgagccgctcattttaggtatacttaagcactgcacaatttagtgaaaacttatcctggtgttaattaactcaatcctgtgtgcacaacaaagcatacataaatctctcagagatacaaaataagctaaatacagatcggatgtgactacatcaaacctccttgtaaagttcgtaaagatcggtgctacagattgcctgggggagggggaagctggcttataataaggtctgggggagggtccagtgtggtctctgtcacacagatgatgtaaaggtcaccaggctacttattaaccatgtctgctcacagctttctggacagataacaggttacacattccttcccttgaaggagcaacactgtgtttaacattccaggctcccctagtgctgactgtgagcacagagacctcagtgccccctacaacacaaggagagagaataatcctctggatatctataaaggggctaaaagaacggacatggtgacatacaaaagtgatctcaatcattaagaagctaaggcaggaggatttctgcaattacaaggttacaaaaagccttggctttattttgacaacttgctccattgaaccattgttgctcagcagagtccaaagaggcagccctgtgtccccccaatttctggagaacagggatttggtgagttggcaagataactctctgggccttgggcagccagaggctcccaagaatccagcttctctccttcctccttgttgtgaaactccagacaattcacacagcaagtggagacagaaaaagcatttaggggaaggggttaagggagccacagagttttgtatttcaagtttccatagtgcagtgtcactgctgaaaaaacaaggcatggaagtgcagggtctttccagcgggccgcagctgtcagcaggtgttggaaatagctcgccctgtaggcccagagcagctgacctgtggccagatttcctgaataattccacaaacttggccttccctgtcaagcccagccgaagatttaatagtgcctgttgattgatgccggctgctgtaatccaattctgagccaaggcgcagccagcctccaggaggccacttgatgttccctggtctcctaataacattgtctctcctcctccctccccatccaccataggccatttggtcaaattagaagatgaactcaaagaagcagatgccttcctttagataagatccaaaacaattcccctgtggagggaagggggaggggtttgttttcttttgttcttgtggcaaagaaggcactgttaatgtgtggcttgactaaaatcatggcaaccaggaggtggctctcttctatccttgtagctcctctcaaggtgtctctgtgagtgtttgtgtgtttggggcaggggtgtgtctggggtgtggggttttgtcctcatgatgagtggctgcaagctccccaaagcattgacacctaagttctatgtagcctcaggttccccagattggtcaacagaggctcaggctgacctgcctcaacctttatattgtggttctaagtagcttgttttctctttttattattataaatattttcaaacattcaaaagaaattgtgaaaagaatcattcgagagccactaggattcagctcattgctctgggctaaatggtaccccctcaagattcctcaccctggccctgcccccatacattggaatggaactgttgaggccatggggtctttaaagaagcaactgagttaaacaaggccctagggtgaaccctaatccattctgaccagtggccttatgaaagactaggcttggacatacaaagagagaccaggggcacagccacaaaggagaggcatggaggggcacacccagttgcccctgagccaatgaggaagggcacaggaaaatctaagccatcagcatgttgactttggacttctggtgaccagacctgtgaggaatgagtgagtgtcaatgaagccacctggtctgaggtacctcaggacacaactgattcttgtcagtcagcacttggccatggtcactctattgtccgttcagccatctgccttcttcatgttaactgttttggtagatttttaaagtgacctgaaaacttggtctactttgaagagtagcctagagaaggtaaatgtgtttgataaagcttaccagccaacatgttcaattgagctctggctgtaactggagtcagaaggacaatcaagatgtctgcccaaggatgaaggatcataaaacttcattacaaagacaggattggggatggagagacagctcagcaggtagggcacatgctgccaagcctgatttcttgagttcaatgcctgtgacacacctggtaggagagaaccactcctacaagttgttctgacctccacatacatgcatggcatgtgggcacacatgatgcacataaataagataaataataaaaaagactttaaaaaaaagaaaggtagaattttataaataggataatcacatatgtaactattatatatataatatacatataatacattatatatactatacatataaaactatatgtgtgtgtatgtatgtatatatatatatatatatatatggaagtagaacatagcctataaagggagagaaaggaatataaaggaagtggggagaggagaacaagagaagttaatgatggggtaaaaagaatatattcatgtctttttatatgtagaatatatatatgtatacatatatacatatattatatgtatatatatgtatacatatatacatatattatatatatatgtatatatataatggatgcataagaaaattgttgaagtgatagagagaggggagggtcaaataagagcaaggagtgatgacatatatgtgagatgtgatcacatgacacctattattttatacactaactaaaaataaaataaaagtaggcagatctctagtattggcaaatagctatagctccggtcagattttgcggtacaacctctggcctctttgggtgttcattctttgggtagcactgagcactatgtccccagtctggtctacgtagtaagttccaggtcagccactgctacgtagaccttatctagagaataaaaaaatctgattacagtgcagtatcgctggtagggcatgactcatccccaggctgtcactcaggctatgggtcttttccatattatgtctctgccatccctcagggctgaaatcccctgcactcagaactattggcaagaatggtcacatgtcccagttctcccagggttgctctggcctgtggagtggttgaacacatctttgtggtaaataccaaccatctctgtacagcacaactcctagacaatcctgagatggatagacagtggctgagagagagatagccagctggctagagattgatcagaatggagggaagctgtgagccccacagaagcagtgggaagaacaggaagggtgcaagtggctggggtcaaatgagatgtcccccaagcctggctaagatggctatgggaggccacctccacacaaggctctgcaaagttccttacacacttcttttccaagtcggttctagctctgtagcccagacctagtaacatggcttcaacaagagtcattttcccctttgtcaaatggagacggttagccaagaggacgaacaaaatgtgtgcaaagcgctaatccagaccaccattatcttagtatagaaaagacacagacattcaagaaatatttgcagacttcagtagaatgtagggctatcccaagacagcaaaggcagtggatctggagagaataatataactcaaagcttttgccgttgccattgctcagagggaagcaaaggtctagatcagctacaaggacgagtagggacatacagccacggaaccagtgaatgggtggacggaaaggtgctaagaagagacgagggttggggggattccggcagaaccagctcatgggattttgtcaaaagcaggccagagccatccgatgtcacgggtggccatgaggacttgacctgatgtcaaggattaggaattcctttagagtgattaactgggggaatcaggggcagctacaactgtgagatgcagaaatccaaattcaagctggagtcttagtcaagaaagggaggcagtaaagtttgaccaaactttggtcaaggggagggggcagtctttgctggtatgcttcttcggtccacccatcaaagtctgaagatgggactatagatttgaagtgctctaggactggtgggatcctacactctgctccctaatatgtagacttttgaaaatgtgtgtgtgtgtgtgtgtgtgtgtgtgtgtgtgtatgaatgctcacacgtgcatgtgtgtgacatgcatgtagagatcaagggtcagcttgtaggagttctcttccaccatgtggtgtcctgggactgaacttacatcgtcagtgttggtgacaagtgcctaaatcactgagacatctcactgcctcttttccctgaactgtgaaatagggtctcattatgtagcccaggctgactcacaatgctccttcctcggtctctggagtgctaggattacagaatcatagtttttcaccaccatatctggctcaagtatagacagctttgcctcatgtaagaactctgggtccctggggtcaggtgctagaagtagctgggtcacagatatcaatctctctgtgcagcagtggcaggagagccagtggaggcagacgctgtgacagaatccatctgggctgtgcaacagtggggactggaaggtctggaatcgtgcccaaggaggcaacgttccagaagtggtcttctggcctggttgataaatcccagagccacaagcactgtgaatgtgacacctgttgacagcggcagggtggcccagaaactgattaggaatgtggctttgctggcagctcatcaggagtaagccgggcctgggcccacacaaaggagtgaagctaagggcaaggcttgatatcagggaggagggcctcacctctagctatctagaaccctagagagggttcccttgtccaggaagcacagcctctgtagagggaagctggagagagctcagagctcacctggcagatgccctttcacatgcaggggaaataagtccttcacatttaaacagcaatttcctgtcagggatactgaccagggagcctaagtcccaggctggctaggagcttgtcgagcagcagaaatgtgggttatatgcataggtgtttgacttcaggaaatgccactgttggtgccaggaagacagaggccaaaggcagtagggtaaagtgcaaaaagacagaagaaaaggagctgccgaaagacatatacacagaaagatgcaggtcacagactcacagctggttattaagatcaaatagaactttggagttggccagggcccgttgattgtagaagccacttgccttgctttcacaggagtgactgagctgagctggctacatgagtaaatctttttttttttaaagtctgatgtcgaggtctggagagacagctcagcagttaaaagcacatgttgtttttgcaggggacccaggttctattccctgcacccacatggtggttcacaaccatccataactccagttcaaggagatctgaggctttcttcttagctttgagggcaccaattacacacgtggtatgcataaacatatgcaagcaaaacactcatacataaaataaaataaaatgaatactttccttttttaagtgtgatgctacatggttaagaaaaacagaaaggttttgctgtgaaagtggcaaaacatccaagggctgagaaacacccatgatgctggggagtaagggggtgggggatgaagacctgatcagctgtggtggcacatgcctgttatcccagcaccagggagcacgggacaggggaattacttgaaatagtaaactacacagtgagtcttaggataccctgggttacagaatgagacttcttcaaaaaaatgaagatgactaggaggagaaggaggaggagaaagaggaggaggaggaggaagaggaggaggaggagggggagnnnnnnnnnnnnnnnnnnnnaatgggactgtcttagttacttttctgttgctgtgacaaaacaccatgaccttacagaagaaagcatttaatttgcccttggtttcagagggttagatccacgctggcagagcagagaggtggtggcaggaccagctgggaactcacatcagggaaagcaagaggcagaaggaacacactggggatggtgaaggtcttttggaacctcaaagcctgcccacctaaccccagtgatgcacctcctccaacaaagctaatctaatcctccccaaaccaacccatcaactggggaccaagcagatgagcctgggggtagggggagtggagtggagtcgcattctcattcaaaccaccacgggagctttgaccacacaggaaaactgggggagatggtgtgggtgctattgtccaactgttgacctctgaactaagcgtgccgtttccttgcagctgctggctctgatgtcttagacctagttcccagaggaacagagcccaagccttcctttctccctcctccccactttgtgcagaaaaatctcagcttttaaggcttatctcaaatgccacctcttccaggaagcctgttctaactactcatttcattctctctccaactatctcttcctcccgtaattctctccagacatccttaagcctacactcttctctttcatcctgaccaatttatctgaaaataggttgataaagagccctcttctgtgccagaaatggaaaagccttggctctaatccttccagctgagtagcaaagtaacttatgcaacacccattttacaggtgagaaagctgaggctcagacaaaaggatccggttcacaggcaatagctattgagtggctaggtctgctcactgagctttccttgggtgctttagtgttggtagactacatcctgggggccaaatccagcacccctcgtatttttataaatacagttttatcagaacctggtcacacttatatttaggtattgtccatgactgcctttatgctttagagcaaagctctttgacacagactatgtagctcatgaatcctaaaacatttcctaccggtcctgtgtagactgagtctgctactcttgttattgaagctcctcaccgagctgcttaagtcagtgcttattgctaagtaccaataaccttatcttttatggtttagaatattatgtgtgttcatgctttgggcatatagtaaggtctcaggcagattgcagtgtgtatctggcacgggccactttgttcttttatagacaaggttcctgtaaaaaagatttgagactgtggatgcagctccgtggtagactacatgcttagcatgcatgaggtctgggttcaaccctcatggtctttggaaatatacacatctatgtatgtgtatatgcatatgtatatttacatatgtagaagactacatagctacacacacacaatatgtagagtttgtgttttgttattttgagtgtgactttattggcagcaatatagcaaacactgagccacgcagatcttccctgaagcagaagagggcagaggctccttggacaccctctgtggggtgtgactctgatgcatgccggaacagtattgatgaggccgttttgaggcaaatgaaaagcctcctggttgatagattgtgctgtctcctccttgtggcgtctgaggtgatcattgtacagagctcccagcctccctgggtagagagggtcctgtgtcttcatggctgccctacagaagcatctgtgagtagctagagctgcctacccatcccagctccctggagctctggactggcccctgaaagcctggcatctagggcagaagcaacatcaaagcagggattggccgactcccaccacaaatgccaagcaggccaggcgcgggcagcactcgggggcgtgacaaatctcagcctgtctctagcttgtgttcccgggccagtctgccttgggctttgccacatgatgacgggtccatcattcactcatcttctcctcatcatttcgggacttctctgtcactcagctggctacttgggtaagtgtgtgtgtgtgtgtgtgtgtgtgtgtgtgtgtgtgagagagagagagagagagagagagagagaatatatgtgtatgcattattttttaaataaaacttgaaaagtaggcttgtcctgggagcatcagcagaatttgaaacttctcagtcagtgttaagatggcagggtgaagggagggaagaactcactgggggccttgcacgcatgcttacccctgtgaagttgtttgtagtccctcttgtgaccttgactccagagtggctggcagctgctgtccctttgactctgcagtaaaaccgtgctctgtggtccacagatccccgtggcatcaggtggccgggatgctcgccatcattccgggccaactggcttgggtaacgaggctcaaagacagcagccaccaaaccaccagatcactttcttggcaggtgtgtcctcccttgctgcccaagcacactcaggtgcaccttcaccgtggccttttttcaaagactgtcaagctgctgttaccttgaggatcagaacttgcttttcaaggctgtatggtttgtgcatggggctgatgtaaagttccaaaaggcaggcttctttggaactgtgaagtgtggacaactttggtcaaactgtagccagctagtgtgtgaatgtcatggatactgggcattgcagcctaccatgggggcacccggagacaccatggaacatacgtctttcactgtgtcacttcctctggggtttccttctaatgccaccccaacagggtggggagacgtgaaagctcccaccctaagcgcaggcaggaacggggctattagcatatggctgctctaggtgtttcccaggctaaggcgggatgctttgttcccttgcttcttcctttgctggcttttggtacacactggctcaccctgaggggcgccacttgttgtgggaagctggagcagggacccggtggtctgctgatggacttgtagggaaaaagaaagacccagtggtgataatggggtcatacttaccttaaaacctgtcattgggggtgtgtgggccaaactcttggtgacacagccgaggaaactgagtgcttgggttgaggaagtgactgtactgtatcatggggccacatgcacctcagactcaaactcttagatgcaagttcctgtaatcccaagggtccactggcatggatcactttccaagaatgtacctcagtttcccaaaacaaagcagggagaagtttcctttcccatgaggggaaaaaaaaccaaacgcttgccaaaaccttcatcagacagctgactatacttctgtagagaaacacccacagatacaatggcattagtgtcatcacgtgaaggctggtggtcctggagtcccttggcagtgccaaggcagctgcctggggccgagccattgcatgtggtacaccgggccacgacaggcaccacgtgctacacacccaacagtttccattacaacggagccttctgggactcttccaggctgggccctgagcttaggtactgttccagtggagacagcaccagcctgggagagatgcacggggccattcagccccaaaatagacccgagaagccctggcttagctgacggggagagtgctgaggggaagctgctcgcagacccatccacctgatggaaatactcagtgctggaatgagctgtaaataaaccagactgtgctaaaaacaaacagcccctggggctgggggaggggtggaaaccgacggcccacacctgctggcataaagtaggtcaagggggaggaaggggtgcaggcgagggggtagcgtaaaggcagccgctttggcagcaaaagcagctgataatttatgttccctgaagatgtctccagtttccaggaagaagtgagagaagtgattgccttgggacatccaagatctttcactagggatgcttacagggtgccggacaggcaacgttggagactgtagagggctttgaaaaccatggtgcaaactagccacatggcctgccaagctcccaggtataccttcgaggagggctttggattgttgttgtctcctgaggcaaaaggaagacaagggaaaaatggatctggagggcagtctaacaggcttcggcggctagtgcggacctgccaccctcttcaataggccagcatagcatggagaagccaaagttgtccactcctgacttctcaacgctggccaagagctggtgacactttaatcccagcacttgggaggcagaggcaggcggatttctgagttcgaggccagcctggtctacagagtgagttccaggacagccagggctacacagagaaaccctgtctcgaaaaaccaaaaccaaaaccaaacaaacaaacaaaaaaaaagctggtgacagagtaaagcttgaaaacgtaactatcaaaccaagaaagagaacagcggagactgaagagatggctctgtagttaggagtgctggctgctcttccagagaggaccagggttcaaatcccagcacctatgtggaggttccaggagacgccctcttcgggccatctcaaacactgcatgcacgtcatgcacagatggagctcaggggtgagaggtgtagggaggccccacccaggccccactctgcttgtgagagcagagatccaggaatctgaggcccaagctaggaaccggaaaaacactgctttccttgatatcagtgctacaagcatcctagtgcacccgccccttctgttggtggattcctagaaatgaaattgctgagctgtgccgtatgtctacactcagcttcattagcaaacaccacacaatttcccaaagaccacaccagcctgttagaacaggataacagttctggttgtccccgctccttgtcgtatttttctcctgtcctttttatttatttatttatttatttatttattaaagatttatttattgattatatgtaagtacactgtagctgtcttcagacactccagaagagggagtcagatctcattacggatggttgtgagccaccatgtggttgctgggatttgaactctggaccttcggaagagcagtcgggtgctcttacccactgagccatctcaccagccctcctgtcctttttatagtagtcactctggtatgtgtgcatctatatcacctcatgcacacccatgatgctcgcagagtggctaagaacattatggtccagccacacagcagaactctgtacgaactggtattacagcctgtcccattcccccaaatgctgtgttaagaaagagaagccagacataggaattcatgttgtgagattcaatttgcataaaatagaaatgtcctcatcatgcatccctggtgttaggacccagtggtgtgtggggagcacggagactagagtttaccggcctctgcggccagtaggtgttttctagctcttaggtgctgtcatctagggtctgttctctttgtagaactctattgtgctgtagtgtgggatctgtatcattttacataacttaacactggccatgtattaaggccaaacatagataagactgtgaaaatcaaagccatagaagtccagtggtccattcacctctccatgctgtggatctggtcacctacacactgagccatttaagtgggacttgttagcaggctgaacaaccacatgagtacatagggtcatttcaaaccatggccacacctacagaggtagtctctgaaggaggaaaggacacacacagcgtctgggccatttcccttcagcagaggcaagagagggtctccgtgtgtcttcgttgcctcaaggcaacacacaggggcctgctccaatctcaggtgaccgtgtccgcatcccttgggcacagtgggcatgtcacagatcgtcatcctaactccatgctaaggaacagcagttttctctgaacagcccttcctggcctggatcagaagaagcggggcagccacaaagcatgctgcctactcatgcccccaccgcccccactcttcccaccgccgttcttcagaggcagccggagcccggtgagtactccggacttgggtgagtgaaaaatctccagactcttccatgccagctccatacctggcccagcatggccacctcaggatcccattgaagaggggcagctctaatgtcactcaaggacagaggcctggagtgggcattgggccacctgtgccacctgtgccaatccattcacacatctgctcccttgccgtgctcggtctgtgaagaagggaggttttccttgtcagggagttaagtggggtcagctttggcagcaagatggctcacctttttgaaaacactaaggtgctctcatagcttccaaatccccaccagctacagaattccctattttatttttgttttttgttttaatcaagtattcatgaaatccctgcagtgggggcaagggtggaagaaaggaagagggaaatgggatgtggaggatggagagagagaagcaggctagagagatgctaggtaacagataccaaaatacggttaaatgtgaggcctttggatgcctacagtctcttacaacatgttgtcgatttaaaagaaaagaaaagaaaaggaaaggaaaagaaaagaaaagaaaagaaaagaaaagaaaagaaaagaaaagaaaagaaaagaaaagaaaacctagggggaaaagagcgcagaagttcccactgcatagaaacagagcaggggtgagccaaggaggcagctatttcattggtctgacctctaacccattgtcactgtcatccgaagcttctctccccagacatgaagaaccttctggaacttgaggcgtcaccatcaccctgcattcaaggctcgctcggctctcctgggccccctgggccccaggtgagttcacccttccaggtcccctcctgtgtcctcccataaaccaatggacagagccttacagtgcctgccctcccatgtgctgtgtggctggttttctttctgtagcttctctccagcctcagcatcctgaagagtctctgggtgaactggcctcgcctgtgcaacccctgacacgacagatttgaaggtttcatatcgcatttgaggatgctgcttgtatggtagtgggctgttgttattgccagcaaataggaccatgaccatccaccccacctgtggaccagacggcttgtgctcaattcaggaacgtggccgtcagaggaaccacttaccttaggtttcctgggctctgggttactacaagcataagcagcccccaagcgaggtataagagaagatcgaggaataggcaagcagctagagaaagagcttttgcactccagagacccccatcccaggctgatctgctgccatgagggcttttcaactgctctggggctccatagggaggaggaagagggtgccaggagcttgtaggtcccgagtgccatcctagacaggaggcactgaagtcaccactcagctatgtgaacctcttatcatgtcatagtgttagggagctaaaagccaaacttcctgacctggaaggcaaagtcccatgagtggtttggagtgctcatcagcttgtaaacctccaccttgaacttagctacgatgtctgcctctctttttcacgtacagcaagcttgcctcagccttgggctggtgcactccagggccctgcttaagttttgacttgctcctcctggtctctcagaggctggtttccatgtcccctccctagagatacctttctcagctaagcatggtgacacatagcactgacgccagcactcagaggaggctgagacaggaggattactataagtttgagaccagtctggaactcactgtatgagttccaagactgctcaggatacagaatgaaaccctatctcggagagcagaggaggggaagaaaggggagaggaagagaaaggagaagaggggccggggggcggggggaggaatgcctttcacgattaccaagtctaagactatggctttgaatccagcctcacctgtttttgtaactacagttttactgtctgtggctttttgcagaccatcgaggtgaggagtctgacagatgtggtcctccaagtgattcttttaaatcactctctggctttgtagaggaaaagtcctgctcccttgtacaggaacagggatagtgtccacttcctagtctaggaacctgtgggctataactagcctgttctccatacatatttattgacccaggtgtataattacataattgtaatcccagcacttgggaggctgaagcaggagggctctgaatttaagactagcctggactgcctaataagagaccctatctcaaaaataaataaataaataaataaataaataaggaaacaaacaataaaatcatctattagatgttataatgaatatgggaccttgagctcagaagtcagacaccgtcataaagaggctgggatgtctgcagaaaggccaggtgagagtactctaaggtgggctcccccattcagcactctcccctgatgggtcttgatgtggatgagaaccaactgagcacatggaaggaggggatcctctggtcacctcagaatggcagttccattcatactagtgtacctctgagctcctgcaagtctgagtcacacagaggctccgctgcgcacccatggagtctgtgcaatgtgagatctctaagtagcatcatatgggaactggttagacatgcagtctcactgggtgcattgatttaggcctatgatcccagcactcagcgggtggaggcaagaagactgccttgagttagtcatgagtaccaggccaaccagggtaagacttctatcacaggaagggagaaaagaaggaaggaaggaaggacggaaggaaggaaggaaggaagggagggatacacacacacacacacacacacacacacacacctccattcgatcagaatctatatttgcttggtgtgtgctaagctcaatgatcttgtaaaaacagttgtaaccatttcaagaaagaaaaggcttggaaatagaaagcaacttcccagcctttacctcctaaatcagaaggcagataacccaaggtggttcctcccaactgtatcttcacctgaggatcgctggggaactcaaacactctcaaagctctctgactcccacctccccagatggtcatgtgattggtctgggtgtggcctgagctttggtttttttttggtttttgtttttttgttttttccaaaaatcctggggatcctggagtcatttggacaagttttggagaaaccacacttccaacaggctgtcatgttgatcacttgcagacagtagaggtatggaggccaagggatttgggtggatccctctctgctaacctcaggaatttggaagtcatgagctttccagagatatgtgagcagaaggcaggcacttctagcagtgaatgtacaaaactggaggttttcttttacaatgtctgctggagtctctcaatgagatccattgtaaacattcgtttttttttccttccattaatgaaagtttctgggaggagagtattccccacctgaaacccacagatcatttgtgggacatcttttttttttttcttttgttttgtttgttatctataagacaggatctcatgtagtccaggctagccatgaagttgctgggcagccaaggctggccttgaattcctgatcctcctgcctatagttcctgagttctgagattacaggagtgggccaccatgcccagctcctccctggggacatcagaatcagctgctctccgtgcagaactcaactctccttcctgccagggcctcagagaactgtagccagcgtagtgaaggatccctgaggccaagaaacatcacggtctcagtagtggggcttctccaggactctgaggctgctcttattaaacactgaaggttctagggagaaaatgaaagtccagtgagtgacaccaatggtgccaagatacagtgctgagaaacgaggaagagggatggtgaggagagtgggccgcagggccgagaggcccctgcaggcatccctggagccctccccccagctcccagcccccagctcccccaccaccaccaccacacacgcacacgcacgcgcacacacacacagacacacacacacacacagagtcagcccgctctgtaaaggtccagttctgcagtctcccactaaacccctcccctgcagtctctccttgtttaggtatgttttcttcaccttttctctccattgtgtagggtccacctgggcttcctggcaagacaggaccaaagggagaaaaggtatgagccgctgctttcttactcctgcctcatcttgacagtcactgcttgctttctggccgtgcccctgagaatgttctggttgggacttcaaaatacgtgctcattctgtcttagcagatgaagcagggagtgatgcaatgaatagatgcagctatagtagtgggtgctattggtgtgtcctgcttcggtccactggcatggcaggcgtgctataactggtcaagtgaccaactgagagccacagcatgcctaggcctcagccctattaagttctctgatcctagaacttctctttcaaacaagctttttctgttttctctatgcacagggggaccttggccgcccaggaaggaaggtaggacccatgctgttctgtcgggtaactgcgctgcatgtacatgcaagtgtgtttggtgggcaccaattccctggcagaactctggtgctggcaccccgctgatgatgccagcatgtttgccctttctgccaacactttggttaagagctggatcctgtggctgctagcatctggctgactccttccagaggctgctgagcctggccacactttcccaacttcatcctgccacccaatggggactcttcaggtccccagccagtgacacaaaatgaccttcattaaactggaataaagtgctcaagtagacaggagtgaatagttttgctttggacattacagtggctctgagtaaaccagccacacgccatcattagtgtcagagaaagagccagcaggcaacattgctgaagtcagagtgggtggtggctcttaagttctaggacttgactgggattgaagacagagcaaatccatcctaaaggatgctagtggctttattagcaacagaagccacaaacagacctttgtatggtccaaatagcaagaccagacacagctcagtgactgtgttgaatgctgtcctggagaaaggcctgtggtggtcccatgctctgaagcatcaaggtctgggtcaattagtaatgtctgccatgagcatggaaggcaaaagtagagtgtacacgccagcatctggcatctttgggctcttggctgagtcttttgagtccccagctaactctgaagtgagccaccgagtgtagagctcaagagagatcccccaccctcacccccaagtctatgttctcacccttgttcacaaaggccattcttctataacccatagctgagatggggttctctggaagcagagacatgtgcaagtgaatagattatgaaggaacactggcaggaggaacctgtaaagaggggagaagaatgtcatgagagtgtgcacaggggaagtccaactccagcagcctgaactgggatgtgtggagagcctgtctgtttgtccttccttgatgccttgaagtaagagatctgggatgttgggtatagaaagggaaggttcataagttactgggaagccccagtgccccatagtgagtttcatggatgcaggcttttatagaagccaatagtatagcctctgagggatagtgcagcaggcaggcaaaatgcccttgagggagttccaacagcatcagctgctgctcccagcatagtctcagctcatgccacaaaacaacctgtagagagcccacaggaagcaagggacagtgggtacactcaatagaggtaatgaaatttgagagatcaagaagtttagaatccctaatctgccaatgttctctatttcttaagtaaaataaagcgttgtttggtagcataacactaaaaatctaactcatgtctgcttgacatgggtttttaaaccctcattctttgtagggtagggatgaaggtacaggggcccatgtacagcagcctcatactcttatcaagaccccagatattcttgggtggagggaagcataccgaggtatcttgacttttgttcttggtctttgaagggtagacctggacccccaggtgttcctggcatgcctgggcccgttggctggccaggccctgaaggacccagggtaagtgtcatatgtgtttggggctcatgtagtattagaatacaagggggaagatggctaccctgggtcctggagcagtggagcacatcacttccttcagagggaaatagctggaatgcagcttttagcccccaggtgcttctccttcatgtggcctgcagaccgtggtcagtgctctgactctgctcctgtggataagtgggggctgctcccttcttccctaggatgcccatttccccttggtcctgagaatgagtgttctagtctctgagatgacccagaggaaacttgggtctgggaagctctcagctgtgccgataatctggcgtggaaagtccaggactataggcaggctggaaggatgcagattcaactcctcagagagtacacaaagcaaacgcacccctgtcctcttttgtcttatgttcctgccgcctgtcacagactgcagggtgccgaggccatgacttgaagatttgaccagcaggagccagggcaaggcaagcgactaccccctgctgctctgccttactggctgcactggcaatacaaaaaaagtcccaaggaaatttcccttcaaagaaccaccataacttgggctggagagatggctcacagtcagcagcgattgttgtttttgcagaggacttgtggtcagttcccagcacctccactgtggctcacaaccatctgtatctccacttccagggcatccagtgccctcttccatcctctgtggatgccaggtgtgcacatgcgcacatgcaggcaattttcaatttactgtattgccaggcatggcatctcatactcacaaatccagttctcagaaggctaaagtaggatcgctgtgagttagaggccagcctgggctacaaagtgcattccaggtcagcctgcgcttaagatcctgattcaaacaaaacaaaattcccgctacagagagctaagctgtccatcatggcgaaccacacatagttgtgaaacccttgaaatgcgactaatataactgaatgtcaactgttcagggctggggagatatcagtcagtaaagctgtttgccaccaagcctgacagcctgagttccatccctggaacccacatgtgaaaggagagaactgactcccacaagttgtcctctgacctccgcatgtgtattgtgggttgcacgcatgcacgtgagtgctctcacatacgcacacacacacagagtaaataaaatgtaattttaaaatcttattgtatcatgattatgtgttgaagtgacaattgactaaatgaaagtaaaacactggcaaaattaatttcactagcttagttttacatttaacgtaatttctttttaaatatttattcatgtatgtgctttatgtatatgagtgatctgtcttcatggacaccagaagagggactcagatcccatagcaggtggttatgagctaccatgtgaatgctgggaattgaactcaggacctctggaaccactgagccatctctccagccccgtttgatatacttataaaagaacttgcaattcagaatgaatgtgaagacaggtgtagtgataatatttcctacaatcctcgagctcagaggcagagaggaacataatcagttgaagggcattgtcatcacctgagttctcatgtaacgtcaagggctacatgagactctgcctaaaaatcaaaacaaaacaaacaagcaaacacccaaaccaaccaaacaaacaaaagccaaagccaaaataaacaccacaaattaatccccccaatagcatacagttgactttatatttctacaagttggaggtggcatacaattttgtaatagagacaataagtacacccttacacagcaaccactttcctctgctgtatatgccccgaggctgattttccctctacttgccttccgactgagggtgagagtgtaatgagatgtctgaaagaccctcccctgtgcacaaagcaaagcaggtaaagaatttacttgtgggataccatatcttctgaggccctcatgctgtctcccctggcctctcacaaccctttccaggaaaagaccaaacatcaccatttacaacatcttagtgagtatttagtttggtggtctgtccaccgtgggcattttttttctctatttaatctcaaggaccacagtgacaggtggaaagtagaaccctgggaggaggcaaaggggcagatggaactcacgttcccaacccagccccaataccctggttccgtcccagcttcccccacaactcctgcttctgcttctctgagaaacatcactgtgggtcttcttttccttcttctaattgccacagggtgaaaaaggtgacctgggtatgatgggcctgccggggtcaagaggaccgatgggctctaaggtcagtgcatggtgcagacagccatccctgggtctcttcactaacactgaagagcagcagctgtctacagagatggggagggtggctctgggacactgtcgctgtgctggggaaatcatgccctgaggtgcggggacactggggtcatgttcccgttctcttccgctactgggggtaacggcatccggattaggcatactgggagcctgctataagcacacgcctcttggatatctttgtgtttactgatgtgtgtcccttaggactcacagtacagtgccgagcctcagcaccacatcagggacccctcccatcccctcagccccggctgtcctcgaggctcactgtaaacatctgcctgctttcttttagggtttccctggatccagaggggaaaaggtcagtccctctctccagccatcccgatcctgggctggatgccgctctgggtgggtggtgggtggcacacaagtccagccttctgtcagtcatcagctgcagctcttcttcccagctatccctctgtcctcgtcctgtgtaggctgagggaggataaagacctcccgagacaggacacttctggtaaagctcccagtgacctcacgccctgcctcacgcagggagcaggggaacagatgagagctagcaggcaggcaagtctttggtcagtcagcgagcaaaggggcagtagaagaggatttgtcctcgggccaggtttttactacacgccttctcacccgcccaaaccaaacaccagccggcacctgccagatgagaggactggaggcccagaactttctgtgagtttccctgtactaatgttaggaggtctctgcgggtctaaacagaaagcatttctttactgggcaagccacctaatataagagcctagagctttacaaaagtgagggtgtttgcttagggagtttttcagtttgaaatgttcctatcactacccgccacaccccaaaccccaacacaatgcgatatgagaccattgaccctctcttttgtttttctcctagggatccagaggtgaaaggggtgacttgggtcccaaaggagaaaaggtaatggcaaatctgtacaactgataggcttcaatagaagtgtcagatccggctcccttggcctatggaccgatgggcagccatcttggaaatggctgatcaaatctacccacagctcttccaagtggtatttcaggacagtcatgatatttgttctcttcacagggtttccctgggtttcctggaatgctggggcagaaagtgagtatctagaagtagagagactggacctcaagccctccagacatagcaaacagagcccctcctctttgcccttcaggcagagaaactgattttaattgtgggaagttccagtttgagatgaggaatactggggagaaggcagcaggaagatctgaagtcaacccccacctgggagagaggcccacattgcttctcctacttcttgaagctccagggcagaattaaatagctgaaagttctgtaaggatcaactcctatctcctatcggagccacaatggtcaatgaccctcttatccctcagaccctgacggatgagtttagtttagtgtcactgcttcctaaacactcaacaccatcttcaagggtggcagacactgttggaggaacacggcattattttaaatggatggcaacaattttattgaaatagtgagatatttattttcacacttgggacaggcctaattttaaaaggagacaggtttagttattaaagaaaaattattcagtaaataaccatggggtgatgaattgatataacaaaaaatgcgaagatggcaatagacagggagatttgggaaagtttttacttagattgaggatatggagtaaggttaggtgttagacaagggaagatgtcacagcataaaggaagacttgcataaatgaccatgtaggacagtccctaagctgacatggaatgctgggtcctcaatgctataagatactgatcatgccaagacagctcctgagataacatggttgcttttctattgctgttaaaagatatcatgaccaagacaagtttcgtgtgtgtgtgtgtgtgtgtgtgtgtgtgtgtttcagaagcttagagtccatgacagaggaggaaaggcacaacatcaggaagagctaagagcttccatctagatccacactttggagggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacactggaaattgttatctctacctaggtcataaactggaatgcttcaaatatgcaaacaaacgttttctcaatgtctataatttttaaacccattcactttaaagtgttactttctaaagtaaagcatttttatccggtggtatacagccatgggtctttatgcaagtcactataacttatccttaccttagcctgtcagaaactcagttcctgctaccctaggtaggatgctacattttaaaaatagatgaatcatataaacaaattaaggcaaacttcaaaagagaagaaagtaccttaagatgttttgtctagattctcattccctgcaacagtaatcatcaaagactcattggtcactataaaattaaatttgacaggttctctggcttgtgcgccatttaccaggcttggcatagagagcgccgtcttccccctttcgtggcaggctgctttgggaccgggctgatgtgataactgtaattaggtcttaggagaggaattagatcaagaaatccctagctgcttccagctggtaaagagaagagccacacttccttccaaagacctcttttttaaaattcatattttttatgttgatgctttctcctggctaaacaagatattccctgggcccctctaaacagcccaggggtgtgtgtgtgtgtgtgtgtgtgtgtgtgaaaaccaggttaatggttcctccattgccatgtggaatcattgaccctaacatggacttaaggaaaatgctttcttaaaggtttcatttttaagtgtgtgtgtgtgtgcccgagtatgtgtgtatgtgtgtgtgtcttcatgtatgtgtgcctgtgaaggtgggaggtcttagatcctcccggggttaaaattttgtgatcattcacaactgcctggagttacaggccatgtgagccacctgatatagtgctgggaactgagcttggatcctctggaaagccagtaaacgctcttaactgctgagtgagttggagggggacaggttcatcctgttgctaagctgacaggtcagcttggccctggtcctcaccagctactggtctctggaattccccattgtgttagagaaaatcacatgacaaggagcctgggtatctattgctctctctgagtggctaggatggcccttcatgagcactagcaattgataaacagaaacttccctggtagcaactgctacactggctatgttgggggcacagtttgggatgcagggcaactgtttaaagtacaagtgttgtgcccgtgggtccataatccccagaggtacacgcacacggaatgcatgtgtgtgtgtgcatgtgtgtgcgtgtgtatgtatgtgtacatgcacatagaagtgcatgtgtgtgtgtgtacatgcacacaggagtgtgtgtgtgagtgagtgtgtgtgagtgtgtgtgtgtacatgaacatgggtgtgtgtgagtgtgtgtgtaaatgtgtatgtgtgtgtgtgtgtgtgtgtgtgtgtgtatgagtgctatacatgccaaagtgcaagtgtggatgtcagagttcaactgatggcgctgcttctcttctacccggtctttaggctcagcagggagtggcttttcccacaaagcccttttgatagtctgaaaaataccttttgcaaaaggttggctttgaactatgaaagagttatttttaattaggaatgtaatttacattgttttccatattttaataatatttctgtggtgactatttgaacaaatacttgaagcatcttttctcacaaaaagggttttcatgtgagttggacagagtggcacatatctgtaactcctgcacttgggagacagaggcaaggggatttcgggggcatcctcagctatgtagatgggtagaggccagcctgggctacagaagatcctagctcagaaagatttttagggagaagtgagctgaaactcaaaataatacttaccggtttgtgaagaagtgatgaacccaactacgctttaatcccagtaagcaggggggcagaggcaggtggatgtctaggaaggctagcctggcctacatatcaaatttcaggccagccagagctatgtagtgagacactatctacaaaaaaaaaaaaaaaaaaaaaaagtggggagttatacaatctcaacaagaatcagaagcatgcccgaagcatacccagcattacatcagaaaagacggttcccaaacatcaaaaacacccaactcacacctgtgagcttgtactaaaaatgtaattgttcaattagacaagaaagtcttttccccagtcaggagtgacacgggctcacgtgcaactgagaggcaggagtcaccctgaccactgtggaccaggttgtctcttccgtttgaccaccagagcacctatggctctagagcactaagtcacactcgggttgccttccttctttctttcctattaatatgagctcatcagtctcccacactcccagggacagccctacctggggagggtacagtatgaagaggaggcgctggcagccagtgataggagagacccacatagatgtgtctactctgtctctcacttgcctctcttctccccagggtgaaatgggtccaaagggagagtctgggctggcaggacaccgaggccccacaggaagaccaggaaaacgaggcaagcaggtaagagcctcagggtttactcccaccgaggtcacaccccatggtttgggagtggagcagcatgcaggagtcaactggagccatcccacagccctggatcccggcatcctcagggctggtggacagagcagcctcactactgacggaccttcaggcttctcgaagccaaaatggttcaaggttgcaggctctgctcaaggtcagaagtgggagtggcccgagttcaccttgttcagaggaatgcatacatcttaactgaagcaactgagaatgggaggaggccaaggccattttgcagaaacttgccttctgcccagcgtgctgggtatagacggagttctccagaacagcctaggcccttccctgatgacagttctcactgcacaagcccctaatttagaagtgatcctcttcactggtgttgttaggagtttagggaagttgttcgctttgtcagcagggcaagccaggttatgcagttgggaaattgaattccagggctggcttgaggactgtgctaagtgcccgcaggaaaactagccccttgactcatggacagatgcctctgagagatgagctctgtcacctttttttgattggtggcggtgggggaggttctttggtttgtttgttttaagacagggtctcactgtgtaacataggacggccttggacttcactaaccctgcattatttttcttcttattattatcataactcagctgcctatttcttttttgtcgtcgttgttttgttttgaattttgagacagggtttctttttgtagccctggctatcctggaacatactctatagaccaggctggtcttgccctcagcaatctgcctgcctctgactcccaaatgcatgtattaccactgcccaactgcctttttcttcttcttctttttttttttttttccaaatagatattgaaatccagctttatttaggggctggggcaatgagttgggtaaagttctttccgtgtaagcacgagagctgagcttggtcccagcgttcatgtgagagggccagcgtggcagctcgctcctataagccaagcaccagggaagtagagccccaaccactctggccaatcccacaatcccacgagctgtgggttcagtgagagaccctgccttaaaataaggtgtggaacctttgacctctgcttgcacactcagatacaagccagcttatgtaaataatcttagttgctgaaaattgatacttacatttgtgatatgcgtacttgtaatatgtatactttttaatttaatgattctgagtatgttagaagaaaaatgttattttgagcacctatataaaacatttcttatttttaattgttaccatattttatggggtagacagtgatataattatgtacatacctacactgtagagtgaccaaattcagttattagacatacttatcacttccgatttttacaatttctttgtaatgagaatatttcaactctacccatctcattggctttttatctccatcctgttgttggttatgacctgatctgggtattatagccttccataattctttcttctttcattttaagatctgtttatccatttattatgttctcgttgctttgaggcagtgtctcacgtagcccaagatggcttcaaactctgccctcaaccatgctggggttgcatgtagttcagaactatttcttttcttttatgtccaatatgtagttttttttttccttacaacttaaaatcatgatgtgtacagcttattgtagaaattaatgaatttttaaacgtcttctaaaaatactattctgcatcatattctaatagacaagaaagcaataggttgtgtggagccccatccccacccccgaccgtagggaggacatgctttttccactctgttggctgtttccccaaggccaaagtgaggatccccaaacttcagttcacaccagacttgtccccatgaaagctgctgttgacttgaaaaaaccatcatggcgtggggatttagctcagtggtagagtttttaccctgagttccagcatcacaaaaaaggaaaaaaaaaatctcctgttaaggatacagaaccacttcctcaagagaaacctcctcggctcagggaaacctcccataaagacatggcactttccacacagtgaccaatgaagcagaagattcctctgctggccgctggtgtcagagtcaaggagtgtttccagttccttcaagctgtgtacttcctgagctcagagccagctggcctagctgttagaaaaacaagcctgactggctatattaagctggtgtgacttcctttgccattctgggacccatcttggttaccattcggaatacttcaccctggcctgcggattaacagcctcctccgtgagggtgggattggaaacaaaccaacctcatgggtcccctgggacgagtataggaaaatctttagaggccacgttggcaggacagcatctcactgaatcagtgtggagattggaaacagaatagctacaggtgtgactctctttaagaaatcaggacgtcttgggtgtgagggacatttggctgggacatctgtcatccagttgatcgttatggttggtttaactggtctggctgttgaggagggaactcactggtccacgagtttcttccaaagctgcacgattggataaggaagatgacttctccaatagagggcgattgtttggccaggagtacggaggtagttgtgcttccatactaggatctccaaagggctgtaggaaatcagagttccttctcccatgagagaagatgaagcctggccagccactagggcttgtttccccatcacccttcattcttcacaagccgtatcttcacttctgccatctttgttaacctcttagaacctaggtgggtgcctatttcctggccccgctttagagaagctaaaaccaaggcacaaagcaataccatgagttacccagggcctcacagtcaagggagaatatcttgactgacagattgtcaaaaatccctccacattcactgccaacttcattctcccccttcctttggtctggggagagaagatgaacatggtagattctagcctacatggaatttatgtctcctggggagacagatgaaatgatcacacaataacttatgaccagtgatctgaaataaatgctagaagaaccatgcatggtgtgtgtgtgtgtgtgtgtgtgtgtgtgtgtgtatgcctgtgcatgtccatgtgtgcatgcatgcatgcatgtgtgcatgggtatgctcatgcctgtgtgtatgtttgtctctctctctctctctctctctctctctgtgtgtgtgtgtgtgtgtgtgtgtgtgttctgagactgagtttcacactgtagctctgggtggcttataattagaactcatgtatatctcaggctgcctttaaactgtagccattcctctgcccttagcctgttgagtgtggtaatgacaggcatgcacctcaccactcagcttgaagaagaaagctttaagagaacttggtgggagacatcagtgttgcctggggagattttgcagctgagacaacagaacttaaaactaaaggtagaggggcataaggaagagcttagagtttgaagagagaggattttgggttaagaatcatggtgtttttgacaaaaaaaaaaaaaaaaaatcaccaccaacaacaaaccctctgactcaggccatgaccagcttcttgcactcagtaaagagtggggtctctaccaagatagtaacaggaagtctgtgggtagaaacaactcttctgatagaatgaaaataacatgtaggtaaacgcttaaatgataggtccaacttggccacctgaacattaggcactgcgcagatcctggtctgaaactccactccctaactcatgcagataatgaacttagtgaggtcatcaaacttgcaaatgttgcttgctctgtttgtcgcaggagcagggtgctggagaccaccatgaaagcttttgcttttctaagcaaggtggtctctgacttagaggcaatgtggaggaagaactttgttatgtcatgatatcacaatgggttctatctttctctctgttagggtcagaagggagacagtggaattatgggcccaccaggcaagcctgggccttctggtcaacctggccgtcaaggtcctccagggcccccaggcccaccatctgcaggtaagacttatgcaacttcacttgatctacacagtagcactcccaactctgtctcccaggaaagccacaaggagatgccaacagagttctacattgtatttcttgctagaaaccgccagagtctcctttgcatatatgttcctaatttgtctatgatttggctaactgaactttgttttaacattctggaaaacacacaatggaagtcaagagagggtaaattacattggtgatgtcatttatattttcagtgaaaagggtacctatttcatcaactacaatctttttcactttaaaaaaccatatatttattttatgtatgtgagtacactgtagctatacagatggttatgagccttcatgtggttgttaggaattgaatttttaggatctctgctcgatccagttggcccctgctcgctcaggcccaaagatttatttatgattatacataagtacactgtagctgacttcagatgcaccagaagagggcgtcagatctcattacgggtggttgtgagccaccatatggtt

SEQ ID NO: 1400 - DNA, 529 bp, Mus musculus
acaaagctgagctaggagaggctcccagcagccttgccctctgacttgatattaaccagacctggccagcatggtggtcctgaatccaatgactttgggaatttatctccaactcttcttctgctccatcgtgtctcagccaactttcatcaacagtgtggtcccaatctcagcagcccttcctggcctggatcagaagaagcggggcagccacaaagcatgctgcctactcatgcccccaccgcccccactcttcccaccgccgttcttcagaggcagccggagcccggtgagtactccggacttggacatgaagaaccttctggaacttgaggcgtcaccatcaccctgcattcaaggctcgctcggctctcctgggccccctgggccccagggtagacctggacccccaggtgttcctggcatgcctgggcccgttggctggccaggccctgaaggacccaggggtgaaaaaggtgacctgggtatgatgggcctgccggggtcaagaggaccgatgggctctaag

SEQ ID NO: 1401 - protein, 158 aa, Mus musculus
PDLASMVVLNPMTLGIYLQLFFCSIVSQPTFINSVVPISAALPGLDQKKRGSHKACCLLMPPPPPLFPPPFFRGSRSPVSTPDLDMKNLLELEASPSPCIQGSLGSPGPPGPQGRPGPPGVPGMPGPVGWPGPEGPRGEKGDLGMMGLPGSRGPMGSK

SEQ ID NO: 1402 - DNA, 71108 bp, Homo sapiens
  misc_feature (1)...(71108): n = A,T,C or G
tggacatgaagggatggggacaggaggctttccaggtggagaaagtgcagggattctggaataggatgtcaggccagggaaaacacagggcaagctgtccttgctagcagttcccagcaggagcaggagctggagtgcaataagcccaaataaaatgttcccccactgtccagccgtccaaatttggaagtggtcttctgctatgctgagccaccagaatctgtcagcagtctatcatccaagcatacctcattctatttctcttcaagggctcccagccaagaggccctgccactgcccccaaaagggccatgatcatgcccacactgtgccctggggtggggcagttcactcacctgtctccccatttccctactgtgtctggtcctggagctgggtagtgtggtgtaaagaatacaggctttgaggtatgtgggccagctttgtgttctagctctgtggccttgagcagattacctaagctacctttgtcaacctctatccatagagagagtaatacccatctcatagagttagctcaaaagcctagaggcttccaagaaatcacatctgtaggaatatcataggtatttaatgattggtggttgtagttggtattttcatcccttaaggtcagaaatgactattccgtgaatacttcccagagaactacaattaaagttcatctcttaccttcctcatcgactctggcacctccttccaaattcctgtaactcagatggcagtcaagcctcccagatcaccactgaccccagttccatagctctgatcacgctaagtcctctccagatttctgcagcgtctcaggaaagacttttctccccgtcccatccctgtgttgtcgtacgctagcctagaagccaagcctggcacctgcacctgtgtctgtgagaaggctgctcactgcaagccctttctgtgttctggtaactttaataaaggcctggaggctggggagaaggaggtgtcaggttggggtgagtgtgacctggaaaacaatagaggtgcagagaattgggaggggaaggagccagggttcagagaaggaaaacacacaccacctctcaaggagaagcaacaacattccatcagaagaagacaggggagggtggggtatttggtggcgctgcagactttggaaaatacaatctgctacacgaccttaaatatctatccaatctgatcattactcaccacctccattgtcacttcttggaaaaccaaccatcatctccaccttcagtgtcctcctgttaggcctcctacttccccctacaatctactgtggtgaagccaggggtgatcctgttacaacacaaatcagagctgccactcctgttcaaaaccctccactgacttccatcttaaaacaaagtccaaactccatgcgtggcctacaaatgccacatgacctgaccccagtggcttcttggatcctatttccttcactctccctcttgcttactctgctcgagccacgtgtaactccattctgctcctcctggaaaaaccaagcttgttggtgccttaggatgtttgcacctgatgccttagaatgctttcctcccagatatctgcatggctcgttttctcaggtctctgctccgatgtcacctcctcagggaggctctccatgatcaattatttctctccattattctacattacactgaacaccagtgtgcttctgtcttgagacctccttagaatgtaagttcccaagggcagggacttttgtacactctgtgcatgctgaatctacagcttgtagatcttggcctgtgttgtgataggaacacagtaaatatttattgaatgaaaaaataatgggccaggcacggtggctcacgcctataatcccagcactttgggaagccgaggcaggtggatcacatgaggccaggagttcagtaccagctggccaacatggtgaaaccccgtctctcctaaatacacaaaaaaatgtgccgggcatggaggtgcacatttgtaatcccagctactcggaaagtgaggcacaagaatgtcttgaacatgggaggcagaggttgcagtgagttgagattgtgccactgcactccagcctgggtggcaaagtgagactctgtctccaaaataaataaataaataaataacaggaaaacagaaaaataatgagtgaatgaattctctgacctctctcttaccttcctgaatcattgcttttctgtttctgtcttctctagtttaaccttgttcatctacttcctgaggacactcttgtggttttaaaacttcacagttacatttagtaactctttatataaggaaacagattgccacataatccatgataactgggtggaaaatttttaatctctcttgtacttaaaaaaaaatcacctgttcctcttacctgagattgcatatgtttacattttggccttggagataaccctttccctgtggctgagtatttttaaagcactttaaggccttaagtggattaaatacagaacatactgtgacctcaggtttgtgcgacttgtactacaacctgcaggatgggaggaacctccttgtcacagggattgtaaggcttcattggagcagcgtgggtgcctatgtatgttcttgtccatctctgaggagattatttcctacacagccagcctcagctagtaggtgactctacgatactccctagcagtgcctgattattgcgcatattggctaagctctctcttctcataactgggatgcaggatgcataattatatgcagtaagagtggttccctttcttaccctttacttctcagtcttggtcagcattagcctattgttattaaaggttttgccaaacacagccacatgcccttgatctccacctttagctgggcagagacaagatccaagctttgaaaatggctttgggccaaatcaagttgctaggtgggccttcctccccaccccatccaatctcctcaaatgcaagaggaaccatctctccaggaggcaaggtggtgtggttggggactgggattggggtagggggccggtgatgggctgagggtgttgggggaggtgatgggattgtgggtggtaatattatttcaataaatatataaaaataaaaatttgcaattagcttgtgttaagtacaaatagtatactaggaatatgcatttgaactggctagagagttcgcagtgaatgtcacctaagtttcccagggttcaccttaggggaaatctggggcaagctccacctgaaagagcgaggcagatttgtttcgccctttggtggcttactaaatattatgagcttacttattcctatgattcttgaaataaataacgttaggatttatttgttcaggattcaggatgtttttccttcctatgggctttagttcaagaaccatcaatcctcgggttgtcataaagcattttggggtctcctcggaagtccctggccttcccttatgtcctgtctccctaccaagaatgtggttttgcatcctcagagttgaatgattcttggactcacaacctttctgagtctggtttcaggtaaagacaggttgattggtgttccatggagaacatgtctagccctaaaggctagagcactggtgacatctgattcgatgtgtcattcagcagcctgcacgcttcatatctagtcttgctaggcattgttccagccagccaatgacctgaacctctgctgctgtccccagaacttcacataagcctcagttttctcatctgtaagatgggaattataattctagtcttgctgcctcacttatgactatcgaatgaaaaaaagataaggatttcatacaaaataaagccctatatacgattatttatcataccagtaacatgtttagtgtataacatgtagataagagaaaagtggggagctaaataataagaattaaataaaaatgggtttgagggtcaaatatgtttggggtaaaagcaaagtcaatgcatttctttactgccggacttctcagtgtttttgatatgccaataaatgttgtgaatttccaacagtgacataaaacaggcagggtttcctaatgtccatgaactcctctgcttttcaaaaaccatgcatctcagaatgagcacaccccccagcatagtatgaaaaacactgtattggttaagattactgtcgctagtgttgtgattgcactccagatggctcaaggccagcctactatctctgccctgaaagtgaggaaatctaagctcctggccctggagatgtaactatgggcgagatgcctggataagtctaatgggtcttatcagactcgttagctcttctggccctctgatgaagctatgctttgcattcccaggccccatcagttctggctttgatttaagaccaagttgccagggaacagtgagctgtgaggaggggctttcctggggcttctcagttgcccaggcttgcctcccgcctgctggtgggaggtggctatgacctctgcataactgaagtatcatccattctgggccagagagaccaggctcagagctctgtttctctgccaggaccaatcaataactctctgctcttcacaacacgtctgcaaaagacttgttggacctcgggcatgcaggattggcgcctttttcctttctgctgttttctttactcctaaggccgccctaacttgattttgtaaaaatagaattttgtttttaaattacaagttaaataaagctcattgtaaaaattttaatacaaatatgtataagcttgaaaagggaattctccttttatcttctcttatcccatatactgtgggatgtacatcattctagatctttctctacgcacatataaaaactgataaagagatttgcttgtttgttcagaaatttggtcggatatactgccactttcttatttcactcgacagtgttccattgacaatcttccatgtcagtgcatacatgtgacatttttcttattttttaaagtcaagtttactgatggaaaatgtacatataataaaactgaccctttttgagagtacggtttgatgaattttgacaaaatatacaaccactctaatcaagataaagaatattttcatcactgctagttctcttgggcccccttctcttctcacaattctaacccctggcaccatggatctgttctccagccccatagttttgccttttccagaatgtcctactaatggaattatacagtatgtagcctgttgtgtctggcatccttcacttagcataatgcacttgagattcttccatgttacttagtttattccattttattgctgagtagttttgcattgtatgtacacatgcagtttgtttatccattcactggttgatggccatttgggttgtttctagttttagctattacaaatgaagtggttatgaactttcatgtacagtctttctgtggacatgtgtttcatttctcttggataaatactgaagagtagaattgttggatgtataataagtgtatatttgactttataaaaaactgacatttttttccaaagtggttacaccattttgcattcccactagcaatgtttgagaattccagttgcttcatatcctcaccaacacttggtattgtcagtcttttaaattttagctattctagtaggtgtgtagtggtatctcactgtggttttaatttgcatttccctaatgactaaagatgttgggtatctttacaaatgtttatttgtcattaatgtatcttctttggtgaaatatatattcgcatcttttgccttccttccttcccttcttccctccttccttccctcccttttttgagacagggtctcattctgtcgcccaggctggagtgacgcagtaatggctcactgcagccttgacctcctgggctcaggtgatcccttatcttcaccctcccaggtagctaggactacaggcatgcaccaccacacccagctagttctgttttttgttttttgttttttgtttttttttcatagatacagggttttgccatgttgtccaggctgtgtccatttctttatttcatttcagttttttttttttgaaacagagtcttgctctgttgcccagggtggagggcagtggtgtgagcccagctcactgcaacctctgcttcccaggttcaagcaattcttgtgcctcagcctcctgagtacctgggattactggtgtgtgccaccacacccagctaatttttgtattttgtgttgagatggggtttcaccatgttggccaggctggtctcaaactcctggcctcaggtaatccacccaccttggcttcccagggtgctgagattacaggtgtgagccatgtctggcctgccatttcttttaattaagttttttatcttattattattgagctgtgaaagttttaatatattctagctacaaatcatttatcatatatgtgtttggcaaatattacgtcctagtttttggcttggctttccaatttagtattctattttgaagagcagaagcattaaagtttttataatgtccaatttaacttttttaaatttaagatttgtattttgcatcttatttaaaaaatctgtacctaacccagggtcactaagattttctcctgttttctgccgtaagtttaatattttagcatttacaattaggtctgtggtctattttaaaataatttgtatgcatggggcaaggtaagggttaatctttatttttatttgtttgttttgcatatggaagtcaaatttttccagcaccatttgttgcaaagactgccttattctttctagtcactgcataacattttgaatggatgtcccaggatttattccaccaatgtttcattcatggacagttaggctgtttccaacttgaggcaacaatgcacacccttgcacctaaaccactgggtagtgaatgagtatttctgagaacttctgggtcagacggcatgtgcattttaagtttaatggggccaaaagattgttttccagtgtacagtcctgcctacaaggtctgagagggaagactctgactttgaatggctttattggtgtgagcttttctcaaatctcaaatagtttccttctggacaaatctaatagtctatgttattagattctggaaacatcagagcccttccaggaggatttgaagaaagatgataatttctgtcttggtcagttagggtaatcttataagaaataggttcataaaatataagatacctaaggaaatggaaatttactaaaaattgtttaataagtattggggccttataaataactctgtgttggggcctcctcaaagggtagaggctcctgtcgtaactttagatcagcagtgactcattctccagtgacttgaattataaatttagcctctctgtctgcgggtcctaattcaaggtggccatccatagtccctctcacactctcaccatactcaccaaagccctcccttgtatcaggcgcaggccacccagctgtatgtgcagaggctccaaggggtgctggggaaatgcaagttgtgcagaaagctggagcataaagttatgctacttttgtacgttcttcttttttcatcctacccagtggtgtgatttgatcaaagtaacttacattgttgaggatctgttaggtgacaaggactgtcctgggggccttgagagtacatagagctgtgggatagtcccctatctttagggatgttaatgccagctaaatagcaacacaaggtggtgttcaaaaacaatagcagcaggtgtcaccggtaggacgtattgacagaatttgttccaagggtatggtcagtggtgaattctttgtgctgagagaaggaagaagtcatactggctttgcagaggaggaatctgagctagatagtaaaaattcatattctgacaccaagttactcaaaagataccttcctcccaggtagactgtaccttctccaagccactggaagctggctgctggggctccaggagttaacaagagtgagcctgagaatgtcctgattgagtttggccagcaatcacagctccttcttgtaaaaattttgggagcagctaaatgggggtaccctctctttaatctgtcctataaattttgaatgtagttcaggtatatttttcatgctttcaaaagctttccttatcaactctgtatcagttagctattgctgatgagcaagtcatcctaaaacttactggtttgaaacaatagccgttttatttgctcatgacttcgtaatctgggctgggcagttctttcgagggtctcacttggggtcactcctgtggctggcatcatctgagaccaggacagggctagatgttccaaaatggcctcactcgcctgttgatgctgcatctgggatagtcagaacagctggaggctggctgcttccccctccatgtggcctcttcaatagtccagactttttaaagtggcagctgattttcaagaaaaggcaaaagcaggagctgccaggccttttaaggcctaggccaggagatggcacagtgtccctttagccacattctattggtcaaagtaagtcacagagccacctcagatttaagggaggggaactagccctgctttttgctgggaagagtgtcatgcacacactgggttgggaggacttttggaggccatctttgcacccaggctaccatggctcccttgggtctcctttgtgctgttcctatgtgcaagttctaatccgtgtaggattcatccccattacctcacttaactttccaacaaacctttaaagggaacattgtctccattgtatggatgagaaaactgaggcttagagaggtgagcttgtccactgccactcagagctgagagtcaagcccaagtgtggtgctacagctgtaaaatatcactttataccacgccctgacccaactccaccttccccataatgagcacaggggcaggatgcccaccccagcatccagtaactagcagactgtttctgagttaactcctatgaggcatgtaatatgtaaattaaagcaaaatgaacaactctgtgaattattattttgttttagtcatctaatcatctctataacaggcttttataaactcataaaaggtattaagaatgtgataatttttatttgaataattttgtctagccaaagattaagttagtgatgttatttttctgaatatagtttgataaaaatcattcacttttctatacttttactgttttcatttattttgccttgcattgaatcaaaaggttgcagcttttggagagagaaacactttttcacagagaaagctgtttggaaatataaactacttccttcctcctttttattggatgattaaagaaaaaaattaaaagttaactttacatttgttacacaatgggtaaaaatgtcacaggctgacagtggaggggtttttctccatgaaattcagtttgaatcaggagagttgtttctgcccagttccaaggaggtagatggtggcacataaccaattaggaatctctctgcccttgaggactgcctccagtgaacatctgagacttggctgccttctcatcacctcttcactagccacttacctcagtctccaaaaaagaaaattttgacatcttaattttaatgtgggcatttgatatggagcttgagataaatataactctctgtagcatggagacagtttaatgggaaatggttggcattctttcttggtaaaggcatgggagacaggagaggtgggggagggagagagagggagggggtgaggaggagggagagggaaagagaaagagggaaagacacacacacacacagacacacacacacacgcacacacacacacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcaggtaaatgatggccacaactttcctctcttccatctgtcaggggacagggggaggaaggaagattgttttgcaatgtgtcctgatgtttttgccattcaactgttggtggagggaggttggaaggaagacggccaccccagcagcttcctgtcacccgagcttgtctcggaagccccttctgtccttgttccaaccggctcctacctggctgctcaaagcagagacactttgaaaaatggtttctgcctcccctattctccccatttgctgcatgatttcatcttggtcaggaatttgggagagcttaaaagagacagaggtgtgcaagtaatagagaagtgagtctcagatgtttctataaatacatctctgacctcttcgaagggggcttgcctcacaggggctgttgtggagtaaacaaacctctttccagacccagatagcatccatggccacaatagtccctcgaagggaaaatgcaggtggcaggggccggtggggtggggggtgaacagcggcggggcagttgcagcctcaggactaggttttccctttctccagacctgtcttcctgggtgcgacttcccttcagcctcagacaaggcagctggaggtcctgagagaagtgagctttccagggagaagtggagggggttccacagtgacagccaggtctggagctgagtgtgtctgccgggtatgaggctgggagatttggggaaggggctgtgtctgccagcctgcaaccttttctgaggtcagcagcctgttgcccttgtcttgtctgacccagagcaggggaagtattcggttactagtatggcctatttaaacctttctgaggaaactcaaatgtttccggagggcttgaaggaggcaggcagaccctcacagcccccctcaattcacctcagtgacccctgactctccccagcaaagttttagttatgcctccaacatgagtctcataaatacttcaactgagacagaaatttcactatcgctgcctttgctggaaacacagggagggccagaaatgccaggctctcagagagggcacatctctgaatccagctcccaactgctgtccattgataaaaacagctcatcagcaagttgtgtagccaacgtttgtgggccatgagggagtgactcagagactggtgtgaggctaattataaaagtgtgagaaacagaaggaggtgggggcagatttgtggagaattcaggagggtgggcaggaaaggtgagtggtggtgtcaccgtgggtgtgtgcccacatgcccctgcaaattcaagttaagagcatcaagcttcttctaggagtgagtagtcattattcattccccagttcaagggagaagcttgagagttaatttggcctaatttggtggttcttaatcatgtttgggtcatggattcctttgagaatctgctgaaggttaggacttaaggaaactcagttttctggttctagccctgcctctgatgagctccctgacttctgagagacagtggccttacactataagcaccatgtggccagggcatgtgtctctcttgtactttactgttttcccagggtcagaacagtgcctggcacatagtaatcaataaatatttgatgaatgaatgaataaaagcttctcatctgcaaactggggtttaccatcattttgtattacttaatttaaatagcaccaaagtggttaaggagttcagaaaactagagagaaaagaacctctggttttcttttgaactctttgccttggagagcaccctggcacaacatagatatctcttaggtaagctttttgcagactgtaccaatcagggcaacagcaggataaagaagcaactcaggtggttcagatgaaaagatctgaatgaagggatcactttgagaggtgtgggcggggttaagggaaccaacaaggaatgctgaggcacctagagattagcaactgcaatatgcctttaccaccctgtgcttgaaaaggcaagaggggcaaataggaaaatggatcccaggcagatttggagccttagagaaggggccattaagcaagagcattggtcatggaaggccctaaagcagggagaaagtgaaggagaagtacaccatcttctctctcctcccatccaagcaccttttggcagcgcctctcattggccaacccaacttgaagccagagggcagagcctggaggtcagggactggaacactgagggcagagagccaaggggagggttgggatggagaacaaccagtgcgcacatccacaggcacttctggctgggaatgtggtcattagacattagggaaaacaatggaatagacctagcgggaatcactaaggtaaccagctcagtatcacaaagatatgttttctccggtggtcacttggctttgcccccctaatttagtcaccatggctttatgatagcacagttcagaaataaacttaagctttaaaaaaatggaagctgttccttgtaatcctttggaaatattttccaacagtttgatataaaatattctatattcagaagcttatagactcttaattcttctgaagataggctgtgtatacacagaaaataagggcaaccaggaaaatcttttcattctatgcattataacttagtgagtgcctactgtgtgcctggcactctaatgtgtgcttcaagggacacggagacaagtaggatgtggcctctgctctgagggattccatgatcacctgcttttgaaacacaggtggcgtgtggtaaatgccccggaaaggggttgtgatggaggaagagctctcatgggcctgtaagccagtacttaccttcatagataatccactccttcactgtcttcaagaaagactattccagcagtgccatgtgcagcaccagctatctggatcagaggttcattacctggcaacctcctctgctgggtcccagaggagaaccaggaaggagcaaaaaacatcagaggccagaactgatgatagaaatgccatcgctaaagcacataatatttgatacacacaaaactatttcaggcctttattctaagcctattaactcttactttgggcaccactctaatagacatagatagtccgtgacttgaaagctggtgattatatatagcatattaaattggggagggaggagttgctgcttaagctagacacaatgacggatgataagaatgattacaagaaaaacaataaagaattaggaaatgggcctgagatttcaaaaagaatagtaggccaggcgcggtggctcacgcctgtaatcccagcactttgggaggctgaggtgggtggatcacctgaggtcaggagttcgagaccagcctgaccaacatggagaaaaccctgtctctactaaaaatacaaatttatctggatgtggtggtgcatgcctgtaatcccagctactcaggaggctgaggcgggagaattgcttgaacctgggaggcggaggtagcagtgagctgagatcgcgccattgcactccaacctgggtaacaagagtgaaacttcgtttaaaaaaacaaacaaaacatagtagactagagctacctctagagcctctgctctgtctgtaacccctgaaggcgtcattgactacagtacattaactggttttcattatgatgaacatgaatggaccagtgatgactggattgtgcctactttatcttgcttaagaaggtagataaatgccatttatatattagaatgatttctattgaacatggcaattattaaaaatgccaagattcccacatttggtgtattgcgttaaccattggtgggtaataaaccaccgtgacacttggtagatcaaaacaacaaccatttattgttgaagttcatgtgtttgtgggtaaactgagggtcagctaatctagcttgggtttggctggccctggctggactcacttatgggtctgtggattgacttggctccagtatccacccacagtggtagctcagtagtagtacaatttccagaatgtggaggcacagacacaaagacaatgatatttaccggagggcaggccttccacacagtttaatttgtgtaattctcgcagcactcctgaatgggggcagcaccacttcccctttcagatgaggaaatggcagctcagaaaggttaagtgacttgcccaaggtcatgcagctgttatgtgggagagctggagactgaaatcctgcttctttaagtccagggctttcaccagtatataccaaatctccttatggttttggataaatagtgatattggcctttaaagtcctgtaggctaccctcctatcctctggaaactctcctctggattcttttttgtttgttttttcgagacagggtctcgctctgttgcccaggctggagtgcagtggtgcgatctcggctcactgcaaccctccgccttccaggttcaagcgattgtcatacctctgcctcttgagtagctaggagtacaggcacgtgccaccaagcctgacaaatttttgtatttttagtagagatggggttttgccatgttggccaggctggtctcgaactcctgacctcaagtgatccgctggccttgacctcccaaagtgctgggattacagccaccacgcctggcctggattctttattttccattccctcctgctttttcctcagtatatcaatgcccaaagctctagcaaaagattgaatattgctttatattaaagtgtgcatgacttgccagggtactgatttatctctgctttgatggttcttgcattttaatggaggttaaggatctaagctaaacaatactctagtgaaatggtgtcaaccagggtgtttgggggtggggagccaggggaatccacttcacaagccttccctttaggcattgtgagccgacccatccccatcgatgaccctgcagacacatgtggtttccctcattgaatacaggattttccaggaaggcaggactcttcaggtgatgtttgggtccgggtctcagaaaccagatggtgagaacacccaaatccagtcctgtagagtgagatcagatggaaggatgtgatttctgtctgggtactggaatcttctcctgttgcctgctgggatgtaacccagggcaggcattttgtggcctgtagggcctgatgtccagccccgtgctcccctgcctggaagccagccaggccaccacttgggaactatccatattcttggcactagattatggaccatttatttgtgtctgatgctgatcagctattgtttaatgctccgtaatgcacttgccagccatctcctctgatttaccgccccatatttcctatggataataaaatcagagaggattcttaaattaaagaactctctaaggggtcccaggcttcctgccaaccccatcccaagcctctgcgtgcagcagtgggctcatgtcctgttcagacacagagaggggtgggtgtgagaggtgggagactttcccttctgataagttgggccaaccccccaccttactgtttgccacactcacacctcctttttcagatccacagccaccactgccacatccatacaaaaacaacacagctccagagtgaacagagagccgctctggcttcgatgagacaccaaataacctcgtgtcccattttctttattttattttattttttattttgatttttttgagacggagtctcgccctgttgcccaggctggagtgcagtggcacgatctcagctcactgcaacctccacctcctgggttcaaacaattctccagcctcagtctccggagtagctgggattacaggctcccaccaccacgcccagttaatttgtatttttagtagagacggggtttcaccttgttagccaggctggtctcgaactcctgaccttgtgatctgtctgcctcagcctcccaaagtgctgggattacaggcatgagccactgcccctggtccccatcttctttaaatgcaattcagtcagaagtaccacttgtatttctcctatggactggcaccaatgattcccacaagcctcttgttttacaaagcactttcacaactacagttgtctttcccttcacagtagcccctactgtgaggggtcctgggtgcaaattgtgcctcccttggttatgaactgtgtgatggtgaagagctcatttcatgcagtgagccccaagtttctcatctgaagaatggatataatagtctctgtctcacagaattgctatgaggatttattaattcaacaaacatttcatgagtgccaactatatgcctggggatatgcagcagtgagcaagcagacaaaaatatcccacccacatggagtttctgtcatctctctgagaacttatccagtcctaagagatgaatgaaagacacgtgggacagagacggagtttgtgaaccagctgcccaaagaccaaatccagcctttatgcttagcccttagagtactaaaggtggggggtggtgatttctaaaaattgccttagtggctaacatttaaaaattgaatgctttaacatttaaaaacaaaaagtatttctgatatctattcagcaaaaaaattaaataaaataaagaagcaaacatcttgaaaagcaggacaagctgctggacgcacgttctggccatcactggaatggagcttctccagctcaccaagtctgctcttaacccccatccacctcccttactacatctacctctctagccccctctgggcatgtgactctggtctctgggaccaggagccctgctggcttggcctctgccttccccttcttctgcatctgcctagaatcccaaagctctgcacagcttagtttgaaagtcaacagtctagatcagagagtctcaaactacagcactggttcccagccctggttagacaaaagaatatgcacccaggttgcattatgaaagtccagagtccaagctgagcagacgaattagatcagaatctctggggtattggatcaggcattgggaatgcttaaagtcctccaggtgattctaatgtctgggcagggctaatcactgaactacggccagcatggaaatcacctggagggctttttaaactgcagaccactgagacacaccctgggaatttctaatttagtacttctaatgtgaggcccaagagtgtgatgctgctggtcggtggaccatgctgtaagagcctctgttctagctcacctctgagttcctttattagtttcctatggctactgtaataaatcatcataaacttagtggcttaaaacagcacacatctattatggttctggaagtcagaagtctgaaatcaaggtgtcgccaaggccgagctccctcagaaggctctcaggaagcatccatttcctgccttgtccagctctagagctgcatttctttcattctttggttcctggcccctttctccaccttcaaagcaagcagcatagcatcttgcttcagtggtcacattacctcattctgtgtcaaatgtcctctgcctgtctcttataatgacccttgtggttgtatttaggggccacccaagtaatccaggatgatcccctcattttaaacttcttaatttaatcatatctacaatgtcccattttccatataaggtaacatttacaggttccagggatcaggatctggatatctgtgggagccgccacaggttacctagtttttccactaggtaaacagacccacgagtgttttgttaaagtgacatcagaatcaaaggcaccgtggtgtgtactgtcttcatttgggttccttctcagaagcggagcctgagacaaggatttgagtgcaagtagtttatttgggaggtgatctcagaagggcagtggggaagtgagacagggaagagaaggcaatcagtatggagtgtgttcgggagcaggttactgctatgagcaactggggctcaattctactgggggccttagggagacaggcaggggactgggatatttatccatcaactcctggggattttcaccactctcttcttcctgcttaccccaaacaacttcccatggttggagaagcgctctggcatagacacaagactctgtagtgggaagctgaaagcatgagcaggatcgacgaatgggcgggattgatgaatgtgggcagggaagtgtcctctgctatagatagtgtgagagaacagctgtgtcctgctggcccttacacagttccttgcctccatcgcctctctggacagtaacagttatagctcagcagcccttccctgtcgggatgcagaagttgggatccagcgggccatggaaccaccactaaaaacactaaagttacctttcattgagtattttctggtcaccagactcttgacacatattatatttaatcttcacaacaatgtcacaaggtagccattagtacccctattttactaaagaagaaaggaacattcatagaggtgcagtcacacagtgcctgggtcaacattccacatcagaacttctgaccccaaaccatgacaaaggcagaatcgcagagtggttaggagtagggcctctggtgccgcactgctggagttcaaatcctgtgttcccttagctttgtgaccttggcaaattaccctgttggtgcctcagcctcctcgtctatgaaatggctgtaaaagcaggatttcactcccagagaagttgtaaggattaagtggtctaattatgagcataaagtactttcagtagtgcctggcatacaatgtgtgatatatacatatttcctgtcattctttccagaacctcttggtgtctctacacatggcaagaggtcagatctttttccataattaattgtgtcaaaaggcaaaaatcccaaatacaacccagagaactttttgcttaaaatatccagtgagttacggcaaaaaagaagagactcagcttccacccactttgcatttataaaccagcccctaaagaaggaacacgttgcccagagaaggaggcttctcgtggtgaccggcttccccagatgctttaaaaatacacctggccctcttccatctcccagcccaggagcatttagctccattcaagcccgcacttatctctcatggcaaccagcataaacacaggcatggggcgcgtgtttgggagctggtgacagctgaaggagaggcctcgtggctgctacaggctttgcaccatcaaccagctgcgggctgcaaatgaaaaaagagaggaaagaaaagaaggaagcatcggtgtgagtcgggcaggttcctccctcccaggcatcccacactttcctcactcatccttctgtaccactctcctcttccttctttgagaagtttggagaaggcatcaggagctttcctgctgctgctgggagttctgtcctgggaccatgctccacagaggactttccaggggtttcgggcctggcatggggcttcttggggacccgggaagacagggaatggggcgacattggccatcctacttggagagactttcctgcccacctgctcttcttacttcactaggattccgggtttgttccagtgtttggacttgtcccccgtatgaggggactgtcgggtgggttatgatcatgaggagttgaaactggactgccctttgtgtccaacagggccagcttggcttctgagaccgtccttactggggtggacctcatggagtggcccccaaaaggtttccagattctctgtggtcatctggaaatgaaattctcaaccactgagcacagtgtccaggaattagggaggctccaggtgaggaaacaatctgttttccttctgtcgatcttctcgagagctgcgtggagcaaggtcatggtagggaaccatcatggtggaaaacacaggagtcccctgtctctagagagcagcagggccctgcaggagcagcattggttgggtggtttgtcccctcactcttcctgtctgccagtagaaagtgaggattgaagggccgaggtgactttaggaacaatctgggccccagaaatgctttccccagagtatctgctctggcccttacttccctctgctgtggagtcctgagaataagagtgcattggctggacaggcttaggagccggctgccctgggcatgactgccaagattattttgttcatgtccagtagaagatcatatggagacatgtaggcagggggttggccatttgcctgtttacttgtgtttttagacagacttgcagcgcagtccttaggagttcaggtaaaattaggacacatctgtagtgttggacaagtcatttgctctcttgcaggacccagtttcctcatctgtaaaattaaggggtggaccagactttaaatatcctcttagacttagactttccctgactttgtggctaacatgctatttgcaaatttacagaattagcacccacacaaagaaggggtcttggcgtgtatttctcttctgagcattggcactgagaacccattatgtgagagtaaaaggcatggagttcccattcacacagctctggatttgagtgagtctccgtaacccattagctgagagatcttggccatgtgatctttgttttggtttccttccttccttccttccttccttctttccttcctctctccctcccttcctcccttcctcccttcctctctcttggtctctttctcccctcccctcccctccattcccctcccctcccctctgttcccctcccctcctgtcccctcccatcctgtcccctcccatcctgtccccttccctccttgtctcactctgtcaccaggctggagtgctgtggcaatcacggctcactacagtctctaccttctgggctcaagggatcctcccacctcagcgctccttccagtagctgggattacaggcacatgccaccataaccagccaagttttgtattttttgtagagacagggttttgccatgttgcccaggctcgtcttgaactcctggggtcagcgatccacctgccttggcttcccaaagtgctgggattataggcatgagccactatgctcagccacggtttaatttcttaatatttcagtttccacatctgtaaaatggagataataagagtctccattttagacggtgatgaggataaaatgagctaatacctacagagctttgcactgcacctgacatacagtttgctctcaattactggttgcaaccattattccaaatggtggagagaaactggaattcagccacttgcctcctcctgggatgtttcattccactatcatcccatctgctttttttttttttagacagagtctcgctctgtcgcccaggctagactgcagtggcgcgatctcggctcactgcaagctctgcctccggggctcacgccattctcctgcctcagcctcccgagtagctgggactacaggcgcccgccaccacgcctggctaattttttttttgtatttttagtagagacggggtttcaccatgttagccaggatggtctcgatctcctgacctcatgatccacccacctcggcctcccaaagtgctgggattacaggcgtgagccaccgcgcccagccccatctgctcttattcggtgctgaagattccagtttcagaactgagactctctgtctaaagcctgaggctgagttggggacatcccagtgcacaggctatggaaccggaggtctgggttcagaatcccaactccacaggaccttggatatcatagaatcaattttcctcacctggaaaaggggaatatacaatccataacatcattgcaaggatccaaggagagagcctgggaagggcccagccctgggcctgggtcagaatatgtactcaggaattactgttgtactttgaggggcaacatttgactttcaggacatgggatgctcacacctgataacaacaccttagccattctgagttctcagtagaaaggtctgctaaccagcaaagttcacaggcaggagctcttcctttggctgtgaaggagaaagcttctccccttctaagacaggggtgatcttaggaggaaaccccacaaggcactgcaatcctgagagtgtccactttttggaaattgggcagctctatgcaaaacctagcaagaagacaagccacttactgtatctagttcatccacatcagaacagaccctctgtccacatggcatctgtcttgcatgcttcctttgaggtgacaatggccatcaagtcaccaggcctgcctagtgcaggtcctcctgggcagtcagaggaaaatgattaaatatgagattttcaagtggaatgccagcaaatagtggctgatttgacatagatgcccaatattctggccatatacccatctgctgccgctttgcattttgctcaatgtttatttctaattgaagcaataaaatccatttgaattgattaagatcctccttcttcttatagttattatgtatgtaattttttttatttttagtaaagacagggtctagctatgttgcccaggctggtcttgaactcctgagctcaagcgatctgcctgcctcagcctcccaaattgttgggattacagacgtgaaccactacacctggcctgcagtgtggttttaattttcatataattaaaattatatacaatttataatatataatttaattcttatataatgaatgagactgaaaatttgcccatttttcatctatcggatgggcaaaattcaaaaggtgtaacatcagactgttggtgaaggtgtgtggaaacagacactctcatccactgctcctaggaggggatgtgaattgatgggggctttgtggaattatttgatgaataatttgatgaattattcacttatcaaacctggctttccgtctctagattcattatggccattacttaatatacatagcatttgagatacttcccctcaatcaaatgaccagtatttattgtaccgcctacaatatgcttggctacttgttatacaaatggttggagtttgtgtgagagcaaagcaatcaagacagggagacaacccatctatgttcaagtcagactctaccacttacctgggcacttatttgagcttcagtttacttatctcagataagtaatgtttcaaatgaaggcaacattccggttgtaggccgatgcttagcacatagtgctcaatatgtgttgttgagagttgtgacagctggcgttggcaggctacctaaggtagtttaaagactgtttttgtgttctgctttaggccacaggaaaacaccagaataagttacaaatgaatgaagatttaaatataaaatatgaaactataaaatgattagaaaaaaccttgtgagattttttgggtaacttgggtgtttggaaaaacccagaaaccataaaagaaaataattatacattaaattctgctacataaaaaaataatgtgggaggcgagaattctaccactgaaccaccaatgcctctcataaaaaaataatgtgtggcaaaaaccaactcaaaaggccaaaacaaactagggaaaatatttgcaagccatataataaagtgtttctttcctatatataggaaaaataatgtaagagaaaaattgacaacccaatgaaaaaaatggaaaaagtataaatggcttcaaaatgtttgaaaatattctcagtctcatttactatatgagaaatgaaaattaaaaccatgctgaaggctaggtgcagtggctcacgcctgtaatcccagcactttgggaggctgaggctagcagatcacttgagcccaagtgtttgagaccagctggccaacatggcaaaaccccatcttgctaaaaaatacaaaaaattagttgggcgtggttgcacacacctgtagtcccagcttcttgggaggctgaggtgggaggattgtttgagcttgggaggtcaaggctgcagtgaactgtgattgcaccactgtactccagcctgggcaacagagtgagacccacttttcacctatcaagtaggcaaaattcaagaggtcaaacatcagactgttggcgaaggtgtatggaaacaggcactctcatccactgctcctaggaggagacgtgaattgctggggcctttctggagatgaattaggcaatatgtgtaaaaattacaagtgcccatactttttgacccagtatttttatttctaggaatttatgtaatggatagtcttaccaacatacacagagatgcatgtggaaggttatttagttgcattgtttgcatcagcagatgtttgcaaatcatccaaatgcacatcaatgggggcagaatgaacaaattatggttcttccaaagaaagggatattatgcagccatagaaaagaaagtggggtggcacggtggctcacagctgtaatcctagcactttgggagggtgaggtgggaggatcacttgaggccaggaatatgagaccagcctaggcaacgtagcaagacctcatctctaagagaaaaatagaaaagaaaacaatgtgcatgcattttatgtagttacagaataatttcttagaaatactgtgaaaagcctggtgcactggtgtgtgcctgtagtcccagctactcaggagactgaggcaggaggatcgcttgaatctagaagttctgggctatagtgcactatgatgatgggatatccacaccaagtttggcatcaccacagtgtccttccaggagcggggtgccccattgctcagggaggggtgaacccgctcaggttagaaacagagcaggtcaaaactcctgtgctgatcattagtgggattatgcctgcactccagcctgggcagcataatgaaatgctgtcttttaaacaaaaatactgtgaagaaaccaagagggagtatcatatgtataatagaatattacaagtaaccctttgagtaaaagggggaaaatattatacctacctatttgcttgtatatgcacaaaatattcccagaagtatacatagaaaactaagtaatggttggtaataaataattggaactgggtagctgagggagaggggtaggagaaagaattttaatgtatacttgtttgtatgttttgaattttgaatcacatgcatgtaatacctattctaaacaattaaacaaaacaccatctgtacaaaatactacctttcatctggagcacaagatggaattttttgtctttaaaagtccttagatccaaagcagcaaggagaattgagatctcagagagtttccagattggtagaatcacaggattatagtgctgcaaaaagcctaaggtttatcttgccaacttgctcagttgataagtgctagtgctcaactgagtccaaagggatcaaccctaggctccccaatttctggaatccaagggttttagtgactttgagaccaatgggtagagaagccagtctgtgccagtgggcagccatgggactcccaggaacccagcctccctcctccccacctgttgtggacccttggacaatagatcctggaggtgggatggggggtgcagggatggatctagggaaaggaataagtgagccaggtggttttgaattacaagtgcctatagagctaaactgtcaccatggaaaaatgaaggcatggaaacgtagtggctggaagcacagggtctttccacgcagtcacagttgtcagcaggtgttggaaataacccaccctttgggcccgatgcagctggaaggttttgtctctgacctatggccagatctcccgaataattctacaaacttgtcctcccctgtcaagcactggcagaagatttaatagcaccggctgatttatgttggctgctgtaatcaaattcagagtcaaggcgcagccagccatggagaggtttctttatgttcccttggctcctaatagcattgtctccgccttcctctctacttaccacatgccatttggtcaaattagaacttgaactcaaaaagcagatgcctttctttagataaggtccaaaataattctcttgtcagggaaagggggatggatttgtttccttgactctgtgtgtgcaaaggaggtatttttgatatatgacttatataaaataatgaccgacacgagatgactgattttctttcatccttgtagtgaggatagacttttcctcctcaagacatctctgtgggttaggggtgggagacagaagagaataacttcttatatggtttgcagtgattcaatgacctgctcaaggcctctcaatgagcggcttcaggttcctccaggtggcactggtgccttagctctgtgcagctccaggggcccctagacatttgccaacaagggagttgggctgacctactcccaaccctaatccttgtgaacatatcttctggttctctgttgactatctaaaattttttaatggtattctttttaaaattaggaataatttcaaacattcagagaaagtaaagataattgttcagggaacaccaatatgtccactgtttggggctgaattgtgtctcccccaaattcatgttgaagccccagtaatacccagtaccttagaatgtgactgtatttcttttggttttggttttggttttgttttttgagacggagtctcgctctattgcccaggctggagtgcagtggtgcaatctcggctcaccgcaaccttcagtttccgggttcaaacgactctcctgcctcagcctcccaagtagctgggattacaggcacccaccaccacacctggctaatttttgtattttttagtagagaaggggtttcaccatgttggccaggctggtctccaactcctcacctcaagtgatctacctgcctcggcctcccaaagcgctgggattataggcatgagccaccatgcccagccagaatgtgactatatttggagatgaggtctttataaaagtgattaagttaagataaggccattagggtgggcattaatccaacttgactggtgttcttataagaagaggaaatctgaacacacaaagagacacgaaggatgtgttccgaagagaggccatgtgaggacatggcaagcaggtggccatgcccaagccaaagagagaggcctcaggagaaaacaaaccagccacaccttggttttggccttccagcctcaaggtctatgagaaacaagtctctgttgtttaagccattcagtctgtggtactttgttaccccagccctagaaaaccaatacacgaaccgcagcgattctgcactggctatcattttgctgtaattactctatcatatatctgtttattaatcttttttattgatggatttcaagtgagttgcagatttgtcaccctctttgaagaatagaataggggaggtaaatccatgtttgattgaagaccaccagcacacctgattgaaccctctctgtggtcgggataatcagagattgtttactcatgggagtttacaaaccaggaaactgaaacccagagatgaacagtcattgggtttgattggaaagacgtgattctgggcgttggtaagtggttccaaccttagctggctgaggcgacacttctggctcttttgggtgccatttcttctgaggtttcctgctcattctctctaggtggtggtggtggaggaagatctccaccgtgtgctggtaactgaacctccagaagtctctggagtcagacatccagattcaatcctggcctactgcctactggttgtgtttgaccttgggtgcatcccttaatctccctgagccttacctgaaaatgaggatgacagtactaatatataccttgtggggctgttgcggggatcaaaggattgaatggggaacatcacggaatgtgtcccattgttggcacctcactactgggttagggcaatgctatctgctgtaacaggtgagcattttagtggcttatcctaatcaaaatttattttttgctcacctaacagtccatgtccctggttgggggcagtgcacctccattctggcattcaggggtgcaggccctttacatcccgtggctccactgtcccccaggaattgagtctgtgcacccaggcagaatcattggcaagaataatgacatgcccccatctctctatactgcagagggctgggaaatgcagctacttcacagggctcactctggcctatggaagagggagcacacattttggagggaatgttagccttttccacacagtctcaactcagagaaggtcctctgatgggaagtcagtggctgggagttagtagaggaggcagccagctaacccggaaactgccccaccagactagagcagtgaggacagcaggaaggttggaagtggttgggaaccagtgagccatcaccaagggtcagcgtcagatgaccacaggaggtcacctcctcctagggctgtgtgcaaggtgcctttggaactctgaccccaattctgtacttgctatgtggtccagatcaagtgacttaacttctccaagagtcatttttcgcctctgtaaaatgaggataatcagttgtgagggttaaatgcaataatgcctgggaaatgctgagcatgggtcatcgtcgtttcgtgatgtgggttttgccaaacgagtctgcaagtatgcagcgcaggcaatgctccttcccctcatctcagggaggatgatactaacaagtcatgaccctctttcctcagagtccttcttaacacagcattccaggaaacctgtattcatcagtgcaagttaggccgggcgtggtggctcacacctgtaatcttggcagtttgggaagccaaggtgggcagatcacaggaggccagaagttcaagaccagcctgggcaatatggtgagaccccgtctctactaaaaatacaaaaaacagccaggcatggtgtttttcctgtaattccaggtactccagaggctgaggcactagaatctcttgaacccaggaggtggaggttgcagtgagccaggattgtgctgctgcactccagcctaggtgacagagggagactttgtttaaaaaaaaatttataaaagactgggcatggtggctcatgtctgtaatcccagcactttgggaggctgaggcgggtggatcacctgaggtcaggagttcaagaccggcctggccaacacagtgaaaccccatctctactaaaaatacaaaaaattagccaggcttggtggcaggtgcctgtaatcccagctactccggaggctgaggcaggagaatctcttaaatccgagaggcagaggttgcagtgaaccgagatcatgtcattgcactccagcctaggcaacaagagcaaaactccatctcaaaaaaaaaaaaaaaaaaaatcagtgcaagttagcagatgagatagatgaaaactctttgttcccaagagattagtcttctacaagactctcctgagtaaacaaaaccattggatctagaggtgagattaaagaaaaaattattctgacactggttaaaatggtgaggaagactttatccaagactattgcaataggtttaaagactattgtaataggacacagagatcaaccttagctccattacaacaaggacaagtggggaattatagccaagaagcaggttgggtgggtcagtggattaaaaactagtaagaggagacatcatgatagggggattttggctgaaacaacttaacaggattcttgctgaaggcagaccaggttgatcagttctcaagggtgggggattctctctaaactgacttatcaagattctggctataactggactctgcaaggatggacacagaagcccacgttcaaagcctagtcaagaggagggctcaggggaacctgaccaaagcttggccgaggaaagaatggttgtcagtgggaaggtagaactcaggtcttcctacctatttctctgcccaccaaggttttgggatgggacagcggatgtgaagtgctccagggctggtgggagccttggcactgccccaaacaggtagatgtctttgcctctggatccctgggaaggctgtgggagttatctatgtcacacaggctctctgtgaggtagtggtgggagacacagcaggagcagcatgcaaagcagaatctacttcagccccatcggcagggaacaggcctgtgtgtggcagcagcagggacaggagcacctggaacagctcccggggatgtcgtattccagaagaggtctctagcctggctgataaatcccagagctgtaattaagacaaaatactgtgaatgtgacacctgctgacagctgcaggaaggccccagaaacttgtattgtgaattagattttacaggcagctcttgccgtggtgaactggtgccaggctaaggcacctgagggaacttgagggcaaagattgttcaccaaggggtaaaaggggagatccttcacccctgtctaggaaccactgatgtttcaggaatcacagaccctgagagatgccaaagttggaaagggcttagagctcatctggtccaaggctttcattgtacatctagaaaaatccagacccacaggggaaatgggttgtcctaggtcacacagtgagttagtgccagggctaaagaccagggctcttaatcccaggctggcacacttggctggagagcaattaaaagtagttgagcatacatccagaaatttgacttaaattaaatggtgcatgcttggaaagacagagacaatgccagagaatgagacaaagttatagatagagagacacagagacagagaaagacagagacagaaaagagagtagcagaaggagagaaacacagagaagaggcagaagatattcgtgaacctgaaccattaggttcaaatagagattcaaacacctgccaagttggacaggaccccagcgatcatctagtccagctacttttgtttttacaataatgaaacaaactacagctgagtggtttacatatgtcaaacctttttagaaaaagtttgatgccatgtggttaaaaaaaacacagtaagtgcttttggtgtgaaaagtggcaaaacttccatctctgaaggtttgcgaaatgaaatttgaaaaatgaagagctgcaagaatatgactcagaatagagaaagtcaggaaaatgtgatgcagatacttctgcaactctctaggactcaggactgaggactccctggccttattgctactttctctgaggtcttagacccagtttctgagaaggacaaaggggaattccccagagaaggaacacagcctaagcctcacctcccactcctcccatcttgatatagcaagtctctgctttcaagtatcagctcaaatcccacctcttccaggaatccttccttgatatctcacttggaccctctacccctcaaccgttacccatttcttccttctataaatcccttcaggcatccctgccctatgttagccactcttctttttttaccttatacaacagttatccaagaatatgtcaataagagagcccttattcggtgccaggaattccaaaagctgtagctctaatcctcacagcaaactatcaaagtcggctttgcacgcccactttataagtaagaaagcttagactccgaaagaatgaataacttcctcaaggtcacacagctactaagtggcaaaaccaggacttaagcccaacttggatgactccagggccagtactcttcccgtgacactgaacgacacattccaagggcgggaactgtgtctagtcattatgtcttgcacaatttggtacttactgtgtttctgaatgaataaaacagtaaatgaatgaatgaacataagtgtcctttcttttgaaggttatagtgcagggcttggcaaactacagcctgtgggccgaatccagcctgcctcctatatttgtgtaaacttttacaaaacatgaccaatctcattccttcatgtattgtctatggctgctgtcctgtacaatggcaaagtgaggttgtaacggagaccatgtgacccacaaagcctaaatatttactatgttgacctttatagcaaaagtttgctgactcctgctatagcttatggtctttactaagctgatcaaaacaacagtgcttattgctaagtagtataataataatcttgtcttttataatctaaaatattgtgtgtgtccatgcttgtgcactgggtgtgcctataaagtaccagatagatttaagcatgtaactggtatatgccgcttcatccaaaaagacttgcctacatgccctttggaaatctatatattttgtttgtttgtggtttcgttgttgttgttttagttacgtttagctttgtcagcaacactttggcccagacaggattagagctgagacccctggccatgaaggtcttccctgaagcagaggagggcaggctccccttggacggtctcggtggggggttgactttgaggcttaccagagcagtcaatactgctgtggtattttgagtcaagtcggtttttgagccaaatgaaaagcagcctgtttgattgctctcaatttcctcttggcttgcagggggataagtatccctgggctcccaacctcatatcctcccctgggctgaaggcactcttgtcctccaagcctcccctacagcagtgttcatgggcagctggagcagggctgcctacccattgctactcccaggagctcaggactggctccagacccctggcatctggagcagaagcaacatcaaagcagggattggccaactcccacccctaatgccaaacaggccaggcactgggagcactcagaggcgtgacgaatctcagcctgtctccggctagtgttccctggccagtccgctttgggccctgcctcacaatgacgggctcatcattcagcctcgctcatctgctcatcatttcaggactgctctgttactcggcaggctgcttgggtgagttgtgtgtgcgtgtgtgcacgtgtgtgtgtgtgtgtggatgcacatgcattgttttggaaaaaagactcttggaaagcagactgtactaggaggttttagcagcctttaaattttttttctttttaagtttttctttcacagggctgtttctcattgtgaaagcctttaaattttaaactgctcagccagtgttgaagttgcaatgcaaaggggtttcacagtagagttggtggggacctggcgtacatgctaacgggtgtgtgcacttgtctgtgtccctcttgtgaccttgactgacacaagtaccttgtgctggcagctggtaccttggctggcagctggtaccttggctttgaagtaaaatcgtgttctgtagtctgggcccccgctggcgttgggtggctgagacagtctccatcactcttgagtggactgccttgggtaatttggctcagaggcacagccaccaaaccacaaattgttctttgtaggttgtatccttgcctgctcagggacatacagcagaaggcaaactctaccatgttctttcagagaagttcaaattacgtgcaacttttaggatcagaatttgtctttcaaggtttgttgtggggattgaaggaaaattgtagggtgcagccttctctggaacatgtgaattggggggaattttgggcaaattgcattcagttaatgtaagaactttactgtagctgagacccaactcactacaataaagtcaaagcactctgagctgccatacagcgtgtgcccttggctttctctcttctttggggtctgtctctctcatgcaagttcccacaggcagggaaaggccccaaaagaggaggaggaagtaaaaagctgactagtccaccaactggacaggcaggtgcagaacagttaaatggctgcacttgtaattctctcaacctgctgaggcaggatgcttatgtcacttctttcctttgacagtttctaatgacacatttgttggattgagggggtgggagggaaggctacttgatggaaaaacagaaggcagaaatggaaatggctatttccagtaacctattgtggggctggccttgcaagagggtagatgaagatggatacagtggtggttctggtgtcatacttattttaaaaagggactaaaggaggccaggtgcagtggctcatgcctgtaatcccaacactttgagaggctgaggtgggcggatcacctgaggtcaggagttcaagaccagcctggccaacatgacaaaaccccatctctagtaaaaatacaaaaattagccaggcatggtggcactcgcctgtaatcccagctgctcaggagactgaggcatgagagtggcttgaaccctggaggcggaggttgcagtgggctgagaacccaccactgcactccagcctgggcaatagagtgagacttcgtctcaaaaaaaaaaaaaaaaaaaaaaaaaggcaaaaggactttggagatgatttgggcaaaactctttgtggtacagatgaggaaactaagtttcagattgagtaagtgagttgtactggctcacatggccacttgcacctagacttaacactctttaatcaaatccatgtctttccaagagtaaattggagaaaatcgctttccaaagatgtgcctcagtttcttgaaatgaaacaagagaaagtctccttttcaagaatgggtattgagtccaaagggcaaaaccagcatcatcgacaacaaaagcttcaaacacttgccaaagcctgcattaaacaattacccataatttggcaatgcactggccacatacaacatgagcttgatgtctttaagttgggacatgcggtcctgaagttccgtgatggttggcatttccaaggcagctgcctggtgctgagccacgtgctgctcccaggtttctgcaggctccacggagatacgcacaggattgctttcaatacaacagagccttccggggcttttccagactggagcctgagctcagacacaattctatagagacagtccatgagaaagacccacaggccactcggatgacaccaaaatagacatgtgaagtcctggcttagttgactgggagggaggagggagggggaagctgctcccaaacacgtccacctgatggaaatattctgaacaggaatgagctgtaaataaactaggctcctaaaaacaaatagcttcagggagtcaggggagggcagaaatagatggccttcccctgctgggaagaaagtgggtcaagggggaaagggtgagggggatggggtgggggagccgaacaatgcagaagcctcagccagaaatgcagctgataatttgtggtcactgaagaggtctccaatttccaggaagaaaggagagaagtgattgctttaaatgatacaaggtccttcatcagtggaaggccacacagggtgctgggtgaaggaaggcactggaggccatatatggtctggaaaaataatggtgatgagtgcatattagcagtgtgggcctgccagcctcccaggtgcttttggaacactgcagcctcagcccttagctgtgtgctgaggcaaaagagaagcaaaggagaaactgtagccaggggaccttaaaaacgttccgggattggtgtgaacctgccagcctcctccaccctacaactgaagctgcccactcctagcgactcaacactctaggaaacttggagaagcttgaggaggaatacattggcattaatgtcaagttcgggaacaatgtatccatattattttaccactgagaaaagtagcccgtgacagctggagctgccctgactctcagagctcggcatggtgttttgcaacacagaagcgatgtcacagaacaccaacttcagacagggtcaccctgtgaccttgatggattgagaagaaagtaagaatcacttgataatcacaactgaacacagacgaaaacaggactatcatccaaccacaaaagtaactaaacattctcctatccttgctaatatgagtgattgctgctgtttaaaaaaccaatcacagctttggtcttgctccactctcttctagatatgaattaaggtactcaattatagaatggccctttcttcctgatggcatccaattcagagtgaagccagacttcatttcctcagtctcccctccatcacttagcaaaatccccaaccctaggatcagtccttcccagcatcctctaactgagatgccccacggttccttccggtgtgtgttctccctctttgcagtgagtcaataaacccagcttggttccctgaagcctttgcttggagggcactgatgctatagccccaagttgttgttatgggacttgaagctccagaccttcatttctaccacatgcagtcatggtgtagagctcaagaggaagggctccggaaccagactgcctggctctgtcacttactagctatatgacttcggacaaattgcttaacctctttgcctcagttaatggatctgtaaaatggagatgatgataacaagagtagtacctagctcttagggttgctgtgaggattaggtgaatttctatgtgtgaatcacttaaatggtgccttgcatgtggtgtttgtcattattaattcagcaaacgtttgtggagtgtctagcatatgccagatacagtgctagaccctggggataaaagctggctcctgctctcccagaaagcacagtttggtcagagggatacaaggaaatagtttttccccatggaggaaacctaacataggggtaaacccagagaaaaacagcagggccactcaatcttgcctgggaagtcaaggaaagcttcctggtggagacggcatctagtggaggctgcttgtgggagggcagggagtggggtacaagcagaaggcctctgagctctgcaagcctttccaactacagatgccatttaggtactttctgcttcccacaggcctggcccagtgcctggcaaagagtgtgctcaaatgaataaatgtctaacacccataaactagtgcctgctgtgacttttctttctcaaactctgaccactgttgccctgggtaccctgcaacttcaaaaccacccttgattcttcctgcttcttccctcctgcaacatgttggccccgtttctctgcatcagtccctcccttcctgtcccgtgccctgctgcatgctcccattctccaagcctgtcctccccacacctgcaccttccttgcacacagtgttctccagcaccattttgatcctgtcactcctttaccctgcacctgccgtggtttcctacgactttccaattaaagcctaaacccttttgtggggtatccaaaacagcacaatctagccccaaattaactttccagctttccctgcatcctgaccccaacagtcactattcctttaagataagagcttcctcttcagtgcaatggcacaatctcggctcactgaaacctctgcctcccaagttcaagcaattctcctgcctcagcctcccaagtagctgggattacaagcatgtgccaccacggccagcaaatttttgtgtttttagtagacacggggtttcgccatttggtcaggctggtcttgaactcctgacctcaagtgatctgcccacctcagcctcccaaagtgttgggattacaggcgtgagccaccacgcctagcctgtttgacatattttggagtgcctgtctgcctggccttcctcaggagaaactcctcccacagcctctgttgagctggtgacagaccctgagatcctgctaaagactgggtctgagtctggtccagggcaggctctgcttagctgcccccatgacctgtcacctggctgggcaaacagattccctgtggtggctatttgaactaagacccacaaggggatgttccagacaaagcagatgggggaggtaaaagaggtgaggcaagactgggtcagccgtcatggagagatgggcgtgaagacgccaaagaggatggaatggatcagatgcacagaaagaagcataaaaggggagatgggggacaggggatcgaggaaggtgagagaaataccaggacagtgtcatgtcccattgactcattggctccagctctttctgacagttgttaactttacaataaatctcctttttccccagagcccatgtgagtgaagctctgcttctcacaatccaagtagccctgaatggaacatgggtctttctcctgccattcctcccgctccctggggagcctcccctccttccatcagccacctccccagctagcccttcaaggcctagctcaagtatgcatgacttccccagatattttcgtggtctggaagtcttcctgtctaaattctccttgcttttccagaattagcatgaatgccctctttcccaaaagacagctaggtttatcccagctggtggccacctgttgttcctgtttttctgaattccttcagtccctcgttaacttgtatgacctggagtggatgctgctttggcgttgagtgctgggttctatggaactttttgtgaccaagctaagcaccaagcattggataggccaacagttttcactggggccattttggaaattttcaaggtatttttggttgtttcaaaggctgggatgggtagcatcactgtctgttgagccgggtcaggagtgagagctgtcttgcaaagggtgggatagaattgtcccacatcctccatgactttgaaatgtcccaaggaacattcgtacttatatataattatctcattctagaactgaattctcttttacacagcattttttttttttttgagacggagtctcgctctgtcgctcaggctggagtgcagtggcgcgatctcggctcactgcaagctccgcctcccgggttcacgccattctcccacctcagcctcccaagtaggtgggactacaggcgcccaccactacgcccggctaatttttttgtatttttagtagagacggggtttcactatgttagccaggatggtctcgatctcctgacctcgtgacccacccaccttggcctcccaaagtgctgggattaaaggcatgagccactgtgcccggccttatgcagcatttttaaagcactgttataatataaattgagttttctaagactacaattatggagtaatggttgtgctttatctagtcgggaattttacccagtgttgtttattatttcagaaaatcacatcacatggtggacacattccttgtagcatgagacttgccaataccataatctttatttgagctgttgcattcactgtgatttcatgtaagtgtgagcatcaaaccacagcattatgtattctaatatggttatgtctgaccacttataatcaaaatgtttacttttgtatcataaatcactttcttttttttttttttgagatggagtctcactctgttgccaggttggagtgcagtggcacaatctcagctcactgcaacctccatctcccaggttcaagcaattcttctgcctcagcctcctgagtagctaggactacaggtgcatgccaccgtgcccagctaatttttgtatttttagtagagatggggtttcaccatgttggccaggatggtctcgatctcttgacctcgtgatctgcccaccttggcctcccaaagtgctgggattacaggcatgagccaccatgcctggcccataaatcactttcttgtatttctcttttatgtagaattaagagcactgtattgattttttaaattgtctgtcagcgtgctgtactatttgtgaatttcatttccggataataaaggtgtctttataaaatatttcccgtaaaaggtcgctttaggcctgagagggctgagggtctttggcacaggccagtggaatgctccatcatcaagggtgcgagcgagtgtgtgtgcacggagctaccattcccgtggacaccgcacgacctggcgacttctggggagcacttagcacttgtctagtgtctgaggcaggtcctggagcacaaggtggagatggtcggcagatgctggcccctgggagataagacagaaaactgggttcaaggttgagagcctgtggtggtcaatgtggcgtgcatgttctgtgaggtcagaggtttcgtgaaggggtggaagtgaaggtacatcgtgacaccaaaactgagaactgaaaaaccatagctttgggtgattatggatattgctgctatgaacattttaatacatgcattttggtgaaaacacacccacttttctttttttttcttcttttttttagggccatttcaagagaaatttttactttttggtataaaaataaaactataaccattcaagctggctcttaactaaaacgtttatcttgaaaaatttgcaataacccccactggattcattaggtagggacacaaatcagggctttctcagtgcaaacaccagagaacatatatatggtcctggccaatgcccatcattcagagatgccggggaggagattcaagcttggagtcagaacctgaaactttaaagatcacttgcaatcatgattctgaatgcacccacttttctattggtaaaaacctaggagtgaaattgctgggctagagtatatgtctatgttcagctttaatagaagataacaagcaattttccaaagaggttggatcaatttacattctggccagctaatgtgtgatagttgtggttgttccacatccttgccacatttcttatattctgtcctttttgctttagccattctggtggatgtgtagtggtatcaacccaatgaacatcagcgatgttcagcagaatggatgagtaggttgtgatatagtcactcagtgggacactattcagcagtaacaatgataaacagcaacctagatgatttccatagacactatgttaaaagagagaagccaaagacaagagttcatattgtatgattccatttacataaagtgcaaaattagtcaaaatgaatctctggtgttagaattcaggatgggaaggggtgcagagattggagcttgaaggagcttctgggcactggggaatgctgtttcttgacctgggtgctggtttctaggatacgtccaccttatggagatctgttgaactgtaacttattgatctgtgtactttttgtaaggcatacttcaacattgaacatttactaacattgaacatgggtgagactttttgtaaaaataaagctacaaaggttcagggccctccctttatttcctgatactgcagattaggctacccatatattgagacattaaaccgtaactctccagtgaaatgagtgacacgtgaatgtgtttgtaaagtctagagtcaatgtatgtgttttaaatcatgggtctgggtgtcctgtaagtaatgctaccactggccctggctgcctccctgtctaaacaatttccttctgagtacaatattaaagttattagcaagcactttcttctcctcaactactgggggcatatgatgaaatctgtttgaactttgcatttcctgctacatctacaaagtgacaagtcagtatctgaggaaggagaattgaaccttataatggtcagtgtccagacaagtcatctgcttctttatgaaccatcttaatctagcaaaggcaagggcaagggaataattgctatgtcaagtagccaacaggaggcctatccacatctaacaggctagaaattagatgtggaagtctggggtggcaggatgggtcttccctgggcacggtgggtgtgacagaggcccagcactgaccacatgctaacgagcggcagttttctctgaacagcccttcccagcctggatcagaagaagcgtggtggccacaaagcatgctgcctgctgacgcctcctccaccaccactgttcccaccaccattcttcagaggtggccgaagtccggtgagtactttgggatttatgagaggaaaaaaagtgcaggctactcagtgcacaccacgcagccccacctgcctgccccactccacctgagctgcctccggaatcttttctgagagcctcaaccctccactgtcacccagaagttgagccccggaatggacattttgcagttcctggggtgtgtccattctccaaatatcttaaataaatgatggagggagattcttcttagcaggaattggatttggcaaagtttctcatcttctcaaaaaccatgaggtgaatttataatataacttcctgggttcccatcagctgctcaaacatggaatttccccttctgtttttcttctccccaagtgtttatgaaattcccttctgcagcccgtgtctaacacagaccgtttccatgaggtgactcaggaaatagttctcccgtagccacactgaggtgtgagagggagcagaatttggaaagaaaggaccaggtgaggaaaagagcaagattagggaaactggcctagaagacaacagccagggcattctggggacttgggattctcagctctttcccaacgctctgtctcctgagctgtccaattcaggagccactagccatatgtagctatctggcacttgcaatgtggctagttcaagttgaggtgtgctgtaagtgtaaaatacatactggatttcgaaagaagtagtatgagaaaagaatgtaaactatctcattagttaactttccaatactgaatatatgttaaaatgataatatttgagttttgttgggttaaagaaagtatattattaaaattaatttgacttttttctttttaccttcttgaaaggtaaaaaagtgactactagacaatttaaaattacagtgttgctcttattggtgcctcacgttagttatgtttccattggacagtgctaacctacacattggatagaggcccctgaaatgagcttccaaactctatccaaagtggctacgaggtgtctgtaatccatacaagccaggttcgtctcaagagcagatgagagaacagaaactggtagcccaaggtgtcatcttcttggggcagtcattggggtgtcagggaactgccaggcttagagacctgatcccggagcaggtctgtgtccaggatggtgacccttcctctgtcccctacgcctgacctctaactctgtgttgctttgtactgaagcttctctccccagacatgaagaatctcatgctggaactggagacctcgcagtccccgtgcatgcaaggctcgctaggctcccctgggcctcccggcccccaggttggtgcactctaccggacccctctcgctgtcttctgtttagagcaggaaagcccactgcacagagcctcttagtgtctgctctttctcatgtgatacaaagctgtttttccttctctcgcttacttcctgctccaaagccacttggatagaacactgactctttgctaggtaaattctggcctcccatccttgatttcctcatctatgcaatggggataataattgtccctacaatactgaattttgggggaatcaaatgaggatgccacctctatggatatggtttttattacagttacaatcagacaaacacttgatgacagtgccccttatgtaaccattgacccctcctgtggacccagaggtgcctgcgttcagcacaggaaagtggaggtgcagaggagatggtttcctgcctcactgggcccccaggtattgctaccaagcagcccacccctccccaccaaagctaaaggggaaacagtcaaaatgctgcagaaaggatttctagacaaacaagagtaccctccagagaccccaccccacagagtcctggcccctctggcctgcctccaagagggtgctccatcggtgagggacagctgggtctgagccttccatggggaggagaaagagggtgtaaggagcagttagttcccaagtgccttcccatgcagggggcgtaaaaatgacatcacccacctgggtaaacactcctgtggcttctggacacttgaaggctcacctggattacaaagccccacaagaggggactccggcctgtatctcctacatcacctcataccacctccattgtctcgttgactcagccacagtgaccatctctcgggttctcaaacactccaagcttgctttagccacagggcctttgcacttgtggttcctgctgtttggaatgttctttctggtttgtatcatggccagctcctgttggccactcaggactcagcttctatgccacctccttagaaatgccttcttctaccacccactcaaccacttaaagtagtctcctgcccacacgaccaccacaatcactctctgccacaatgacctactttaattctctgcatgattttttcatcctgttacagttttcttatctgttcttctgttcctggtctcccctctgtaaaacgtaagctcaatggcaggggttggcaaactatatctgtggatcaaatcctgcggcaaagtttcaataaaacatcgaagttttattgtctgtggctgctttttcacgacaaaggcagagttgagtagttgtgacagagaccaaatgtggcccacaaagcctaagatattgacaatgtagccttctaaagaaaacctgtatcaaaccttggtctgtgggaacagagacattgtccatctcactcactattatattccctgtctacaacagtgcacggggttggtataggttctccgtaattacttgttggatacaagaaagaaaacaggactttgaacccagagttggccagaggctgccacagaaaagcttggaagcctgcagaaaagcaagatgagaatcctcggaggtgcatttctatcttcccaccttcagcagtctacactaacaggtctcaggcatgctagaacccatggaatatagaaaagaaaagggggattttctgctgacctcaggacagtggctctctggtcacacacatctctaacctcgtgcaatcccctttgaagcatgtggaggctgtgttgcccaaatgcagggtcctgtgtagccaccttcatgtccttagaacacaatgtggatgctgtccctactcaaagtgaggtctgtgaaccagcaacattggtatcatatgggagctggttagaaatgcagaatgtcatccccctgacaaattcattctatcagaatctgcattctaacaagataccacccctccaccaagtgaacggagtgggtcatctgcacattaaagttggagaggcactgagctagagcacaatgaccttgtgaaatagttctagtccacttcaagaaacagaaagaactaaggcttggaagaatcaagagattggaatgaaaaccctcctcttccctatccaaaaatagaaggtgaataaaccaaagatactggttctcaaacttatctacacattacgattccctgggggagctccaaaaattactgatgcttgttcctcctcccctgagattgctatttattattattatcattattattattgggaagagagtctcactgtgccacgtaggttagagtgcagtggcttgatcgcagctaactgcagccttcacttcccaggcttaagtgagcctcctacatcagcctcccacaggagggtgggaccacaggtgcacataccatcatgcctggctaatttcttaatattttgtagagacagggtctcaacacattgaccaggttggtctcaaactcctgggctcaagcaatactcccacattggcctcccaaagtgctgagattataggcataagccaccccacccagcctgaggttgttatttaattgggctgggttggggcctgggctttgggatttttcaaacatctccagagaattgtaatgtgctgatagacttgggaaccacaggctgaggggagctgttgttatttggataagttttgtagaaatcatatttcagggagggaggttccaagacagccgaataggaagagctccagtctatagccctcagtgtgagcgatgcagaagacggttgatttctgcatttctaactgagctgtgaagagagtagtggttctcccagcacagagtttgagatctgagaatggacagactgcctcctcaagtgggaccctgacccccaagtagcctaactgggagacacctcccagtaggggccgactgacacctcatacagctgggtgcccctctgagatgaagcttccagaggaaggctcaggcagcaacatttgctcttctgcaatatttgctgttctgcagcctccactggtgatacccaggcaaacagggtctggagtggacctccagcaaactccaacagacctgcagcagagggtcctgactgttagaaggaaaactaacaaacagaaaggacatctacaccaaaatcccatctgtacatcaccatcatcaaagaccaaaggtagataaaaccacaaagatggagagaaaccagagcagaaaagctgaacattctaaaaatcagagtgcctcttctcctccaaaggagtgcagctcctcaccagcaatggaacaaagctggacagagaatgactttgatgagttgagagaagaaggcttcagacgatcggtaataacaaacttctccgagctaaagaagctaaaaccttgaaaaaagattagatgaatggctaactagaataaacagtgtagagaagaccttaaatgacctgttggagctgaaaaccacagcacgagaactacacaacacatgcacaagcttcagtagccaattcaatcatgtggaagaaagggtatcagtgattgaagatcaaatgaatgaaatgaagcgagaagagaagtttagagaaaaaagagtaagaagaaatgaacaaagcctccaagaaatatgggactatgtgaaaagaccaaatctacgtctgattggtgtacctgaaagtgacggggagaatggaatcaagttggaaaacactcttcaggatattatccaggagtacttccccaacctagcaaggcaggccaacattcaaattgaggaaatacagagaacgccacaaagatactcctcaagaagagcctgcctttcaagagttcctgaaggaagcactaaacatggaaaggaacaactggtaccagccaccacaaaatcataccaaacggtaaagaccatcaacaccatgaagaaactgcatcaactaatgagcaaaataacaagctaacatcataatgacaggatcaaattcacacataacaatattaaccttaaatgtaaatgggtaaatgctccagttaaaaaacacagactggcaaattggatagagtcaagacccatcagtgtgctgtattcaggagacccatctcacgtgcagagacacacataggctcaagataaagggatggaggaaaatctaccaagcaaatggaaaacaaaaaaaaagcacggcttgcaatcctagtctctgataaaacagactttaaaccaacaaagatcaaaagagacaaagaaggccattacataatggtaaagggatgaattcaataagaagagctaactatcctaaatatatatgcacccaatacaggagcacccagattcataaagcaggtccttagagacctacaaagagacttagactcccacccaataataatgggagacttcaacaccccactgtcaacattagacagatcaatgagacagaaagttaacaaggatatccaggacttgaactcagctctgcaccaagcagacctaacagacatctacagaactctccaccccaagtcaacagaatatacattcttctcaccaccacatcacacttattccaaaactgaccacatagttggaagtaaagcactcgtcagcaaatgtaaaagaacagaaattataacaaactgtctctcagaccacagtgcaatcaaactagaactcaggattaagaaactcactcaaaaccactcaactacatagaaactgaacaacctgctcctgaatgactactgggtacataatgaaatgaaggcagaaataaaaatgttctttgaaacccatgagaacagagacacaacataccagaatctctgggacacatttaaagcagtgtgtagggggaaatttatagcactaaatgcccacaagagaaagcaggaaagatctaaaatagacaccctaacatcacaattaaaagaactagagaagcaagagcaaacacattcaaaagctagcagaaggcaagaaataactaagatcagagcagaactgatggagatagagacacgaaaaaacccttcaaaaaaatcaatgaatccaggagctggttttttgaaaagatcaataaaattaatagaccgctagcaagactaataaagaagaaaagagagaagaatcaaatagacgcaataaaaaatgataaaggggatataactactgatcccacagaaatacaaactaccataagaaaacactataaacacctctacacaaataaactagaaaatctagaagaaatggataaattcctggacacatacaccctcccaagactaaaccaggaagaagctgaatccctgaattgaccaataacaggctctgaaattgaggcaataattaatagcctaccaaccaaaaaaagtccaggaccagacggattcatagccaaattctaccagaggtacaaggaggagctggtaccattctttctgaaacgattccaatcaacagaaaaagagggaatcctccctaactcattttatgaggccagcatcatcctgataccaaagcctggcagagacacaacaagaaaagagaattttaaatcaatatccctgatgaacattgatgcaaaaatcctcaataaaatactggcaaaccaaatccagcagcacatcaaaaagcttatccaccatgatcaagtgggcttcatccctgggatgcaaggctggttcgacatatgcaaatcaataaatgtaatccagcatataaacagaaccaaagacaaaaaccacataattatctcaatagattcaggaaaggcctttgacaaaattcaacagcccttcatgctaaaaactctcaataaactaggtattgatgggacgtatctcaaaataataagagctatttatgacaaacccgtagccaatatcatactgaatgggcaaaacctggaagcattccctttgaaaactggcacaagacagggatgccctctctcaccactcctatcacagtgttggaagttctggccagggcaatcaggcaggagaaagaaataaagggtattcaattaggaaaagaggaagtcaagttgtccctgtttgcagatgacatgattgtatatttagaaaaccccatcatctcagcccaaaatctccttaagctgataagcaacttcagcaaatctcaggatacaaaatcaatgtgcaaaaatcacaagcattcctatacaccaataacagacaaacagagaggcaaatcatgagtgagctcccattcacaattgcttcaaagagaataaaatacctaggaatcaaacttacaagggatgtgaaggacctcttcaaggagaactgcaaaccactgctcaatgaaatgaaagagaacagaaacaaatggaagaacattccatgctcatggataggaagaatcaatattgtgaaaatggccatactgcccaaggtaatttatagattcagtgccatccccatcaagctaccaatgactttcttcacagaattggaaaaaactactttaaacttcatatggaaccaaaaaagagaccacattgccaagacaatcttaagccaaaagaagaaagctggaggcatcacactacctgacttcaaactatactacaaggctacagtaaccaagacagcatggtactggcaccaaaacagagatatagaccaatggaatagaacagagccctcagaaataataccacacatctacaaccatctggtctttgacaaacctgacaaaagcaagaaatggggaaaggattccctgtttaataaatggtgctgggaaaactggctagccatatgtagaaagctgaaactggatcccttccttacaccttatacaagattaataccttattaattcaagatggattaaatacttaaatgttagacctaaaaccataaaaaccctagaagaaaacctaggcaataccattcaggacataggcatgggcaaagacttcatgactaaaacaccaaaagcaatggcagcaaaagccaaaatagacaaataggatctaattaaactaaagagcttctgcacagcaaaagaaactaccatcagagtgaacaggcaacctacagaatgggagaaaatttttacaatctacccatctgacaaagggctaatatccaaaatctacaaagggctaatatccaaaatctacaaagaacttaagcaaatttacaagaaaaaatcaaacaaccccatcaaaaagtgggtgaagtgtatgaacagacacttctcaaaagaagacatttatgcagccaagagacacatgaaaaaatgttcattatcactggccatcacagaaatgcaaatcaaaaccacaatgagatatctcacaccagttagaatggcgatcattaaaaagtcaggaaacaacaggtgctggagaggatgtggagaaataggaacacttttacactgttggtgggattgtaaactagttcaaccattgtggaagacagtatggtgattcctcaaggatctagaactagaaacaccatttgacccagccatcccattactgggtatatacccaaaggattgtaaatcgtgctgctataaagacacatgcccacgtatgtttattggggcactattcacaatagcaaagacttggaaccaacccaaatgtccatcaatgatagactggattaagaaaatgtggcacatatacaccatggaatactatgcagccataaaaaaggatgagtttatgtcctttgtagggacatggatgaagctggaaaccatcattctgagcaaactatcgcaaggacagaaaaccaaacaccgcatgttctcactcataggtgggaattgaacaatgagaacacctggacacagggtggggaacatcacataccagggcctgtcgtggggtggggggagtggggagggatagcattaggagatatacctaatgtgaatgacaagttagtgggtgcagcacaccaagatggcacatgtatacatatgtaacaaatctgcacgttgtgcacatgtaccctagaacttaaagtataatttaaaaaaagaaatcatatttcaaacaggctttgcattatgcatgttcacctgcagatcctggggttgcagtgggggcctggggaattttgatgaatttcctctctgctgttttggagaatttggaaaacagctgactgagcattttgcaggcacattctggctgtggatatgcaaagctttgatgcagtgagttgtagggtccctgagctagagtcagctcctctccaaggcacaaaaatgcactctttacttgccaacattcttagtgtcttaaaaaagaagacttttttcctgctgaagaaaggcaaaaattatttggcacctagtacccacaaattgaccatgggaatttccaaggtggcagctgctgctatgtgcaaaacttaacttgtctcttgtcaggcccccagggaagtttggcaagagtaactgaaaagatatgagaggtgatgaagcctcttgttttcagcaaatgggatttattcaagactcttttgttgctctcaacaagcacttgggatgttttatgcaaacaaagagttacagggagaaaattaaaaccacagagtagatatgtaagcattgcaaccatggagccactggaaaaccagctcagagaaagctaaagaggaggaacagaggaggggactgggctggagggcaaaggaaaagcctccatgggtccctggagccctacatctgcccagagaatgatgttgctgctgtaggagcccagtgcaccaagagcctcacacccatccagcttcagactgatatatactttcttcactttttatcttgattgattagggtccaccggggcttcctggcaagacaggaccaaagggagaaaaggtatggaccactactttcttcaacccttctttccttggcaattccagcctgttttctgggcatcccactgagaatttcctagttgagatttccaaacatgtgctaactctgccttggtgagaggctgggttccatgatggctgggctgctgcagcacatatgggataacactggtgtattttgacgtggcctatcgacatggcagaggggccgtgagcagcagccaagcaactgagccacatggccatgcccagtcatcagctctactaaggcttctgcttccagaacatctcttccaaagcagcctctccttacctgtcttctccatccatagggggagcttggccgaccaggaaggaaggtatggtctgcgctgttctgtgagtgtcacatgagcgtctgtgcttcatgtgtgtgcatgcactcctagggaggggggaacagcaatgcacttcagtggtcactgatacccaggtggacagtgatggtgctgctgtctcgatggtgacagtagtaaccttgccctttctgtcaacttctttgttcaggagcaggagcctgctactgccaggcattcagacttcttccgggggctgccaaacctggccaaattccacccctctcacttcccgccccaaccccagaccatctcactctgctacccatcagagaaacccttcatagctccaaccagtgacattgaatgactgtcactctctgtttgattaaatttgaataaagtgccagagcagacagaaacaaatggcttttgctttttggctcagctgaaataaatggaggttacttaaggtcacggtgactctgagtgaaccaaacacatgttatcaaggctctcattagtgtcaggagggagtaaatcagctgcctattatatttgctgaggtcagtggatactggcactgaatttctaggtcttggttatagacaagcgtgcaaaactttggccaagaaagatgtccatggctctaaatataaattactatatttattgttaaatggtttattaaatggtttcatggtccacaagatccttaaacagacttttgcaagacaaagttacaactctttagggcacagatgaaaactatagccaaggcacagtggctgtctgaagtgctggggtggtctccatggcaatggtcaaaggatattctgctgtggtgtccatgctcaggcctaacaaggaccatgattgattagtgatgtcgccatggatgtgggaggcaacagtagaaaccagtacacgtgccaggatttggtatatctggtttaggggctgagcccttcacatctctagctaattgcgaaattagctaatgggcacaaggtcaagataggcccttagcacctgcacccactctctcttgcagggcttgctcttccatagccctggcttaggcagagacacaggtgacatgtaccctgtgcaagtgaatacattattatgggaccactctcgggaggaacctgtagggagaatgggagaagccaggcaaaggtgtggtatcaggtgaagtcgagctttagcagtctgatatctagggggagcttgagagtgtcagctgcccaaaggtaagggagctggactattggctgcaggaaggagagttacataaattactgggcagctccaattgctcaagggcaaaccgcagttacaggtagcagaaatgagctgttagcagcaaggaaggtagcctctgggcgatgggcactctgagcaggtcaaaaagaccttgaaagagtgctgacagcatctgctactgctccccaaatgtaatcctatctcattccatagcacatccttggaaagaacccattggaacgcaggggacttttgggtgggggtgggtagaagtgacaaaaattaaaaaaccaagaagtttagagtccctttctcaccaccctccatttcttgagaagaataaggtcttgtttgatgatacagtgtgacaccaagggcttgtcaggccatcagtctttggagagtggggatgagggtcatagtagccatgcctagagaacccactgtctcctctgggccccagagacaaaacatatttattagaagtaaagaaacaaacccagttgcgctgacttttgttcttggtctttgaagggtagacctggccccccaggtgttcctggcatgcctgggcccatcggttggccaggccctgaaggacccagggtaagtgtggcatgctctcagggctcatgcggtgtcaaaacaagaggggggaagatggcagctttcctggctcctggcacatagtcagggaatcccttcttcaagagggggaagaagaagagagcttaaggactggccacagggccccagatacttcctccttcacttggcctgcaagaccttgatcagtgcaacagctctgttcctgtgggaggagaaatagggggctggtaccctcttctacaggggccgtggttctcctttgtcctaggaactagcaccccactctggtttccctgagatgacctaagaggggcttgcgtctgggaagctcttgcctgtcatgctgacctggcagggaatggagagttgagaaggtggtgttggctggctgaaggatggaaatcctacattcagagagggattgtcgagtgctgatgaaatctccttcctcagtcaggctatggaaagcaagcacatccccatctgtgcctctgtttttcccactagtagtcatagactagagggttcagaggcgtgactcagagttttatctgcagaagtcagagctgggcaggtggatctcaccatctgctctgatttgtttactggctatattatagcagtggaaaactgtgtgtccagtcctcttaggaaaagtcccaaaaggatattttaaaaatcctctgcatacagctgagctgtcctgcacagcagccagtagccacatgtgaccctcaagcccgtggaatgttgctagtgctactgaggaactgaatttttaaattttaactatttgaattaacctttactaaattcagttatttgaaaatgttaaagtatgtttggagcaacttgaatgcatgaatctgctttttcaactataaattttatgatctctaagtacagattaaatattttggatgaaaatttagcacctgaatggagatgtgtaaatgtaaattacatagcagatttcaagtacttattatgaaaagcacaatgtaaaatatctcaataatttttgtatagattacaagttgggatgattaattagattaaaggagatctattaaaattaacttcattcgtttagttttactttaaggtgacttcttttaaaagtttaaaattaagtatgtggctcaccttatatttctattggttagtgctggtatagagtatttttagtacagagggtgggtgctggaagtcccaaccacaaatcattctgaggacccttcctatgcaaagagcaaagcaggcaatgttttttgcgtgtattgacaccttgttttctggggccccagttccgtcatgccccctccactactctctcactatcctcgctaggaaaataccaagtattaccatatacaacatcttagtgagcagttggtgtggggatctgcttcactttgggcgttttcattttatatttaatcttaaacacaagaatgaaatgtggagtacggagttttgggacctcaggagggagaaagtgggtgcatctggggtcctcagatttacaagccagccctgatatccccagttccttcccaatcttgcctgtgacttcctggttcagtttctctaaaaaatatcaccgtgggtcttttcttcttctaattcccacagggtgaaaaaggtgacctgggtatgatgggcttgccagggtcaagaggaccaatgggctccaaggtcagtgtggggtccaaatggacgttcccagatctctgtcaggctctggagcagctgctgtctacaaacatagggactgggtggggctgcagtcccggactagggaatgtcgcggatattggagagcctgcctttaccagccctttggagaacatcatgccctgggatgcaggggcatagggatgccattcctgctgttctcttgggcaggaagaaccaagcttctggacatcagagcagatggaaacctttgatcaggactttgcagagtgataaaagcaatgttccttttaggcctggtataaccacaaccctctgggacatctttgtgtttggtgctgcaaccccactaaaactcacagtgcaatgtggagacataccttaccaccacattcagggattccttctattcttccaccaaactcagaagtcctacagggctgattgtaaatgtaccttctgctttcttttagggctaccctggatccagaggggaaaaggttagtgcttttcttggatggtgtcctagagcctggtctgggctactggctctggaatcagagacatgcagagaatgggtccaggtctctctttagtctgcaactgaagccaccatccctagctattccccaccctttgtcagtggactgagagagaagtgagggacctcctgaagcagggcaagctggtaagagaagggctccccatagaggcagaggcccctcgtgtggagcacataagcaaatgaaggccgtgccaggtagagaataagcacagtttgcacagagtgctggaggaaattggtgatgcatgtctttaggccaagctttcaccaccacacaaccttctgacctggccaaaaaccaaatcaaaacagcatcaacctgtggacaaatttcctacaggatgagagaggatttggggcccagaattttccgtgagttgtcctttatgaatgcaagaggtctttggggttcaacaagaagtagatcacaaagcattccttccctggagaagtcacctgacatatctgagcctatttcttcacttgtaaaatgagggttttggtttagggagcttttcagtttgaaatgcttgaatttccctcccaggatattaactcattgactttctcctatggtttcttcctagggatccagaggtgaaaagggtgacctgggtcccaaaggagaaaaggtaatggagaaaacctttccatagaaatgataaatgtcagtgcaagtagcagcccccacccacccccatccgtggactgatgatggactgatggacaggcctccatcttgaaaatgaccaacaaagcctgtccacagccatttcaggtgttatttcagaggtgatcacaattatttgttgctcttttcacagggtttcccaggatttcctggaatgttggggcagaaagtaagtaaccttgaggtagtgaaaataggcctcaataaaaatatcaggtcctccaagcacaacaaaaagaactctgcctccttgtctatcaggcagggatggtgggtttaaccatggaaacttctattttgggacgggaagcaagttgcttttcaccctggggagagggtggcaggatggtctggagcctccctctagctcaatgggaaggaaaggacaacccatctgggttttgggtttttgtttgtttgtttgtttttttgcttttttgcttttcctacctcttagagggctgtggtcctattcaaatgcagaaacctttctcacaggggactcagatctgagccacaacggtcaaagcccctgtcagcacacaggcctcagtgtaaggcacaggtgtctttagcttaaggtcactgtgccttattgcagtccttcttcaagggcggtgcacatactgccagaaggacacaaaagtatttgaactgaagactgctaacattgtttaagagttaaattttgtatttaaatagttaaatattggccaggcatggtgcctcatgcctgtaatcccagcactttgggaggccgaggtgggcagatggcttgaacccaggagttcgagactagcctgggcaacatggtgaaatcccatttctaccaagaaaaatatacaaaacattagctgggcatggtagttcgcacctgtagtgccagatacttaggaaggtgaggcgggagggtggcctgagcccaggagtcaaagctgcggtaagccatgattgcaccactgcactccagcctgggccacagaggcagaccctgtctcaataaataaataaatagttaaatatttaatggatatcttgcttgggacaaggcttaataaaaaagggtccatttcaggtaacttaaagaaaaaaatactcagcttgggcaatatagtactatctcatctctaaaaaaaaaaaaattagcaggtcatggtggcacatgcctatagtcccagcgactcaggaggctgaggtgggagaattgcttgagcccaggtgattgaggctgcagtgagccgagattatgccactgctctccagcctgggcacagagaaagaccatgtctctgaaaaaaaagaaaagaaaagaaaagaagaaagaagtgaagaaagagagagagagaaagaaagaaaaatattcagtaaatagcaaaacagtggtatatagagatgacaaaaattgtgaaggtgactgttgaccaacatatgttttgaaacttttaccgagggttagggttggggaagaagaacaagggtagttgagggggaatgtcagagaataaagagagaaaagggcatacatggccatttggaacagctcctaagctaacatcattttggctcctcatgccataagacattgacattggaaattgttattttaacatagttctcaaaccatcatattcttcaaacatgcaaaggggatgctttgttagtatttttcatttttaaaagttcaccttaaagttttatttaccaaactaaaacaatttttatcttaccttttctagtcagtggaaagtgtttaaatattttcaatcaacatgcattaatttattatatcactaccttaagctgtcagaaactacactctgctaccctaggtagggtgttgggttaaaagaatagattaattatataagcaaattaaaggaagtgttaaaagagaaaaaacagttttacttaaaaatatttagattagcttttcattcagggcaacagtgaacgtcaaagaataataaattactgtaaaattaagtatggcagcttctctgtcctctgcaccatttactagacttcccatctgaagagttgtcttccccttttatgacaggctgttttaagacagagctgatatgatgaccataattaggtcttgggagagaaattagatcaagaaattcctgactgcttcaagctaatgtagagaagggccacacttccttctgacaatccctgaaaaaaaaaaaaaaatgctgcttgtgctgctgttttctcccagccataaagacatccccgagcctctctaaaacagccagggaaaaactgcaagcatctccatggcatgcggcatccatcctatcctctcacacgctcccattccctagagaatgttgaaggatgtatgggttggaaagaaataacagatttaaggacaattcttggtgaaacaagacattggtggcttgggtagggacacattggctgagctgacagataatttcagagctttatgtttgatcctttccatatacaggtgttccctggaattttccattgtgttatacctcctctgactgccatgtgaaaaagtgcctgggtgttttttgttctctctgagtgtctgggcagctcttcatgggcactggctgctgattaacactcatggttgctattgctaaatttttcttgttggctgtgcattctgggctgttgggggattactggagataggaatgaagcgccctgtgggctgacccaaagaaatagtaagtggggctggaatccatgtagaagaaaatggggaagaaggagagaaactaagatggagaaatgagttttgtgaaatattggccttaaactatgaaattctgcaatgggtacattgggttttgatagttcaacatagagctttacaaacaggaatattgtttccattgttctccatgcctttttcaataattatattgaagatgtgaacatatgtttggaacatctctcccacaaaagaactttcatctaaatcaaatggaagtgagctggaactcaaaccaatgcttactaagagtgggcaagcacataatcctaagcaagagtcattaaatgagtagaaacttcccaaagatgacagctggcaaaacagtgtccaatcatttaaaaacctccagatttgaatttgtgctaaaaacagcacgtaagaaaacacaacataaaattccaactagaaggaaagcgttttcccagacagcttgtagtaattagcacaggcatgctgtgctggatgccccagcctctcactgcctgttctgggtgatgatttgtctcttctatttggccatcaaaatgtgtgctgctccacacctgtccctctcaggtaacagataacccactcagaattaccttcttccttccctcctcttccatgaaagacatgtctgcctttctcatgacttcctcactctgctaaccttgcagggcagcccagttggcatagattcggaatgatcaagtagactgccctcgtagccaatgactggctagacctgtgtagatgtgcccactccacatgccctaagtcctctcttgcttctctttccttctttccagggtgaaatgggtccaaaaggtgaacctgggatagcaggacaccgaggacccacaggaagaccaggaaaacgaggcaagcaggtaaggatcccagggcttaccacccgcctgaggtcagaacttcctgacctggcagtgtgtggagtggcaggcaggtggcgttaatcagagatattctgtagaccttgactccagcatcctctgggctagcagacgggagcagcaccacttccagaagctgctggcatctctaggctagccgtagtttgaagtggatgggataggatgctccatgtgaactgtgccaaggccagaagcaagagtggatatttggttcataaaaataagtctgtcttaaccaaagcagctaggaatggaaggcagatatggtcatttacccagaaaacctattttatgcttcaatgtcccagacacaaatgaagttttaaaaatgagcctagatattttcctgctgttgagaggtcttctgggtctcaacaatagggtggtttttccctactcaggcctccaatttgtaagtgaccttttttcttgggttgattaacatgcttaaggcagttgttcattctgaactccccctggtcagcaggctcttgtgttaagccatgtgatgtgacatgactgctctagagacagccttagctgtctcatatataatcctgagaggtaaacatctttggatggaagctttttccattcttttacttatttccttaggctatatctgtggcccacaaacttaatcttacatcaagatcacctgggggtggggccggtgattaaatacagatgtacagatcccccacatcaggtgcaatggttgtagttccaagcttgccactcctcatccccagtgcctaggccttattttccaaagaccataatataattgacctggaatgagctttcagcatgggtttggttatttttttttaagctccatatgattttaatgtgcagccaggtttcagaaccataataacactatgaagccaattctggtcttttcccaatcaatttagaaagaacacaggctccaacctggaaaatttagactgcgcagtaactttcgaagttacaatcatccagtccagttttcaaactttgatcatgggtagcatggtcatggtttcacaatgatgccacagataccaatttcttaaaagtaggctcagataaaaaaggaaaaatatgggggagaaatcttttcttatatcactttatcccctcctaatgatttccattcataatattttaagcttggggttccagaagcttcctggcttccttctgtcttgggcagtgtttgccttttcctagttcctggcgataaccaaagccaggaaggccatttcttgagcctgctgagactaattccgtggaatcataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttgactgcaacattttctgtcttcagttatacaaaaggaatccaaacaatttttattccaacttttttcttaagaaaatgaagacatttacaattccacagtgtattccccctcctcctgtgtttatggaactatatttgcaaccacatcatgggatgggcaagaaatgtcatattttgttagatcctttaaactaagttaaatctggctctgagagtccaacctactaggatgccaaataaattaattcaggcattattaggattttcactactcctccaacaaccacaaataggttgggcaaagatcctggtgaattatggcagaaaaatgtcagggaaggtccctccaacctttggtctactccattcacctctgaaatagagtagaaatagaaatagacttgttgtccaagtccctgtggtccacagatacctggtggctgctgttctcatgccatacgtgggtatcagaacattttcaaggctgggagtcctggtccccacagttcaactttccaaggagcaccccacaaccattctttctgagacctgtctctttctcaggatacaaggggtccctctcctgtccatgtctagggaggtctctcctcttccatccctgaccccctccttcctcatactcctcatataccagcaccccaattaggagctttgtccttcagagaacagaaggcagaaagaaaagtttgtttccaatagtacctgcttttagcaagggcaagaaagcacaaactcttgctacctccttgaaatagggagaggaggaaggaaatactgggagaacaaacactgattagtatgggtaataacttatgtttgctgcgcctgtttccatgttgttaggggaatcagatttgagatgcagcccaggccatgtgcccacactccataattcatttctggaattggctggatgatctgaatgggggtcctttcaactagtcctcttcctccttggttctggaaggcatgatgtccccctggagccccataactatgagctaccaaccgcagagactgagagcttggcctgagttgtgccttcagaagggactctcttggcccctggggtacctaggggctcacaaaactgaggagtaggccaggcgcggtggctcacacctgtaatcccagcactttggaaggccgaggtgggcagatcatgaggtcaggagatcgagaccatcctggctaacacagtgaaaccccatctctactaaaaatacaaaaaattagccgggcgtagtggcgggcgcctgtagtcccagctacatgggaggctgaggcaggagaatggcatgaacccgggaggcggagcttgcagtaagccaagatcgagtcactgcactccagcctgggtgacagagcaagactccatctcaaaaaaaacaaaaaacaaaaaacaacaaaaacaacaaaaaaaaacaaaaccaaaaccaaaaaaaactgaggagtagtccaggggcatgggattggtggatgtgggatgtgtaggagatccttagcggactgggatcttaatggtctcactgtgtttatctctttgtaaaggccagccctcacctgacttgtctggttccctcctggggctaggggatggatgagaagggctaggctggagctgtcagcagcttcttggtgcctgctgtttctcttgtcttgtctgtcttcggtgtattgcaatcctgtcctcttagcaggccccgcagagtcatactttttctccctggccttccagctccctctcttccacccagtatgcccacctccctctcccttgactaccccagcctctgcccaatcacgccctgccctctacccttcagaggacaccttgccgtctgtggagctggagctattcctatggtctctctgggtccacatgaccttacatggcactcctctcaccttctgtccatccaacaaaattctctgttcctttgaagctctcttttcagtaaggccttccttggcccctaacaggatggatcaccctcccctgagccctggtcattgcctctctgttatggcctctccattggtaacgtttctgcagatgtgtttcatcttcccactagatccttgagggcgaggtaggcggctgagtcagcttcacatccccagtggcacctggtatgtgggtggacagggctgcttcctgcaggggctcccaggcaggggttctgtgggttcacagttcatctccttaggagccaagcagggtgggaccatctctttggattgatgcccccgccccccattccgtcctttgagccacttcctttctgaggaggcttcctgagtgagcgggctgaagaaggtaaagagaagatggggcaataaataatcctgctctttggaaaatattggaggggtggggagagagggcaaggaaggagttaaaaagagatattcagccgggcgcggtggcttacgcctgtaatcctagcacttggggaggctgaggtggacggatcacttgaggtcagaagtttgagaccagcctggccaacatggtgaaacccccatctctactaaaaatacaaaaattagccgggcatggtagcgggcacctgtaatcccagctactcaggaggctgagacaggagaatcacttgaacccgggaggcggaggttacagtgagccgagatctcgctactgcactcccgcctgggcgacagagtaagactccatctcaaaaataaataaataaataaataaataaataaataaataaataaataagttatccctgtgcctgggaccagttggataatcatccagagttggactaggccccccaaattggttcctgacactacctttgacagtctgatgaaagtcccaaacccattctcgggggggaaaaaactgtatatacctacatccaaggttttgcaccctgtttcccagggttccagaacccctgtcccagcgccatcgtgagatagccttggcctctgtagaccacaggttaaaactcccctggtctagtcctaccctccccttagagaaaagaatcttgaacctcaaagagaagtgatgcctgcaaggtcacagcagtgactgggggccaccctggtccagaatgggtgagtgtcagccaggcggccctagaggttgttgtgctggttcctctgccctctcctagattcccctttcctgatcctttcccactgaggcagccaatggaagtgggagcctgcctgggaaaagatggagagccaggtcctctggctgcagggggtggcgatgaaacccagctgagacatgatctcccagaggtcagggtggggaagttcaggttgctgagtcctttagtatagcctggcagaaaacaggcaggggtaacagatgccctgcagcaactgggaggaagctgcagggaaactgcagtggtggcagcaggctccctgccacatcctgttgggaggtgacctcggtttctggtgcccagctctgtgggaccagatggtgctgggggaggtggaaagggtgagagctttgtacttatctgagttagagggtaagaggggctaagaggtcggggggggaataaaggcaaaatgcctttaggatgtaatttgcaataatcaaattacaaatttggctgagtccttcctgtacccagacagagtataagtgaatcaacgtggtacctgggaattgccagcttcctgagagcatcagtattcttggacatttgtcttttgaacagcatagtgttaagtaaaacatgaattcaaatctcagcctcaccattcatcagcagctaatgggacaaactcctgactgtctctcaggccatggttctggaggagttgttggggtcacagagccttctggaaggctgttccaatgccaccctcatattcttggtcacagagcttttccacttcaatttccccaagtgcttaattacccagaatattcctagcctggtggattccctgtctctctgggctcttctgaaaatatcagaacacagactggagctcttcctacagaattatatttgtatttcttgttagaacaaacaaccataacttaggataagatattggcacagtgcccttcccctcatgctgtcagcattctgattgtacgaatacctgtcaacccgctcaggaaagttcagtctcctccgactgcagtgttttccctggggtcctggccagatctctcccctggggtcattttatttcctgcccttctggatctgtgaactgtgttcccagcccctggctgccccagatgtcatactgcctgacaccaatgactggctggcctccaaacccacccctcgctattttcccagaagaagggatccttacctatttctcttctcagtccccatctttttttctctttcctcacttcctgttagatggcttttg

SEQ ID NO: 1403 - DNA, 590 bp, Homo sapiens
gccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcag

SEQ ID NO: 1404 - protein, 196 aa, Homo sapiens
QTLASMVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGEKGDLGMMGLPGSRGPMGSKGYPGSRGEKGSRGEKGDLGPKGEKGFPGFPGMLGQKGEMGPKGEPGIAGHRGPTGRPGKRGKQ

SEQ ID NO: 1405 - DNA, 83180 bp, Mus musculus
  misc_feature (1)...(83180): n = A,T,C or G
gttgtgtgtaagcgtaactgtgcctgtttatgcttgtatgtgagtgtgtatttatgagagtgtatgtgcacatacatgagtatacaggagattcctgtgcacatgtatgaatgtgctttttatgtgagaatgtatatgcatttgtgtgtatattattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatagttctaacctaccacatgcccagtagcaacgttcgtgaacatgggcaggaagctgtgggtttcaccattgccctagtgaccttacagggtactggtagggttgcggagaaaatgatataggcacagtgtgtttgagaggaatgagtgccaccaggtggcttctggctgtagagacaggatgaccagtgtaaggggcctggggcagagaagagtactcctgtgggagaggatgactcaaggtcttggctttgggttgagcctgtctccccatagcagttatagacggcagaggagggcagcagcttggcccaggcttgtagcaggttgggatagaaagtgtctagagtgagttctattctgaaggcaggagcagctgcgaagggcgacatggtgctatgtctgtgtccccatctatacagatatacagaggtgtgctgtgactttgtcatgccacatgaaaatactaagagctacccttggctggatgaatgctgtaacacgcatacccacattccaccacataaaagattatgcagttggaatttctcccccctccccctccccctcccttcttccctccctctccttccttccctacagttgtttaggccctgctatgacccatgtcttcctgtgctgttgtctcctctggagacttccttggatgaggggatcctgtcccagccaccattgagaagaacggctttgttcaaatgcccacctccatttaagtacatgcctggtgcctgcagaggccagaaggcattagatccctggaactggcgtttcagagggttgtgagctcctatatgggtgttgctaactgagcctgggccctgtatagaaaccagtgttgtagccgctgagccatctcttcagcctgttatgcactctgtccttacttgagctgctgtggcctgtgttatctctgggatcagtcagccttggtcctgtgggtcatgtgtacacttgcttctgacttcttcactagacgctctcctctgggtcacgctgttcctttcaaatcctgcccctggaccagtgttgaccttggcaatgctgccacagacaggacatctcaagcttccttcctgtgccctggataaataagggtgtacaagctgtggggtgcagctcggagtggggacagtgaaatgcagtgcaagagagaaacttggctctcccctcagcactgcggaggccctgcctgcccttgtgccttcctgtgtctcctttggagactttcttggatgaggggatcctgtcccagccaccattgagaagaacggctttatccaaatacctatctccgtgtgcttagctcaggactgggttagcaggtgtggcagagagggctctgaagctgggaagaccctggctcagcctggggaagccctgcagcatatctggatggggctaaaaggcctcctggcagaaatgcagctggtactgccttgaggtaacagcccggcattgcagccctgcaccttggccctgcctcagcttctgccttgcctcactgaggaggaggatgatggccttagtcctgccagcttgccctgcagcagtactggaactggcatgggcctgtccccactgagccagcagctctcccgttccccatttaaggaaacctgcaggcctcaggaagtggggaagaaatgtggtgtactaacctcatttccctgcctggccttagctctggctggaccacagcaccaaatgggaagcgtagaaacacgcttctcagtgggtggcaagtccctgggctaattccaggcctgtaggagtgggaagcacagggaaagaaggcagcgcccaggccatgtcagcctcagctgaggctgacctacctccagatgcccagagcatcaccccagttatggccctgctgatgcaggatgaagcatgcacaaagcttgggccttacctgcccacccaggctgctgtctagagctgctgcttgctgtgtgtgtgagacaagtccacgtgccagagcccccacttcctatctgtctaatgggggcagcaggctggctttcgcagtactggctggcacagagggtggtgcaggacactcaggagttaccctgtgtggggtgcttggcagagaaggggatattttcatgatgttcctatgcctacccttctagatgacgtcctcatcgtccctctagaaggtggtgatagttctggctcacctaggaccccctgctggggacacagcagtgagacagcccctgtgcccattattgcaagagctgagagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacatacacacacacacacacacacatacacacatatatacaaaaatacaaaaaaaggtaagtatttttttaaaaaaaactgggcatggtggcacatggttgtaatcctagtacttgggaggtggaggaaacagtggggtgaggctagccttagctacaggagatgaggatggtggaggaagcagtggggtgaggctagccttagctacaggagatggaggtgatggtgaaggtttatacctctttcaagtatttcaagcaatatctctattttaattccttcacataaaaacctaaagtttgggtccctcaaacgatagtcactcgttatttctcacaggtctggtgggtgagctttcaggcctgggttagggattggaaccaatccctagatccatctgtgtctttccttttatcccgtctcctcactaggtacatgtactggactgactggggggaagcaccccggatcgagcgggcagggatggatggcagtacccggaagatcattgtagactccgacatttactggcccaatgggctgaccatcgacctggaggaacagaagctgtactgggccgatgccaagctcagcttcatccaccgtgccaacctggacggctccttccggtgagtgcctagtggccgaggcgccctccccactatatctgctgtcctcagggagttgaggctccttaactcaggccttaggttcttccctggagcccccaaggattgttagatgactttgggaacagagcatagttaccatgtctgatgtcacagctgatggaactgtttccacagcaatatgctgaacgttccttccaaactgtgtgagaggaacatacatagcctccgagatggcagctgtgcaaggcgggctctgagttcaatccctgcaggccacacgataagaggtagaggaccatttctttctgtttttgttttttctagatacggtttctctgtgtaatagccctggctgtcctggacttgctttgtagaccaggctggccataaagtcacagagatctgcctgtgcctgcttcccaaggctgggattaaaggtgtggccaccacacccagtctgagaaccagttcttggatctccacttagtgctgtgggtttcgagttcctcccatatacataccatacatatcgtattttaaaaaagagaaaagactacatctgacccatatctgcgcccagtttgtactgggaaatgagtaagaaaatctcagtgttcaggggctgggagaggtgctcagtggttacctgcatttgctgtgtttgcagaggacttgagttcacttcccagcacttgtgctggaaggcttatctggtgccctcttctggcctccctgggcactgcactcagatgcacatacctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctgtgtgactattatcatatctacagccttgctagagactgtgcagacagtaggtgcttgatcaatgaagaggacaggtagatgaattcggcctgttctcctacttggttgttagagcttcctgcttggtgtggccctgtgccatcattacacttgagaaatagctgtgacctttgtgtcgagttaggggtagtttactctgtgactgaatattacttactgagttgacatcaggtcttgggctcctcatgggaaggttaatctgacctttgcactggaggagctcctggcttggggcataggagctgctgtgaagggttcatcttgagtttgattaaaaaggcccacattccatcaattttgggatgatgtccagcctgtgtcttgtcatttgtagggcgagggtgaagatgcacatagggtacactggtcagggtctgatctgagatttggaaatcaggctagcccaaggacagacggtgggagcaagtgatctcagcatgatctaggctagcccagaatctggaaagctgctagccttgggcaagcggtcctgacaagagggtagcagttagtataacagatagcgataactcttgcattgtgtcagtgtccagggacatttaccattttgtttgatgttcacaacaaaccccatactacctcctgtatgatgataggcagggtctcaacgccatacagctggccagagcctactgcagagtggtggtcgttaaataaccacaagatgctggctctgctcaattccagtcctattaccagtgttgataatctcattaaacatgatgtccgctgtgtcggcggttctgaacacacagggctgagagtgcctccctgctgttggtgtggactgtcggacagaacacatctggctgagtcagcaggaagctctttgcacatcaggtctggggacccaggcttctcagaaactgtcaccaggtgtggctccatgcatttttcttttctaggggcactttgtccctttgtccaggggctcttacgtttttgtcacaggcacccaggctggctgggtgggcgctgcccgtgcatacctggaagggctgactggagtggccgagtgaggagagtgtgcttgcagctgcttccctttgatctgacagacacagcgggtctgtggtggcctaaaggcctccagcatagggcagagttggcctgagaggtcttctcctaaccactctgcctgtttcctacctactgcaggcagaaggtggtggagggcagcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgcgcgtgtgcgtgtgtgtgtacatggtatatgtgagtatgcttgtacatggacagtgtttctgcatgtggttgtctaggcaggctagtacggtggacagggcctctctagagctgtttcaggctttctagggcaggtggtgccattgtgaaggcccagtagagccctgaagtgtaaaatacttgctcagagtcttacttctcagcctggggtcttatatggtagaatcttaatagaagtccctgacggtgactctgagtttctgtgacagactgagggggttggatgggaggcgggaagaggccattctaggctcactcagttgcacatgcaccaaggatcagtatttctggccacactttatagaaggtttgaatgtgggtctaggaactcaagccacaaaggttagtgtaggaggggtgggggaggtggtccctgaccctgtcaagagtacatagttcttgaactcttttgcttggagctgcccactcttcactgagtgtgttgtgagggcgaaggtcaactgcaggagactcagttccagttgacagagttgcaggggtgctgagccccacattcctgaggtagaaggagggtctgggaacctttgttagattcaactgtacagtggtcacagaagagcctgggggaggggcctaaatgtggtaacccaatgtggactgagtctgcagggtccaggcagattaaagagacagggtgtgctcaggagtccactaacccagggttcccaggcatggctgcctaagcggtcctgagaatttccatggaagcatggcgggtgacttttctggggaaagtagcatcctttgaaagtttatcttcttgttggagaaagcttagcttggggaatgtgccctgcagggcagggcaggtctgggatggtttctgagaaattacagaactgctgctgaggctgaaggccctccatgggggggtggtctgagtgcggttaggtaggactaggaggacgagtcatggtgtagggctggagggacatctgacagttgtcctgtaggatacatgggatgtgtaggatgccagcccccgtgggagggagtggctgggcagtggtgcgctcacagcttgtactgcaacttccttccatcctgtcctgttctgtccccaccagtccacacaccatgcgaggaggacaacggtggctgttcccacctgtgcctgctgtccccgagggagcctttctactcctgtgcctgccccactggtgtgcagttgcaggacaatggcaagacgtgcaagacaggtgaggtggaacattggcactggcagggacaggtggggcctggcctggtggtgggggctgtcaccagctaaagtgacaaacatggcagcctcttcacaagggtctactcgatttagtgacaactctgacgctgagttcaccatcagctctgagctgagtttgggagttgtggatccctcatcaaaacagtgatatcctggtttagtagtgccttcagagtgctgagcacatcaacgtagggccacaccctgaaagtttgctgtgctgagttttatccaaaagctattaactgtaaaaaggaaaggatgggggcattagtgggcactgcccagggagctaaccccagtgtggagcccctgagctttcctggtctgtatcagttttgccctctggagcacagcagccactacactgagtgcagacatggttttggtttggcttccctgcatctgtgtcgttgatttgcttcttgtgtttcagttgttcaagtcttacctctctgttaacacttctatgcaaatggaggtcccagatcagccttgttgaaagttttctttctgactcagagagccagtttccctcctttttgaatatattttttcttttttttcttcgagattataacataattacataatttccttttctttttcctcctctaaacctttccatatatcaatccttgttctctttcaaattcttggctttgtgggccaatatctgttttttttttttttaagatttatttattattataaataagcacactgtagctgtcttcagacaccccggaagagggcatcagctctcattacgggtggttgtgagccaccatgtggctgctgggatttgaactcagaaccttcagaagagcagtcagtgctcttacttgctgagccatctcgccagcccgtgttgttgattttaagtcagggtctcactatgtagctctgactgtcctggaacttgttatgtaaactagactggcttgaaaaatcatggaaatctgcttgcctccacttcctgagccttgagctccaaggtgtttgccctctgatttcactgcttaattcacacaactttcggctcaggcctcgcttttcatcactgattgcttctgggttcctggtgtagtcagcattctcacctccaggaaatggacttctgctgtggtgcctcgggtagccccttctggtacctacgtacctagaggatagttctccgggttggctctgaggcttgtcttatcaggtcctgtgaggagcacagccatcctgaggctggttctcctttattttttctggggacagagcctgcttccctcaccattggccctctcccacggggaaaggtcagggaggcagctgccttccatattgcctggtctaagcagcagcttccttgaggctgtctcctgatgtcagtgtgtggggttgaagggatgtccttactcagctccagctgtggttcaggcatggggtgtgcctctgagggtttcctggcccctgctgtgctctgcagtgtggacttagattgtaggtgcctgtggtatcagaggtcaggatgagcagctggccctggccttcctgtgagccaggttcctcagtgactcagatgtccaggggtcacaggttccactttcctaagaatcctatctctactagctgtgaaaggcactcctaggaagactgtcagagaatgccgagcgcacaggacaaagcatttgtcacccagagtcctcctgtggtggaagtgtgcgagaggctgaggacatcgctgtagtcagtggacttctgtatgctaaatccatactttttccactttggctgaagatgccctgactgtagtattgtgttaaaaggagggagatgtctccagatgagagaaaaggcgcatgtctggttaggtttctatggctgggataaacaccactatcaaaagcaacttagagaggaaaggttcatttgtcttacaggtcatagtccatcctgacgggaaggaaatgaggacaggaactgaggcagaggctgtggaggagcctcctcctggcacctcatgcttcctcagcttgctttcttagataactgaggacagtctgcccagggatgaaaccggccacagggcactgagccctcccattaaggaaaggctccatacatttttctctactttaaaaaatcttatttacgttttgagaatcttatacattttgataacatttctcttcttgtaactgttcctagggtctccccatcttcctacctatcctactgcatattttttctttctgttaaaaacaaaataacacacacacacacacacacacacacacacacacacacacacacgactattgagtctgatttgtattggccaactactcctgagcttgcgggcttccttggcaagcggttaatatatccagtgttactccctgaagaaacctgactttctcttccccataacctctcagttgcaatgagcttcttgctagggtgcgcctcacgcctgctcccccttctctgtgctgggattctgtctgacttgtcctcgcgtgtgccatcagctcgtgtgcatcttacctgtcgggtctggagagtgctgtttgcgccatatctggctcctacagtctttctgcctccttgtctacagagatctctgagttttgagaggaggggtgtgaaaaagacacccagtttagggcccagggtttcaatattggagacagttttctcaattgaagttcccttttctcaggatgactctagtgtttgtgccccagaatgggactgagagactaatgttttctctaaggcgggaattcctagccttgcctccttctgcacttcctctgtgtcctcatcccttggacagttcctaggctgctagggtggagaaagaatcaaggatccagaagtaggttgggatgtacctctgttcacagactgcccagcaggcatgaaggctcagcttcaatcctagcaccatacaaatcaggtgtggccgggcgtggtggcacacgcctttgatcagcactcgggaggcagaggcaggcagatttctgagttcaaggcccacctggtggtctacaaagtgagttccaggacagccagggctatacagagaaaccctgtcttcaaaaaaagaaagaaaagaaaagaaaagaggtgggagtggccaggggctacctaaggatctccttgtgtctgtggcctctatgagatctctagtgttgtccatttgaggccaaatgggggaaactgtcccataagggaaaggcagatgagtagctagccctgcccagagggcgggcaggtccatagggaaaaggagagggagcttgggaagtgatgggcatggagacgatggggaccggggatggtagcgtgtcttgctctcaccaggatccaagtttctccctggtggtaaggaaactccctggctaccttcagcctctcctagccagcatactaggcttgagtctgtgccctggctctcttctttgagacagactcagcctccttgggctccggttcctttatctgcagcgagaaagcaagagcagcactctggagtggttggaggaaggactgaccacttggcaagtaggaactggacttgaatttgaacttgatctgggaaccaggcggacactcttgagaccaagagaacaattcttcccagacgtttggaatcgagttgatgccaaggctagctggtgccaggttgtggtggccgggctggagagatctcagcgagtacacagcaggctactgacctgctgcagaagtctgtgtttatcttggggattctgagtatacttgcttcccatctttatggtttcagggccagtgttgacctagggcagggacggtggccaggctgtcactggactcctgtgacacaataggcgtcgtagccactgacaggcctgatggagcaggctggagtgcggctgagtctgctctaggtggacacggagtaggtggcagccactaccacagctcccctcctcccgtgactgctggattcctgggcttcacttcatggagtcggagacgagagttctgctctgatctcagtttgagcaaatgaaaaccagcttggagtcttccttgaagactgaggtgctattcctatcaggaccccagttaatgggagagtgggaagcgtcccataaaccgggggcagaagggtcagatgcttgtgtggccattccctcaggatcctgagccacttcttccctctctgtgaggtgaggagagcagaccacccccttagataactggagattggatggaaggcctggtgcatatggaggccaccatttgacatagaaaaaagatcttctatatagcctaggctagcctatgtagcccaggctggcctcacattcatttctcctgacactgcttctcaagtactgagattacaggcatgtgccatcatgttaaaataacttctcacactggtggtgcaagcacagaccgcacgcctgtcctttgaactcaggagcttttgggtcctgaggctctgtgggcagggggacctttgccttcgggtctctgctttctgtccccccagctcttctgaggtggctgcagtgagaccagcagagcaagtagcctgctcccttcagctcagccgagctgtgaggcctggagtggctgtgttgtggatttccatagattagggtgactgtcagccctaggaagctggaagctgagagtcctgtgtgcttggcctgggccagcctccctccctgccccctctggagcagcctccacaggcagctggctttggtttcccccatgtttttccaattatgtggaatggtctaaaaacagcagtagcaggggccttatttgggagtcgccaccactgtctgtcctccgcagcctgcagctctgtcactgtcagcgtctccaagtcctgctctttgtggacccttcgccctggtgctctggcttttgtcacctagactttgggacagtgacttaacaacacgtatcctactttgtaggccacaaactatcagaccagaggactctggccaggcaaagctggccactggacctattgctgtgggtcgtgtggacaaggcctagcaagtcacaggatgggcatggattgggtacccccccccccccactccttcaagatgtagttttaacagatgcttaactgtcaggacggtctgggtgggggctgctgaaagaacagagggcctcactgttgggtctgatgggtagttgggacaactggagctactttgactaaccctcatatccagtccatccatccatccatccatccatccatccatccatctttccacccacccacccggacagattagccagatgggcaggcagccctcagccagggccaagaataatgggtgtgtttgttcccagagtctggctggctagtcacttatcagggaagtaggtcaaagggaaaagaaaggaggtcctgtgggggagtctgcaccgcagtcttgattggcattgactttgcaaacagaaggcagctgctgttctcagccatggaccgtgaatttttaatagcaagaaaattggatctcatggtccaggagactgcgtggtaagcctgtatgccgtcgtgttgtgcgtctgtgtaactgaggtgtaactgcatgagaaacacacattttgtgagtgtcgggtcagatcagttctgacagttgatacatgtgtgtaactgccaccccagcgagagactgttttcatcactcagaaagggcctctgggctcctacctctcatccccctgggaggcagggcacaggccatattcttagaaaggaaagctttccttggggttagggcacaggctggctaccagttgatgctttctggctgtggtgagcagtgtgaggtgtcttccacagactgacaatcgtgccatgaccacctcttgcttcatgctccccttactcctgtagcccactcccaactcctgcctggttacctgaggcccctttgtctttggagagcagttatgagttggtagggtcctggagagccctctaagctgtccagaggaacccccaccccaaacacacacacacacacacacacacacacacacacacacacacactctcacacactttctctgagcaagcgattccccgtattctgatctccatcacttagaaggagtcttgccaggtccagagtgactcagctgacacttggacctcctgcttgtcttagagaagtgtataggttccagctccttttggcctccagtctctgtgcatcttgtacctcttgtttcctggaaacaaattagctcctttctggccatgttgcctggacctactcccacccccacacacttctgtgcttccctggttggccactgctccaagcttgccttcagaggcctgctttaatgccatgtctccttggctctgtgtaggtcctctgagggatggcgtgtgcttaggttatgcttccatgtctgctgtgaaggacaaatggatgcagctccctcacttggagcttcccagtggaccagggtcaggcccggggaagctgggtacttcttggtggcaagagctgaggttctctggttatgtctgcgatctttagcagctagctgggatgcatctagtggggccagctttatcctctctgcctccctcagggacatggtgtggcagcatatggtttcctaggcctcctcatgtgcctgtgaagtctgggtttgtgctttatccacttaggaatgccacccgagtcctgcctctgaacttttcagctgtgtttaaatttatttattttgattttgtgagatcaggctgacctcaagcttgtggtggtcttcctgcctctgcctcgagcgcactatgattacggatatgcaccaaccacgtggtttctgtgagccatatggactgctgatagtcaacttcgacctaaagaaaaatgatgttttcacatagtcaagtgtagtcaattatttggactccagccagccaccatggatggtagtagtagtgtcccctcagggtgcagatggctgccatggcataggtctcagccttcgctcacttcttcctggagctgcgtgagggtctttggggtggttctgcttctcagatggggggccacgcacaaaagtgagagagcttgctcacagctgctgatgggaccacagctggggcactcagctcacagcctgttctacatacccttcccggggctccttctgtagactcctgatgcagagcacacagatgttcattaagccttaggcagctctaggagctacaggacagacagtgtgaaaccaatggctgtggctagagggatggctcaggggttgacactttgtacggatggagaacctcactcaggtcatttctcagcatgaatgtcctgccgctctaaacagactgggttgtttgtttgtttgtttgtttgtttgtttttaagaactgagccttgagcccagagctatgtgtactagacctttccttgtcattgtggcagacgctggacaacagcaacacaaaggagggtttggtttattctggctcccagctcaagggcccagcccatcatgatggggatggacagcgggacggatggctgcagggctgtgaggccactgctgcattgcagccagaaagtgggtgaatgcaggaacttagtttactgtctgagaccccagtgtatgggatggtgctgccatattcagggcgggtctcctctgctctgctaagcctctctggaaacaccctcacaacacacccagagatgtatctcattcccagtcctgtcgagctgaccatgaagaacgtggcacggtgaggtgtagccttctttagcgacctcaccagctgggttggagtctcctagccctctgccccaacctttaatttgcccaggcttaaagccattctttctgtgtcacctgtgatcttcattagagggaggagtgtccattgcctcagtgtttggggcctctgctggggctgagataggagctttccgatatgttcccagctcttcccagctttgatggagaactgtttgcacttgagtttcaggtcaagcggcttgttcaaggctgtttggtagagaatgaaggtggtcactgacatcaggccttggagcttacaccgactactgagccagactggtggtgtgagtacctgctcagtggcctgagggtcatggtggagagggaaagcagaggcatatagctgggaaccagtgagaggctgtgacaagagatggaagaggaaggagcacacctgggagaggcctaagattggctctgacttgactctgtgctggacagcgagtgactttgttgagagttatgctctcagcccagaactcaggcctggtgtctgtggggccattcctcatgagctcagccttcctgcacatgcctgttgatctgttcgaggtgagccattcaggcagtcacttgggtctcatgttaggagcagagcccaagacagctctggccacttcctttgggcctgtgaccctgtggtcattaggcagggtttcccagcgtacttcttggcattagcctaaccacttaccacctaagggggcagtggagaaacttaatcaattgctaaaaaaacaaaaagctcttggctacctgccagccgggaagccgcaaggccaggcagggccaggctgtttacagtctctctcgggctgcagagtgaatggagatctgctcagtcactgtactgcccacgcagcctcgggcctcagagctaaggaagaagctggccatgcctgctctgggggaagctgaggaggagaccagggcaggagtcatggggacagagaagggctggatcttagctttgggtcttgaggagaaaggagttggcagggcagagccacagagtggatgcctcccgggctgtgtgcagcctcacagaggggctgggccctttaggggcagcttggtaccttggtattgtggtagactgtgtgggagggctgggctgtcccctatagctgtgaggtagcaactgctctgcctgggatccctgccttctttcttgtattaattgggtcttgccatattcccaaggaaagagtattagttttcttgttgtggtgaggggaaaaaaccccttttccgtggagagattagcttttcagtgcccacagcgcccaggctcctgcagcaaaggtgactgacaagcctgggccacacctgtaggtggattggagtttcggctccatcctgcctcttaccctgctcctccctttaccatactgagaccccagaagccaaagcctcctggcctcgctcggttctggccccagggaagaagccttgcaccctggtcgcaatgcaccctggtcgcatccctcctagtctgaaactcttcccggtctacacctgaccccagttcagaagccgccttcctcatgacaggaaaaatttctgtttacctcagaaaggaaaccgtcaatgtaaaccaggagagaaatgtaaagtattatgtatgtgtgtgagtgcttttcttacacgtgtgtgtaccatgtgaatgtctggtgctttcagaggtcagaaggggtcagattccctggaactggagctccgagtgtttgtgagccaccatgtgggtacttggtactgaacccagatcttctgtaagagcagccagtgctcttaactgctgtgagtcttttctctagcttgataaatagcaacatttaaatgacccagaattcatctggctgaagctgcttgtaacaggtctacacgttttccactttttccccaacaagtgtttattgggtatttatttattattgtatttattttgtgcgtacatgtgctacagtgcacatgtggaagtcagagagcaactcaaaggcgttggttctggccaccactagggtcctggagcttgtacgaggttagcaggcttggtggtggacacctttacccactgagccatctggctagcatgattttcactttccccatgtattcaagtccaaatgcgtatttgtttacagtgtacgtacagacgcgagcgttgcttctcatagttcaagagcattttctatatcattaagtcttctccgggcctgatgttctgtgtctctgtaaacacctataagcatgaatgccccctgagatgtaaaatgaaccccttccctgcctctcttcctcctgtgtattgtgggatgtctggcctgctcgcagcttctcctgtcaggtgttggggtttttttgctcttctggagctgtgtgtcaggatttgtgtctgtgcactgcagaataggctttgtgttgtactcagggggcagatggttccaacctgctctccagaaagcctgggctggctgcaacgcttgaagaagctgcgacacactagatttcaaatagactttcctagcactccgtccgtcgaggtgccaatcactagaggccacttgttttcatagttcttgactgtgacctccctttcccttccctcccttcccctcccctcccctcctttctttccttattaagcaaaagaccttatgttacgtgtttgtgcttgtctgcatgtatgtgcaccccgtgtgtgtggtgatgatggaagttagagcttcaggaccccggaaatggagttcctgatcatggtgatcactgtgtgggttctgggcactgatctaagtcctctgcagtaccagcatgtgctcatagccactgagctctctctccagcttctcctttttgtttgattattgtatgtgcatgtgggcccgcagggcagtgggcatgggggaataaagggagtgggagaaaacctgcgtcccgccagagttctgttgctctgggcgggtggacgcgggaggacagccactcgctttccacacggcccggggtgggtgtctggctgtgggaagctacggacccagccagccactctgggccacaaggggcagtcctaggtagcaggttctcagtctggggcatcccagacaccgctggacaccacagaagagctgaacaaaatgagggccccagggcggaagggaggagagggcagggagacagggcgctgggtggttcccacttgggtgagactccttggtctggtccgtgcaggaaggccttctggcgggaggttagacgaagcatggctggccttgattagcagagacagcctatggttttagagctttattgtagaaaggcagagagaaagagagaaggtagaaagagggagagaggccgactatggccacgtggagagagggggcaagggaaagagaaagaaggagggctagagatgagagtaagaaaggtgagagcttaaagagagagaggaggggccaagcagcccccccctcttttttttgttttgttttgttttttgagacagggtttctctgtgtagccctggctgtcctggaactcactctgtagaccaggctggcctcgaactcagaaatccacctgcctctgcctcccgagtgctgggattaaacgccaccactgcctggcttccaagcagccccttttatagtggcctgggctaccttgctgttgtcaggtaactgtgggggtggagtctagccagaatgccaggagcttggggctttatctacatgactgatagtcacacacctctccctgagggggctgtgggggcagtaacttcggcaggagtcaggggtccaggagacatgattgaacaccttcccatgtaggtgggaatcaccacccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagaaagagaaattttaaaaaaatcaagtatttactcaaacttttagtttctaaactgtttgtttccatgatgtttaaacaggcatcatttactggttctgcaggcaccgagcagtaggcaggcctgtctcctttatgctagcattgtcccttgtcctcctgcactactccaggcctacagttacgttatgaccgcacttaaaaacatttatttgttatttacttatgtgtatgagtgctctatttgcatgtatgcctgcataccagaagagggcatcggatcccattatagatagttatgagccaccatgaggttgctgggaattgaactcagaatctctggaagagcagccagtgctcttagctgttgagccacctcttccgcccctagccttacttttttttttggtttttagaggcagggtttctctgtgtagccctggctgtcctggaactcactttgtagaccaggctggcctcgaactcagaaatttgcctgcctctgcctcccgagtgctgggattaaaggcgtgcgccaccacgaccggccctagccttacttttttttttttttaagatttatttattattatatgtaagtatactgtcactgatttcagatacaccagaagagggtatcagatctcattacgggtggttgtgagccactatgtagttgctgagatttgaactcaggaccttcggaagagcagtcagtgctcttacccactgagccatctcgccaaccgcctagccttacttttaaagatccttctcagagatcagccatgggcaccaccagccttggcaaacatttggtgagaggctccttgcagctcccccttcctagcctgggctttggctagagccttctattatgagccctggaagcctgtgttatacctgtatgcaaggctgggctgtggtcctgtctcagtgtccctgatgtggtttctgtatttttctttgtaaaagtaaaaatgctccaaaatgccatgcagcagtggggttccagaggacctacctgctcaccatgatggagttgcttgacagccatgggtttagctcagctgagaattactgctgtagtctttctcagggtggctaggaagagtccccattgatgactcttctttagggccttgtgctgatttcgctcttagagggcttgggcctgtgtgtagcttggggacactctattggactctcccttgtgatggcagagaatagccctcacacccccgcagcccctcccctcccccttccctactccccacttctttttcatggctacactttgaaattgtgggttctttgttggtcttgctcactctatggtctctgctctgtcaccctggggtgtgaagggactgagtctgtcaccctggggtgtgaagggactgagtctgtcaccctggggtgtgaagggactgagtctgtcaccctggggtgtgaagggactgagtctgctttttctacctctttcttagccatagctggtctcagcctgggctaaggtagctacctataaatagaaactggtggtctggctgagctggcctgagtgagtacaagcatcttatactcactcctagttggcttaagggatcttatgttcccacttgctgctgtgtgcccttcagccaggagcttggcctctctgtgcaccaggttcctggcataatcctacctgatgtgaaaatgtgccttatatgggtgactacgttaggattatggggcaggattagcacaacaggtttcaatatggtttgggggtttccactggggaccagagcttcctgaagtgggagcactgtgtgaagccaggggacagttggcacatacatgctgcctgtcccacacagagaccctgacagttagtgcccttggtcccttcctgagcttctacgagcagacatctcttatctatcacattgactaagcctcctgactcctggcacagtgttagagccaggaagtgtcccaggtgcgttcggcctggagaaacaagcccagtgagtcggagccctgcctgatgctcacaccaggaagtttcagccccagggctgtgtctcctcgggcagggttgacccttgttctgggcttggcactgtataaaaggccacatagccgtccctacgagactgtgggatgaggacattgtcaacccctgcacagtgcaggggttaatggaatttgttgagaatggagccagaggaggaaaagtttgagattccaagttctgcccctctcccctcacagcatgcacctttgcaggcagcctggatttgggtcaagggtctctcacaactattatttctcctcctggtacctcagtttccccagccttgaagaggaagctgctgtgacttcttccttggtggaggagtcagcgcaagtgtcctgacctttgagaggacctcgagcaagccagcatgagtgtaggcagctgcctactgctagggggctacatggtcaggcatgactgacagcaggctgttggcttggaggcccgcaagcgagggaggtcccagcgctttccctgctgcaaaaggctcttaactgaaggtggatggccttgggatgccagaattcatcactggccctgacctccttggttctgtggatctagagaacatcaagggctggaagggatgactaacagtgatgcagctctgggaggaagctctggcttggccccagtagccttgggaggacctggaactcatagagattcatgctgggagtaaggatgtgcaccaccatgccaggccttttagtactgactcttgggccctggggactggaacatgtgaggggcacactgttggttcagaagagactctagtggccacataacccccgaacctacctgtaaaagtctgaacctcaccaagcagccagggtggttagagatggcagtcctgggccaagaaagaacagtcctgctgatgtgcctgaggctctatgaactgtgcccaaggtcccagagtgtcacagcagccgtggaaacaggtttcacagcttctgtccgcaggctctcagtgtccagtgccatgttgatttttgacaactcacagtggctctgagatgtattggaagtgtagtccttgcttatctcctgtgagaccctggtctacagagcccacagtgcccactgggtctaggccactgtagaaggaactggagcctccgggctgggctcaggtggcttggctctcttgcttttggtctctgcctcagtcacctggtgtgtcgagtggtcctacgttttttgttagtgtttctgcggcaggcatttgggggcctctgagctttagagccgggctccctccatcccagtgctgtgcttgacagaacttacttgacacagatgtccatccctgtcagggagctgggtgacagagcaagacagggatgcctagtgtatggagaagaacagagggactggcagttggggtctggagccctgtgcctccagcaggattgtttttgtagagatgggcttgtggtcaggagagggacaagtggcagaggctcttacacacaggtggaagccagatggcctgcccgagggcttccagctggttattcaacctctctgtgcttcagtgttatctcctgtgaaacaggaaaatacagtgtcaggcccacagagcccctgcagcctctgttgtggtcctggctgagccatgcctgtaagcgccactgccggcccaggctctcgggcctgcctcagccacagcgatagacctctgacctcacagcttgtatccccacaggggctgaggaagtgctgctgctggctcggaggacagacctgaggaggatctctctggacacccctgacttcacagacatagtgctgcaggtgggcgacatccggcatgccattgccattgactacgatcccctggagggctacgtgtactggaccgatgatgaggtgcgggctatccgcagggcgtacctagatggctcaggtgcgcagacacttgtgaacactgagatcaatgaccccgatggcattgctgtggactgggtcgcccggaacctctactggacagatacaggcactgacagaattgaggtgactcgcctcaacggcacctcccgaaagatcctggtatctgaggacctggacgaaccgcgagccattgtgttgcaccctgtgatggggtaaggctgagacgacaggtgggctctgggatagtccttgctgcctatcctctgagatatgcagagtcaggactggtctaaaataagcatttctcaaagggcttgcagtgctgcggctgcagttggtccttagaccggacttagaggagctcagggccaggccatggggcaatggtgagaaagcccgagggctgggcaagcaagcataaggacccatgatgactcttaggatccacagtaaaaaatggacaaacaaaaaccaccgaagaactggaaggggctagagaggtcactcagcagttaagtgcttgctgtgcagataggaggataagctcggatccctggaaacccatatgaatgcctagtgggcatggctaaactaaggtggagcctctgaccccagcatctgtgcccagtggtgagcagggctcctgagctagaactttaactgaccagaccctgatggggagggtgccacagaactctgggcgtgatgctgggtggggtcgggaagagtctgcgcttagtgcagggtgtgaacctgtgtgaggggcagggccggtcaggagtggtggctacagtcttctgaacactgtaagcgcaagtgtgttccctgttacggtgacaagctggagtacagcaggagctgccaatgcctacaagtgctggtgccagtgctgtatcctgcctacctgtgggctctgccccaggcttttggtgcagcccattgtgaggccttgtaagccagagagtttgaaggggttatgtgtagaggtccagaagtgggggcagcagttagtgtggagtgtgggggaaggctctgtgctgctctttagtgaccttgggcccaatagtaggcagaagaatttgctccgtggtaatggccagagtgcagggttgtccccaaagaagatggtgacaaggagcactggggtcatttgaagctgtgggtgaggaagcagggattcggtggtcagctcaggttgggaagcttaaggatctactcccagctacaccagaactcagtgaggtcgcagccccatggccacagaggtctcgtgtgtgaactgaggtaggagcagagatcaggcccttcctagcctgtgacttctgagcctgagggtccagggtaatgggatggcaagtgacgtgtgtctgatcccaggtcccaggaaggaagagtgtttcctacacaggggccaggaggcaggtccgaggtagcaggaggcgaggctctaccctgagtccggagtggcctgggttttcttgcattgaaacttctgccctctgcctccaaatttttctggggtcaccatcctgagcatatgggagctttgcttctgtttctagaaggctccctgccgccctcctcccgctgttctggactctagcaaacaggtcagggacaagggtgccccagatgatctacagggtcactttcagaattttcctacggggtgggagctgagcctgccgccccctggcagccctgtgttgtcctgtgctgtgggggtgctctggtgttcctattgagctgtaggctaacaggctagggtaggtgtgtccctcagagttggggcctagcaagggcagaacagacactatcatgaccgtttgctttttctctagcctcatgtactggacagactggggggagaaccccaaaatcgaatgcgccaacctagatgggagagatcggcatgtcctggtgaacacctcccttgggtggcccaatggactggccctggacctgcaggagggcaagctgtactggggggatgccaaaactgataaaatcgaggtgagtgaggccccaggcacagatgtgcatggaggcgtgcacacatgtaagaagccaccctggagagtggcatcatggaaccagattctttagtgttgctctgaagcccagagtttcatgcagaggccaggcctggatgtccttcaccccatccattgtttgccgtgggcatcactgagtggctgtgccctgctgtaatggccaaagagagtcctggaggaaattgtgaggggttgggcctatgacttgtttggtagagtgcttacctagcaccacacacgtggggtagcacatgcctataatctgagcacttaggaggtggaggtggaggcaggaggattggagtctggggtccttgactgcaaagtgaatctgatcacctaggatattaggatattgtctcagaaaataagaaacaaaaaccaaaacaaccaacaaccgctcccccaaaacaagcaaaaggggtatgattacacacatgtctttaattttagcacatggaaagaagaggcagacagacagatcttttgtgagattaaggccagcctggtctaaatagtaagttccaggctagccagaacactgagcccgatcttaaaaagaaaaacaaaatggtttatgggaattgttcagtgggggaatgtggctgctgggagttctattcttggaacccacatgctggaagcaggatcaactcctatgactttgttttagcctctacacatgagctgtgctgcacatgcatgtctgtctgtctgtctctcccatctctacatacatacatacatacatacatacacacacacacacacacacacacaaagaaaaaattttaaaagtttaaaaatcaaattaaatatgcaatctcttaaaaaatggtttctaatgtctcattcccacagactgagaggcctcggggaggtccgtgctggctttaaagcaggaggcaggaggattggtataaatttgagatcagctgagttacatggtgaatcctaggtctttttgggctacatagtaggatcctgtctcggaacaaaacaaccagaaactaccgggtcctcgggtatcctccatgccgcttaggaagtagatctgttgcagccatggctgtacgatgagtgtggcagccttgtaccacagcagctggtggtggggctgacagtccaggttccctgagcagcgccttgttcgtcagtgcctgtgtgtcttcagcagagcccctcgggtacttctgatggaacctcagtgcctggtgaccctgtcagcatcatgagtacttctttactttcctcggggtggacatcttcccgctttttctgataacttcttgctccttgtttgtggctaccacgatttgttgagaccaccattgaggacactctttatggttctggagtggcctgatatgggtggcttccaagagaagagactgcgtctgaaactgttttcctggggaacaggcgtcctcagtactggggaggtgagctgagggtcagaattggctgctgtccttctcttggggacagcgggagctgccttgtttatcatgggcttccctagtgatagtctctgttttgaaaaaaggaaaccatcttgttgctcatgaacttgaaaatgcctgtctcctgaaccagtaagccgaagccagtctcttcctccagacagctaaggaggctttggtaccctagctgccagtgggagcctgacagggatacccggcacccagagatgctggaccctgtagctgttgctctgtgctcccagcagagtagcctttagtacgttcagtcatagccactgcccatgcttctggtccccagcctctggggacacatttcacctttctgtctctgtgactggttttctgggtatacttcctataactagacttctcgatgcaccttttatgtccggctttgttgggaacatattcaggctctgtgctgccccgtgcacactttctcctcttctgtagccagtcacgtgactgtgtgggacacgccttgcagtgtctcctcagtcctttgctcttgtccatctgtcaggaatgagattcctgtctattcatgcacacattttttgtctgaatacagtttcttccttcccttgagtgtatgtctggtagagggattgcaatttaggtggcatttaaagtatgatttactttaccagggaccaataaactcttcacagtggatgccgtagttcatgatcctgtcagaagcctttgagagtctgaattctctgcttgctgttcccccacccccacccccaccccaccccccgtgtaagccataggttcacattaggtgttttccttctctctgcaccaatccaagtagaatctctagttgctgaactctgcccacctgcctctgtcctcttgagaccagccactgtgacagccaccaagctggccatgctttctgtcccatgcagtctgctccccatcctagaaaacctatctctgggatcttctcttggccccagcatctctgggtctggagtttcctgaactctgcttggatttgtgccctcctttgggtcagaatgggatgttctctgaatatccccccccccccccccccgcccaatcctgcctggtttgggaattcatggaagtgtgtgaccccagggaaggtggcagctgcagaattggtcccatgggaaacttgaatgacagcccctccttaggctcaagggtctagggaagaccagagaccacctgagctaattgtgcagatgtgtagcaactagtcatgatgctaaaaagaggagctggcgatgtaacttcctagtgctcaaatatggccttagcatgtacaacacacacagccaccataggacatttctgtaatttctattcccacatgttagagcaggtaagaactgcttactctcatttcttccgggtctaagaggacctgtgatccttactaaaggatgacatgaggtgtggtcccttagtcacacagaggcgttccccctgggaagctctgccactgtgctagcccagatccaatcttgtcctcaccctgggtgtggctggacctggccgagaaagctctggcctcttctcattttgcttcagggcagctcaggagtgggagccaaggcgtggccaccaggtatccgccacccgttttccccagtttctctgtgggcttctttcactgttctagaatggatccaagtaaagtgtgttcctactgcagctcactttaccatgcttgcaaagtttagtttgatcaataggactaggggtgtagctcgggtgataggatgcctgtctgtcgtgcatgagctaaacatggtggtgcacacctgtgatcccagtgttagcaggcagaggcaggaggagcagaaatggtgaactggaagccagcttgggctatatgagatcctatctcaggaaagataaggaaggaagggagaaaaaaaaaagaacacaacaggggcaaggcaagatggctcagcaggtgaagttgcttgtgaccaagcctgtgataattatgttcagagccttgcaacccacatgatggaaggtgagggctgattcctgcaaattctcctctgacttccatactcacactgtggcacatgcactcactcacagggaggtggggcagaggagagggtgcagggatctgaccgctggcgggttgacactggagcagtgtctttcctcgggtggggcttattttctcccagccccagtttggcttgtattgtggaattagtcactaggtaacccagagccctgcttgtccatctcctccctcacctgctcttcctgagtctttctcccccaggagggggagctccctgtgctaatgggttgtgctggggtcaaccattcccccagacggttaacccatagctggtggcctgtgcaccacctgtgtgtcttgtaatgggaacataaggatgaactctagcagggaagtggttgtcagatgcacttagggaggcagaggcaggcagatttctgagttcaaggccagcctcgtctacagagtgagttccagcacagtcaaggttacacagagaaaccctgtcttgaaaaacaaaacaaaaaacaaaacaaaagaatggactctgggctgtgtgaactgaggctatttgttactgccctctgtnnnnnnnnnnnnnnnnnnnnaacccctggcagtaggcagcggaactacactgtcttacctgctgctcttcacctcttgctgtgaactgtagcggtacagtattcagtgctaggcctgccttatagtttttgctgtctgttctcctgatgagcaagaagtacagccttgctcaggaggccagccaagctttgtctgtaattacctggtgtgtttcctcatccttttctctgtgcctgggatgtcaccattgccactgctgatcttcgtgggtcaccagagtcccactcatcctgtggctttaaaaaacaacaacagggggctggagaggtggtttagtgcttaagagcactggctgctcttctatagggtctgagttcaattcccagcaaacacatggtggcatctgatgccctcttctggcacacaggtgtacatgcagatagagcactcatacataaaataattaaaaaaaaaaaaactaacaacaacaagaagaacaccccaacaaaaggagagtcctggggctcatgatggtcttgacatcgtcatgtagctgggaacgaccctgaccttccttccacctcctgagtgctaggatcatctgcgtgctctaccaagcctagcttctggtgtgtgggatcatgccaggtgtgcactgtgccagctgagccacaccccagcctaaatgtttgttttaatcggcatagtcttttctagaagaagacttggctcttctgtgccagcatggacaaggaaggaaaggaccgccggtccgtggggtttgatttatcactagaggtgcccagaagggacaaacctgcccagattgtggtttggcctggccctttgaaactgtgctgtgtgcctacccagggcctaagcagacgttgctaatagatcccaggaagcctttccatagagctcgccctgtaagtagtccaggcccccactcatgcctcatcagcagtcagggagagaggactcttggcctgttcagtgtgcacaccagactacagaggctgtaggacatgggaagtgtcacttgtctggtaacagctggcctcttgtggcacttggttaggtgctgatgaagaggaggctctggggcagcttgagcctgaggcaggccccaggttggttcttggttggtacagcccctgcctatccagactcccgtttttgccctcacacaggtgatcaacatagacgggacaaagcggaagaccctgcttgaggacaagctcccacacatttttgggttcacactgctgggggacttcatctactggaccgactggcagagacgcagtattgaaagggtccacaaggtcaaggccagccgggatgtcatcattgatcaactccccgacctgatgggactcaaagccgtgaatgtggccaaggttgtcggtgagtcttggagctctgagccatggctccacttggccagttggccccaggaaaggtgacaggatcagacgtgggcttggtgtccagaagggtgtctcactctgaggatggacaagacaggaaatggtgactggataggtgagagtaggggtggccagaaagagagaagggagtggtcacagattagctgtgttgggaataactgtggctgatgtgtcacttcttgctgaatgccaggccttggtaagagcttcagtgcctgaggccagctgtatgctaatgctagttccaccccatgagcactggggatggagggacaaggccatttgaggaacaagtggaaacctgggactcagtgcatctgccttgcttttgtcatcgagcctggctgtgattctcaaatacacaccttttacctgacaggcaggatggtaaaagagtgtactttctgaggactccaaacgtgggtctgtatggtggggaccaaggaccgtttgacgaaggatgggctctgttccagtctgccactcccatgcttggtgccacacctgggccatgcttacacgtctcaggtagcctttgtctagtaaataaatgcaggaatagccctcagtggtctgggccactcttatagtcagcaggtaggtgtggtgtttagagagctgcctcagcctggagagtggctcaggagctcacagtgcctcctggtctcctggaagacccaggctctgttcccaacccaaccaactgtaacttcagctccaggggcatccgatgttctcttctgactttcttcagcatttgcacacatgtgacacacacacacacacacataataataaaacaagaaaacaaaagaagacaaaaaaggaaccaaatctatgggctggtgagatggctcagtgagtggaggtgcttgccgccaagcctgataccctgagttcaatgctcaggtcccacatggtggcagaaggcaccaatacctaaaagttgtcctcttaccttcacatgtgtgctatggcatgtgcatttatgtgtgtaagcatgtcacacgtacacacatgtaggcacacaagcaggcacacatgcaggcacatgtacacccacatatatcacgcatacacccatacatattgcattcacatggggacacacaagtacacatgtgtatacactcataccgcacactcacatacacatgtgcacacacacaggcacaagcacatacgctcatacataccacacacaaccacacacagtaaatgcgaccgagctgcccggctttagcagtaggaggcaggtggttgagcttgtatctgcaggatcaggcagggggtgcctggcagaagaagagagacagctgaacaaagacccatcagggaggcagcatgggtgaccagcttgtatgtcctgtcactgtggtaggccacatggcaacctgcagggctgacaggcttcatttcaccagccacctgtgaaaatgcagctggcacgtgcgggcaccgaaggccaggtccacctgcgcccattgggaagcaatcctgcccgggctgccaagtcaacttgagaagctgccccttcaccccgtttgttatcgataaggggaagaacactccttttgtagtttaaattcttaacataagttgctaaggctgtagtttggctggctcagaaaaaaatgactgataccttctgagtgctctaatcaaagacagatgtcattggctggccatggcacacctgcattttataggttgctaagggagtcagtgaattagggaacattctggaagaacaagaagaaccaatgtcatcaggttaggcgttgaggaggagcagttggcgagaggttgagttgtggcaccatcgcttgatgggctgatgtagctcaggctgggccatccctcgtttgcagacgatggtaccttgaagccttctgtactcagtttccactattaacagatgtggtgccctgggactggggcctggcagtggtagggctctgttgcattgtcgctgataactgactatagtagatgaggctttggctgctcccaaccagactttctttcactcctccttccggggtccccttttggtaggtggcaggaatccagtcacacacaactgtgagctggtgctcctcccctttgacagactgctgtcgttcagagctgtgcatttgcctcacaggaaccaacccatgtgcggatggaaatggagggtgcagccatctgtgcttcttcaccccacgtgccaccaagtgtggctgccccattggcctggagctgttgagtgacatgaagacctgcataatccccgaggccttcctggtattcaccagcagagccaccatccacaggatctccctggagactaacaacaacgatgtggctatcccactcacgggtgtcaaagaggcctctgcactggactttgatgtgtccaacaatcacatctactggactgatgttagcctcaaggtacctggcatgaggttgtaaacgcctgcagctttctatgaggccttgcctgtgaagctgctgctcagggctccatactgcttggttttgtttgttttttaagaactgtctattgtattagggctagagagatggctcagcacctgaggatgctcccttctcttccagagggtctgaatttagttcccagcattcccatcaggaggctcactatatccgatacttcagctccaagggatctagtctcctcttctggcctttgtgggtccatagtgcacttaaatgcacttaggcacacacaggtacacatcagatggttttaaaaattaaggaccaaaggagtggctcagtggttaagagcattggctgctcttctagaggatggatctagggtcatgattcccagcacccacatggtatttcctgagtgtctttaagtccagttccaagggatccagtgccctcctctggccctggcaggtactgcatgtacagacacattcagacaaaacaccctaacataaagtaaaagtcaatctaaaaaccattttttaattttaatttttttctgaaatggggtttctctatgtaagtctggctatcctggaactcattctatagatcaggctggcctcgaactcagagatctgcctacctctgcctcctgagtgctgggtgtgtatcaccactgcctagccccatttttttaaagttaaaactttaagactatatgggggttggagaggttgctcagtggttaagaacgctgactactcttctaaaggaccaggggtcaattcccagcaaccacatggcagttcacaactgtctgtagctcctaagatctgactgctcacatagacatacatgcaagcaaaacaacaatgcacataaaataaaagtaaatattttttaaacattagagtattgagactaaggagatattttagtggccagaaagcttgccatgcaaacagcaaatttaagaaccagggttgggatctgctggtgggcatggcagcctgcctgagatcccagcctctgaaggcagaggcagggtgtagctgtctttggctactttgtgatttttctttctcctactctttccactctttcaacaccctaacactagataggagagggaaaaaaaggatagaggagagaggcaaaagatccctgaataaagtcaggggctggaaagagggctatgttatcattagactacttcctgctgattagcgacatcgagttccatggtgaaattttgacctctgtcagatatcttcttctttcttctttgtgactacttaacacaactatcaataaccaacaaccttccctgcctcatggtgccctagccttttataccctttaaaaagttcccagaattccaaatgtcagacagtcacagaaattatgtgtaactggcaaaaattacagctgtgctagagcatgaggcaaatcatagtcagctgctgtggacagtctgaagcagccccatatcccacatctatgattaaaatgaaactatattataatatttctgtgattttaaaagaaagcaaaattctaaaattgtcactagagcaggggatccctgttgcaagctggctagctagactggttgtatggctccgttttggttttagttaagagactctgtgccatgagtaaggtggaggaatgatcgggaaagactcctaacaccagctgtgagcctttctgtacatgcatatatatgtggacacacacacagacaaaggaattatagtatcgaatataactcagttcaggctgataaaatatcaacacacctccttttgtttgtttctgtgttttttccgggctggggcaggatttttttgtggcgctctagctgacctagaacttactacgtagatcagccatccttgaactcatagagatccactcgcctctgactcttgagtgctgactctaaaggtatggtgcccacagtttaataagcaaataggaatgtctgtgtggtaggtccaggtgacatgcccatttaaagtgctgtaggaaatgcttggtgagccttggcactgccccatgctctcccatagccgtttacctcacagctggtcccactcacagtgtgggtgtcattgttctggatggggagcagggaggagacctgtctcctaaacggggcctgtggagtgtgctgattatgtaaatggttgtcctgggatatcgtggtgcctgtgtgtttaggagctgcctgtggctgttcttgtgccgtcaggctgaggaaagcggctacatctgggaggtgagagaaagctgaaatgctctttgttctttttgtaaaagttggctgatctctgctctaattcattagataactaacccacttcaattacctttcttaaaaaaaccaaaatcaagctagagagatagctcagtggttaagagctctgaatgcccttccagaggacacaggttcaattcccagcacccacatgggggttcacaactgtttgtaactcccaagatctgataccctagcacaggcatacatgcaaaccaccaatgtacataaaacaaaaacaaaaaaaccccaaaatcaaatcatttatcgttgttgggtatagtggtgcatgcctgtagcgctagtacttgggggtctgaggcaagagaattgtgaatttgagaccagcgtgggcgatcctgttccaacaaaggaaggtgaggccagggaggaggcgaagaaagaagatcacccacatcttacgttactgtttatttcttgtggttatttacttatttatttttaatgcttatttttatttatgtccgtcagtgttatatacactggtatctgtggcgatcagataagggtgtcaggtcccttggagttggaattatgggcagctatgaaacacctggcgtgggtgttgggaacccagttcaggtctctgcaatagcagcaggcactcctgacaactgagccatctgtctactcctttcctaattcttattttgtttgtttggtttttttttctttttttttttttttttaagacagagtttacctatgtagtcctgctgtcttagaactcactctgtagaccaggctggactcctgcctctgcctccctatgctgggattaaaggcatgcaccaccacgtcagggatttttttgttttttaaagatgtatctattttgtgtgtgtgagtgttttgcctatttgtatgtgtgtgcaccacatgtgtgcagtgcccttggaggtcaaaagagtgtgttggattccctgaaacagacttatagatgcttgaaggtcatcatgtgggtgttaggaactgaacccctgagatccctccagccacgcccccttccctgattattaacagctcttagagcatttcttcttgtttgaaaaattctttgctgtatatatacacacccacagaattttattttacttatgtatgttgtggaaaatctccaaccccaataagcccatgcaaggaaaacccagttgtgtatttataaaccgcacgcctatattgggcagatatataccgttttcttccccagctatgaaatcctgctacttgcagtgtctccaggccatgtacttctgctacatcttccttccaacatctctccctctgtcctccatttgcaggctcttgcaactcccccccccccctttcttgtacggagagccagcctcctcactttcgcccagcgattggctatttgtcatctttcttagccaatcagataattaagatgtatgtgtatgtgtgtagtcctatgactatatgagcacatgtatgttcagtgctcccagaggccagggagaggtcagatccctctgaagtagatttgcctgagtttgtgagctgtctgacgtaggtgcagcgcctggcctctagttctcctgactgagcgagcagcaagtgctctgagctgctcagccatctctctgtcccagccctttatgttcttactcactcccagattcaggtgtgattacaagtgtttttaagcctcgtgataaaggtcatcttttttatattatagtcatctgtttggagactcggctctgtctcctgggtctgctggaccctcacatgaccctttccttcctcatcttcgcagacgatcagccgagccttcatgaatgggagctcagtggagcacgtgattgagtttggcctcgactaccctgaaggaatggctgtggactggatgggcaagaacctctattgggcggacacagggaccaacaggattgaggtggcccggctggatgggcagttccggcaggtgcttgtgtggagagaccttgacaaccccaggtctctggctctggatcctactaaagggtaagggctgcttttgtctgtcgtatgatgcaggcccctcccgtctgtccacagggcctctgcctcagagtggctggccccacagagcacctggtgcttgtcactagcctcaaaggtgccagggctgggaggatcctagaagattatctttctcattcttagaggggaaacttagactagctagcattgacgctgctgtcaggcactaatgtaaaaaggcagagacaacgtcatttgtaacacaagcattggagagccagacacaggcagattctcaggtttgctggctagccagtctagtcaaatcggcaagctccaggctcagtctgtctcaaaatatgacagaaaaatcagtgaggaagatactcagtgttaagctctggatggacacacacatacacgcacatgtgcacgcacacacacatgcatgtctgatgccagctcaggcctcctttctgcaatggtgaccagcctgcccttcatagatggcgctgaggcacttggatttatgactgttcagaaatgttggtttgcaagctcttggccttggcctaagatccacctaaggaggagccccaccttgggagctgaggcctggtgggccaggtctggtcttttctggtgctaaaagacccttttggagcagggcacatactcactctatagagcatccacactgccatggggacaactgaaccctgcctgaaacagaagctgtgagctcaggatggcaggaggaagacaaaggaccaggtgctagcaaaggccaagaaagtcttccagatcttagaatgacggtgtgggcagtctttccagatgtgcaggggcagaggaggaggggcccttctgtgctactttagcactgggcaggttttcactcttgagagaagggaccatcatctggacctgcccacatctctctctattccgtgagacacaccagcactcggccggcttagtgaagatgtcgcttgctttagcagttttgtctgatggcttttctgcatgtcctgtttggctgcacgtgggttcttcccataccctgagaagagtcagcagtgtggaagaagctaacccgaggtctggctcctccttactggggaaacatcactgaccagcttcccccagggcaagagggttaagtctaggaggtgttggttcctctctgctgtattctctgtgtttagcaaggattcaactaagctggcatgcccctctcccctttactggtatcttccagctacatctactggactgagtggggtggcaagccaaggattgtgcgggccttcatggatgggaccaattgtatgacactggtagacaaggtgggccgggccaacgacctcaccattgattatgccgaccagcgactgtactggactgacctggacaccaacatgattgagtcttccaacatgctgggtgaggctggtgacctcggaggtggggtgagggctgagtgacagggctctcgcttccccctccttatgcatgccagcctgctctgtccaatgagtcacttggcatcacaaaggcaaagacacaggattcttcccctctcctgcggcatgtccccatctagccctggtatccttactaggaacgtgttgggaatggatttccggactctaggtcccagccaaaccctgagccaggactggtattttaccttctaccacatgatggtgctttttattggagggaaactgaggctaggtatgtagtagggcttgcttgatatcaccctgcaaggactctttagagcttcccaggcctagatttggcctccaccagctagtagcaccaattccttctgcatccagacccctttctaacctatgtatttaaaaactaagctttgagatatttttgtatatgtttttactttttagaaataatgtttggttgggctgtggctcagttagtgcaatgcttgcccaccatgcgtaaagcccatgggttctatccccagcacataaactaggtgtggtggtgtaactcatacgcccaggactcaggaggtggaggcaggagcgtcagaaggtcaaagtcacccttggatatatgaggactttgaattcagtctaggatacgtgagactggatgcatggatggatggatgcatggatggatggatgcatggatggatggatgcatggatggagagctgtttttgaaacttaactttcctttaagtcatactgtatacaattttctgcttttttgtgacccccctatatacgacaaacatgttttcacatcataagcttgtctttgttggtaccatatgtgccatgattagaacatgggcttacagctcacaggctgtaacatgaagatgtgcagggatggacctgtgcctggtcgagaggctttgagatcctctaggctccttcctggcctgggaccttatgctctgctctgccagacttgttccatgtctctctctgactcagggctcacgcctgttgtatactgggtgcatcagtgtgccacaccctagtcaacaggtagcagaggaaaataggtctgccagtccactctgtcatctgctctcggaggggctgggcctgacctttgagatctcagatatctgttcttttccattactctgagtctccatggggatgctatagccatgtgactgtggggatcaggtataaatggcctgtgtgctcaaataggtaagatggagttaggcatgctgactcaagcctagagtcccagcagttggaaggctgaggcaagaggatcatcatgggccagctgaggctacacagtgagttttctagacttccctaagctgtagagttgaaatactgttggagtaaacaaacaaaggtcctgtctactgaaagctctcctgtgagtgtcttttggctgatatccagatttctctctgaggacgatgggtgggcttgccacataggtaggcaaccagtctacctatgcatgaggctactcaggcttccctgcttggctgagagtcctgtaaatcaaggttgactgactctcccagaggctccctcagctcattggcctgctagctctcttgctgacatatgtgctatgtccccgcacaggtcaggagcgcatggtgatagctgacgatctgccctacccgtttggcctgactcaatatagcgattacatctactggactgactggaacctgcatagcattgaacgggcggacaagaccagtgggcggaaccgcaccctcatccagggtcacctggacttcgtcatggacatcctggtgttccactcctcccgtcaggatggcctcaacgactgcgtgcacagcaatggccagtgtgggcagctgtgcctcgccatccccggaggccaccgctgtggctgtgcttcacactacacgctggaccccagcagccgcaactgcagccgtaagtgccttgattcccacttgctgcacgcaccaggccttagcccctgagccaccactgtggctgagattcttccagccaccagaatggctcctgagtctgtgttcttgacgctataagcctgtacaaccccgtgttactttcatggcgggggaagtgaaattcagaaggccagggaatgacttcccagtagccctctgaggacaggtgtgtcttgtcagcaggctccatggtgatatgatattggcagcgagccagatacagactggcctccagctagagctagacagtccctgaggcctctgccatcgggtcttgcgcatcacccatacgtagcacggctctgctgcctttccctgttgagcaggtgaggaccctgagatttgaaagggtgggaaatgtacctgaccctgagctggtctgcagtggccacagccagagtcacctccattttgtctgtctgtgcactacatgtgtgtagtgcccagagaagcaagaagccttggatgccctggaactggagctacagacagttggtagataccacataggtgctgggaatagaaccccaggtcctgtggaagagcagtcagtgttcttaactcctgagccacctctccattattattattattattattattattattattattattattattattattaattatttttgagatagagtcttactatgtagctggcctgcaacttgctatatagacaagactgccctcaaactcgtggagattcacctgccccctccttctccccctcccccctcctgagacaaggtttctctatgtagcccggctgtcctagaactcactttgtagaccaggctgccctcgaactcagaaatccgcctgcctctgcctcccgagtactgggattaaaggcgtgcgccaccatgccctgcttgtccccgcttttctgagtgctgtgtgtccaccatgctcagctgggctgttcttgaagcaggtaggggagcagaagcaagaatgcttaacttcctagtgtcttggaacagtggcttggatttcaaaccacccactgtaacacactgatcctggaggctgcctggtacacatctgagtatcatagttcctgaatctgggcagctggccttgggcctcaggacctgggctccctgccaggaaggagagcttgctttctaatctccccaaaagcagttttctcctgttctgctctctgtgggtacctgtattcacatccacactcccacactccccacctcttgcacacaacttaaaaaataataaaagcaaatcttaaaataatcccgggactggggtagagtgctgacctagcatgggcaaagcaaatgtagcatggcataaacagggtgtggtggtgcatgcctgtggccccagtacttgagagatagaggctcttagtgtttgaggaggatgaagagtgaagagagtttgagaccatccttgacgtcctggacaagttcaaggccactctaggctagaagataccctagattaaaaaataaaataaaataaagaaaaggggggaaaaggtgtgaatttattcagaacaatcatacacttttgtgatgatagcagaaatagcgcagaatccgtgccagctgacagttctgtgtccgctcttctctaagaggcccagtgtctgtaaccactctgggtgtcatatccctggccccagcctctcatctccctcttactgatgctttctgctcagtctgtttgtccagcttttcagcttgctgatgttctctgctaggtctgtctgtccatcagccttagctggctatgcttgccactcagtctgtttatccagtcccttagctttcacttgctaatgctctctgctcagtctgtctgtcctgctccagcgccctcagcttgctgatgctcggcgctcggtctgtttgtcccactccagcgccctccaccttcttgctgttcagccagaaatttgccatcagccggatgatccccgatgaccagctcagcccggaccttgtcctaccccttcatgggctgaggaacgtcaaagccatcaactatgacccgctggacaagttcatctactgggtggacgggcgccagaacatcaagagggccaaggacgacggtacccaggcaggtgctcctgagggcagggtgtgggagatgctctgcccagagcttgccctgctggcttccaggctgctccccttttctgggcagggctggtggcaaacaaggatttgggctccagttatgtaattataggtgtgatcctggccttggacttacgagaaactggctttcccagttgttggtaggggaagggggttgggtggtagtgggtcaggctttatggatcttttgtccaatgtggttttctgttgcttagaaacactacatgcttcctttattttataagatgcatgcaattaatctttgtgtgtgtctgtgtttatgtgtgtgtgtgggaatgagacagcagtgttgggtgttgttcctcaggagcaatccaccgggtttctccttgggacctgggactccctgatcaaggtgggatgctggctggcaagtcaaagagatctgcctgtctccacctctcaagggctgggattaagaaagtgtgccactgtgcacagcttcccaatgtggggcctgctcctctgctcacagggcaagtgcttttcccagccatctcctgtgctgctaattctgtaatataaactcacaagcctgagcagattaccaaagagaacagttgggcttctgagacagagcctggtagggttggagagagggctcagtagttaagaagacagtttgattcccaggctgccttgggcatacccatggtacagagacatgtacagaggcaaaacacctatacacattaaaataaataatagtaggaataacacccccgcccccagtggcacatagaaagcaggttggggttgtgggaagtgttggagcctctttgcctggccagtcagtcactcctgcatctgtgggtgtgaagctccagggactcagtctgtgagccgtgtgaaatggtggcagggtggtcttgggaagcaggaggctctgactcaggtgtggctggatgtgcctcatagcacatgaatggagatgtgtgcgtcatgcagtcttcctgcagccacaggccaggacagctgtctgcactcaccttttttccattttgtgtgtatgtgtgggtgtgacacgcacgtgcatatgtcctgtttgcatgtgtagggtgtatctttctgtgcacatgcatgcgtatgcgtgtgttcttgacagtgatgttgggaatctttcatcttactgaggcagggtctcatagtcaaaccgatagtcctgctggtgcgcttgctctgggatccctgtctcacagcctttatggctgtcatgctcagcctgtgtgaatttctgaggctctagcctgtgtgcgcagcaagctctttaaccattgagctgcctcctccatgcttgttttgttttttgagacaggtttttctgtatcccaggctggcctcagattcagtctgtagcataggctggctcctcatcctcctgcttcctggctcccaggtaccgggactcctacagttgggtgctacctcaactggctttttcattcttcttatgtttcccttaaatgaaattgtgtattactgaatgctaagcctgaattcactttaaatttttattatgtttatttaactattttgttctatgtatgtgagcaggtgacatggtttaagtgtggaggtcaggggaatttgtgggagtcagcgctccttcaatatatggatccagtgtcaggcttagcagcaatcatccttacccagtgagccctttagccagtctactgtgttctccctctctccctctctccctctccttttccctctccctctctcccttcccnnnnnnnnnnnnnnnnnnnnaaccccctctctatagctctggatgtcctgggacttgctatggacactagactggcctggaactcacagatatccccctgcctctgcctcttaagtgctgggattaaaggcatgcaccaccatgcctaattagcccagttttcaaatctaacagagttgagcttctcccggtctgtgactagtccaggaaggacctgcctcaggaagcctatcacaacagccacagaacccagtggcccctttcccaatgtatgctatgggacagctatgttaaagcagaacttactcccatgggctggttttcagatctctggaaatgtagatttttttttgttaaaaattaattaatacattaatttgtgtgtacgtgcatgcctctctgtgtgtgtgtgtgtgtgtgtgtgtgtgtgtgtgcccgtgcatgcgtgactagacactagtttgatccctttaagctgaatgactgtgtttgttagttacttttctgttgctgtgataaaacaccctgatgaaaatcacttaaagaagaaaggatgtgtctcacagttcaaagttcaggctgttagagctcaagctaaggaggtagaagcagaaccaggcagctggtcacattgtgtccatagtcaagaggcagagagctaggcctgggggcacacttctaatcccagtgcttgggaggcagaggcaggcggacctctgtgaatggttctagaccacccagaactactttgtgagatatgtctcaaaacaacagtgtatcagcagagagcagtgtatgctgtgttgtctgtctgtctgtctgtctgtctctctctctctctctcttttattatttttttacatttctttattgaggtatgtgccattgcatgcatgcttggggcggggtcacaggacaccttgtgagagtgagttctctccttctaccgtgtgggttccacagagcaaactcgggtcgtcagacttaccagagaccctctctgccttctttttatgcaaccagaatcccaggcaggaaatggcgctatccacagtaggctttcttgtctagattaacccaatcaagataatctcccaccagtttgcccagaagccaggtgatctcccaggtaatactagatgccatcagtttgacaatttagacaaaccaccacaaggtgtatatgataaaaatcctcactgacctgttaggttgtcaagtcatagctataggttcgactctccttttctttcttcatattcttcttcctgttcatcctcttcttcctttccctctttttcctcctctccttcctccccttcttcttctgttagtggtaggttcgactccccttcatagtcttcttcctgttcatcctcttcttcctttctctcttcttcctttccctctttttcctcctctccttcctccccttcttcttccgttagtggtaggttcgactccccttcatagtcttcttcctgttcatcctcttcctttttctcttcttcctcttcctttccatcttcttcctcctctccttcctccccttcttcctctgttagtggtgaagatagtggctggttcttcaactccacgctgggcaagtggttccaggctgtcacctcccagacagtcaccttgagtactatggatgactgtagcttttgtgtaagaaagcgccatgctacaaatcttaagtcctgtgactttcagaccctcccctccccttgtctgcctcagacactttcctgcaccacccagtccttcccacttctccttgcctgtcccagataccccttagctgcatttgcctacccatcactcgctgtacatccttgccttgctccaccctttgacccaagagcctcacacctgccctatgccccttgcctggctctgcagcctgggtcccctctccgtgcataagaagagaggtatccctctgctctccattcctactctcctggccactgaattaaaagaacaaggtttgaacatcgaaagccaagagcctgagtcctaaacagtggaaatgaagggagagaggttgggcttcaggtctcatgtctatctagttgacagcctgccagtgtcctctggtggattccatcatgggacctagagtctggtgtcctgttggggctctttctagtttgttctgtgtattcgtaaatgggcatattactaagatctaagttgagggccatcgtgatggctcagtgggtaaaggtgtttgaaatcatgcctgatggatggcctggtttcaaatcctgggacccatgtggtgcaaggagagaaccagctctcaccatttgtcctctgagcttcacacggtgtcgtgaaaggtgtgcgtacacacatatgcacaaaaccaaccaaataaataaacttgtttttaaaagagccgggtctgcaagtaatgcctcacatgtgttgaaatcttaaccttgaggctgacttgcccttctgctctccctgggtgttcatggcgcatggcagtgtggtgctagcttggtttgcttctctctcacagccctccatgctgacctctcccagccaaagcctgagcccagacagacagccacacgacctcagcattgacatctacagccggacactgttctggacctgtgaggccaccaacactatcaatgtccaccggctggatggggatgccatgggagtggtgcttcgaggggaccgtgacaagccaagggccattgctgtcaatgctgagcgagggtaggtggccctagggagggacgggtgagggctgcaacctgctcagcccatgtagtcattcgctggcccccgtgtacctgtagtgctggcctcgtgggggctagccagtgttcccaatgtggtacccaggacccccagctgcacaagctgaaggtgacgtctaggtggtggtttggggaccctggggatgtcaaccctgctgcatgggccttgtaccagtctgttcagcttgatctttgtggctgcaggattctgccccagacacaactcaaagtgcgtccttcctgggatcccccagcgcccttgtgtgctggtccttgtagtgccttgttagtgagagacccttggacaggtgcccacgaagctcaagaacaaagctgaacttgcatagaggctcaggcaggagctcactggcctttaagtcctgtggggtagacatgtaaagcaggtgttagattggcagggtgttgtctatagggttcccgataatgatcagagcctgatgtgccagtgttcaaatcctgactcctgcacttcgctaccgcagtgatggtgggcaggtgatgcggccttcagaggcttggtgtccctttctgtgatggtgacggtgatgtcagtctttcagcccatagatagctaagtagagcctagctgctggagggcgctgctcaggagctgtgtgaacaccctctgaggaggtgggaacaaatgttctgtggctacaatgttgatccatatactgtctcagacacttagtgtcttgccacttcaggttttccctctgaccagttgcttctctttgcttcatggccttctcttttcagcagttttcactggattcagggctaccctcacacacaaggattgtagctcaatcctaatattttccaagaccccatttccaaagaggctcataccctaagttccagggtggcatgaatttcagggacactattccccccaccatgaggtataacccggcagcctggaggacctgtgaggtcaggggctgggctgggcctgcggatgaggtgggagctcacagcgcccgcccacttcttccctgcatctcccatgtgctgtgcttccgcaggtacatgtactttaccaacatgcaggaccatgctgccaagatcgagcgagcctccctggatggcacagagcgggaggtcctcttcaccacaggcctcatccgtcccgtggcccttgtggtggacaatgctctgggcaagctcttctgggtggatgccgacctaaagcgaatcgaaagctgtgacctctctggtatgcaccctggatgtctccagccactgagtcctcagtctgcaactgttgggggtgaccctaccgtgcgctcccagccttccttactaccaataggggtagcagttaaaatcttgctcggcttgctgtgagcctggcattgtgctgtgagcctggcagctctgtattcatatgtaatccaaataccatgggggcctggctgtgagcccctggactacggatcctagtgccttttcttctagtaaaagctgtgtgattggggaggtggctcagttggtaaagagcttcctatgcaatagaaggatctgaattctgatccccagcacccttataaacagccaaggtctatggcccatgcctgcagtcccagccaaggactgtggcccatgcctgcagtcccaacagaggactgtggcacatgcctgcagtcccagctgaggactgtggcacatgactgcaatcccagtgttaggaaggcagagtctggaggatccctgaggctctctggccagccaatctagccaaatctgtgcactccattttcagtaagagatcctgtttcaaaaagtaaggtggagaaccagccagatgactcagtgggtaaaggcccttgccaccaagtctgaagacaggagtttgatccctaagacccacatggtggaagatgagaacttactcctctagcaagttgtcttctgcaagtgtgctgtggcatgaccctcctcccccatgaatagaagtaataaaaataaaaactaagggtgctggagagatggctcagtggttaagagcactggctcctcttgcagagggcctcagtttagttcccagtacccacatggcagctcacaaccatctgtaactccagttccaggggatccagtgcccttttctgggctccttaggcactgtaggtatatggtatacaaacatacatatgaacaaaatacccaatcacataaagtaaatatttaaaggtcaggtgtagtgatccatgctttaatctgagcatttgggaggcagaggcaggtgaatctctgtgagtttcaggccagcctggtttacaaaggaattccaggacagccaaggctacacagagaggtcctgtctgtcttttattctttctttcattcattcattcattcattcattcattcattcattcatttattcattcatactacatacatatatacatacacaccttaaatgataagattgagacttctggccttcatatgtatgcacacttatgtagataaatacatccacataaatactgggcgggcatgggcacacacacacacacacacgatgagtgaggagagaaagcaccatgcttacagaggccagtgatcatggtgcagttagatggtatgatcctgaaccctaggcccgccctggtgcgagcagcctgcttatatggtatctgtcccagctcccagccctggagagtatagaaatgccccagactcgcatggccccttctttaaatatgcattctcctgagcacagtgggtctggcccttcacttggctgccactcatggagcctttatgctaaccacaggggccaaccgcctgaccctggaagatgccaacatcgtacagccagtaggtctgacagtgctgggcaggcacctctactggatcgaccgccagcagcagatgatcgagcgcgtggagaagaccactggggacaagcggactagggttcagggccgtgtcacccacctgacaggcatccatgccgtggaggaagtcagcctggaggagttctgtacgtgagaggggacagtgtttgtggtggggtctcctgggggaaggtgaatcagccctactggcatcagatgggctgctggtgcaagagcagtgtgcctgaggagctcatgggctcagcaccgaaggccagtgcatgtccagatgtctgcctcttcgatcagtttgtttgctgatatagagaagtacccaaacatgctttttaaaaaagttctgtctgtcttctacctgcccacctacccacacttctaccaatatcattctgtccatccgtccatccatccatctctgtcacttgtctatatttatcatctatttgtcagttggcctttgagacatagtttctaggtagccctggaattcttttttggtttttcgagacagggtttctctgtgtagcgctggctgtcctggaatttactctgtagaccaggctggcctcgaactcagaaatccgcctgcctctgcctcccgagtgctgggattaaaggtgtgcgccaccactgcccggctagcctggaattcttgacagttctcatgagtgctggaattctctgagctgggggaggggaggcagtacacatcatggcagtgattgtatgatgaagaaggctacatgcttcactggcagaaacccaagcacaaaggagagaggtggaatcccactgtctcctgtaaagacacctccccacccccacccccatgacccaaaagctctccactaggctcctgctgttttgttttgttttgtttttgcagtcctcagagtgaatttaggtctctgcttgctggataagtactctacccttgagctacacctccagttaggtcccactaggtcccactccttaaagttctgctgcttctcagtagtgccccagtggcaagtacctctcctgggaagtgcaagtctctgagtttcaattaccaaaagaagaaaggaccttccatccgctccccgaggtgcaaagccatcggggagcatgtgtccaaatggacagcctttcttgccagctgctccgatgccctgggggtatactgtgcttttccagggttcagacctgtggctgcccctccatgctgccacagccttacagcagtctgactcctccctagccccacagggaccatcagctgtccagagcttccctcctggctaggcatgatgtctctgagtaccttccttcttcatgctggaatggtggttgggttgatcttgtgccggtggcacggctgctgtacaggtacagcgctgctgccagactcggtctttacatcagattccatgtcagtattgattgactgggctgggagctgggaccaaatgagatggtcttctataggaatctggcctttgccttctacacacgttgagctctgaggaggaaggtagaggctgacccaactccatcttgctgtgtccctgcagcagcccatccttgtgcccgagacaatggcggctgctcccacatctgtatcgccaagggtgatggaacaccgcgctgctcgtgccctgtccacctggtgctcctgcagaacctgctgacttgtggtggtgagtgagaccttgggactttgagtagggagccatatcactgccttgcatgcccgaaaactgtgtcgaatctccaaagcatgccatttctttacttatggcttctctctctctctctctctctctctctctctctcccacctttttttaaaaaaaaacactcatacatacatacacacacatctagtgctatggttttctcccaaaaaactgcttttcctgcatctcacagattttaatacgttgtatcttagtttttggatagttcagatgtgtgtgtgtgtgcatgcacgcgtgtgcgtctatgtgctgtgtaaactaggggttaatcgtggctgttattcctcactttgcttttttagacaaggtttctcactgggaattggagcttgccaatcaggctgtgctatctgtccggtgaccccaaagatcctcttgtttctgctgccccagaactggggttacgagcatgcgtcatcacacctggctttttacgttgtgtgctggggattgaactcaggtcctcacacttgtgtgacatgtactgatcccgttcccagtcgctgaaatatttagaaaaaatttgagagacaactttcttcagcccaagtgctatttagcagtgtgttgtgaagtgcaggttggctcagtggtgagtacacttgcctagaagtatttgatctctagatacttaggagtgtcccagctgtctctgttctgatttcctctttaattctgctgtggtctgagtgctacccttgtggcatctctgttctttacatacattgttatgtgctctacggcctcgtgtgtttgggactcagtagatgtttcagtggtcttgaggagactgggggttctgctatgtcaggtgtaatagtctagaaaagtttattagattcggttgattgctagtacagatcagccgccttttctctttcctgattgcttagtccattatcagttacggacagggttgttggatttacaacagatttaaacaaagatttttttttttttatattgtctgtgtaaatatttgcctacattcatgtctatgcagtttacattgtccacagaggccagaagaagggtagtacatccccttggaaccagagttacaagcagttatgagttgtcagatgggtgctgggaactgaactctggtcttctgcaagagcagccagagctctttagggtctccagtcccctaataacagatttctgcttctgacctttctcctaccccctccctatatccttttcccctggggctgcatggttgtgatggtggtgtgtcatccagaaacaggcaaggaagacctaggttcaaaccctggactctgacttctaagatgagtgcctttcagctggacacatgccttttgtgagccactgcttccccctgtagagactgagaccatctacctggcaggctggctttcctttaagtaacagagcacttgtggggaatggccataaaagtgacagtcttcaatgctacggtgattaagcgtgcctccttcggggcttcctctctattgtgtgctgggcagcctgggaagagttctcaccagcatcaggcttcatccttgctcgtgacttcccccatatactttggactttcactgagcaactgagcattgttctctaatggctagtcctgctcctgggagactggtctgatacttcaaaccttacagtttggccaagaacagagagggcatttgctgtctgtccattccctttcacgtctagtagcttaaacagacttgtggtctgaagctgctgtctgtgtggctcccgtggatgcctgagcctcctgcctagagcggggactatggagtggcccccactgatccaggcctggctctccacttaggagcatgtgcttagcctaccgtgagatttggaagtccctccttttggtttgtttgtgttgttttgttttatttgtttggtctttgagacagtgtctcttgcagtccaggttggccttgggtttctttttttttttttttttttttttttaaagattttatttatttacttattatatgtaagtacactgtagctgtcttcagacactccagaagagggcgtcagatctcgttacggatggttgtgagccaccatgtggttgctgggatttgaacttccgaccttcggaagagcagtcgggtgctcttacccactgagccatctcaccagcccctggccttgggtttctgatgtagttaaaatcaaccttgaactgcagatccttttccatttcccaaatgctgtgactacagggcatctgcctttatcctcagtttgaggtctctgctcacagcctgtgagatgtgtattttcaatgcagacactttgcaatcttccatggctacttgtctggtcacaggatgaagggcttgcttaggcccttagatggaagccctgtgacacatcaggcaagtgggaaggcaggccagggcctaaagtgcttcagtgcttcaacaatacagccccccactccctctgtgtggcttggcctagccacacacctgttcctgccccacaggcctgtcactcatgcagtggaacctgggtgtacagcggaggagatggaggctttgagatgcttaggaacatctcgggttttccatcctgaatatggtgaatgtcatgattgctacttaattcaaagttcacagtcagtccatgttccttacctaagaaaagagacatggaggggctcaatgggtaagaacacttaattgcaaacatgaagacctgaattcaaacctccattagccacatcacaggcaggtgtggctcttggagtacctgtaaccctagtgctatggggagaaacagggcgtcactgaggcttgctgactgccggcaagctccaggttcagggagaggccctttttcaaagcattaaagtggaaagtgatggagaaagatgctctccatgtctgcataggtgtatgtacctccacatacatgtgcatatacaacacacacacacacacacacacagagagagagagagagagagagagagagagagagagagagagagagagagaggagaaaataagagagatattgaggctgtagcttggttggtagagcacatgcacaaggccctgggttcagtccttcgcactgtgttaaccaggaatggtggtacaaacatgtaatccctttcctaaggaggtggaagcaggaggatcagaagctcaagctcatccagggccctgggttcagtccttcgcactgtgttaaccaggaatggtggtacaaacctgtaatccctttcctaaggaggtggaagcaggaggatcagaagctcaagctcatccagggaagtttgaaagcaactttttcatccctgcctttatctgtgctggggctgaaggtatcacatgagcaggagacagtccccagggcactgctgacacaaagtcagtggaagcgcagcgatgcctttgcgtggctcgctgggtggagcctgcatgactgtggtctccttccctcccctagagcctcctacctgctcccctgatcagtttgcatgtaccactggtgagatcgactgcatccccggagcctggcgctgtgacggcttccctgagtgtgctgaccagagtgatgaagaaggctgcccagtgtgctccgcctctcagttcccctgcgctcgaggccagtgtgtggacctgcggttacgctgcgacggtgaggccgactgccaggatcgctctgatgaagctaactgcgatggtgaggccctaccctggctgccatctccctcccaggtcccattaaagccatttgtccttccttcctatacatcaaacacggggctccattttgccttccacaggtaagggtgctagaaaacagctaaattggcaggccgtcttggtgggaacaaatgaagtaagttttaggcacagcctgaaggaatgctcctgcatgaccccatctattcttcgggcagttgacttaaagacaggctgagactcacatttccacatttccacatttggtagtgacttctgcagaaatgtaagataaatccattagtcagttgctttcagggctcacacccggtacagtgtcatcttcaaaggcagtgccacactcactgcattgtgccatctgtgggataatgctggccacctgggaccactctgactgaccacgtgtgtcccgtcgtcctgtccccgtccccgttccccgtccccgtccccgtccccccgcttttgagatagggctttatatagcctgggctaaccttgagtttgctatgtatctatagtcttgaacttattctttttctacctcctacatgctaggattataggtatatattatcagtgtgatatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgcagttatactcttttttttttaaagatttatttatttagtatatgtaagtacactgtagttgtcttcagacaccccagaagagggcgtcagatctcattatggatggttgtgagccaccatgtggttgttgggatttgaactctggaccttcagaagagcagtctggtgctcttacccactgagccatctcaccagcctgcacttatactctcaagacatctttttttaaagacttgtttattatatataagcacactgtagctgtcttcagacactccagaagagggcatctgatctcattacagatggttgtgagccaccatgtggtcgctgggatttgaactcaggacctttggtagagctgtcaatgctcttaactgctgaggcatctttccagcccccaaggcatctttatccactaagtcagtggttctcaaccttcctggtgctgtgacccttaatacagttcctcatgttgtggtgactccaaaccataacatgtattttgttgctagtacataactgtaattttgttgctgttatgaatcatctgatatgcaagatgccctacctgtgaccctgccagagggtcttttgacaccctctcccccaagaggctgtgagacccacagtttgagaactgccgcattaagccatctcgctggccagcctttaattaacattttttaaaatttccattttatgtgtatgggtgttttgcctgaatgtgtgtatgtgtagcacgtgcatgcctggtgctggcagaggccagaaaagggtgttggattgcctggagcctgagttacagatgcttgtaaggcgccatgtgggtgctgggaactgagcccaggtcctctggaagagtagcccttgtctcctaagtgctgacatgtctccagccctccctgaacctctcttagcgtttgctgtgtgtgtcgctctagtgcctgatccacactgaactctgtcacaggccacatgttttcagcaccatagacccaggctggcactgagctgctcctgtggcattcttgctgtctctgcccgaagctgctgggttatgctttcaatgactcagatgctggctgccactttcctgcatccccattcagcatgaccccacgttctgcaggggacaaggcctggagtggccttggcaggtttctctgtgaagccatgatgattgctttgcagctcaccagtgctctgagggatctggtggaagccacgataacggcacatgtgcccaaaccagtttgctgccaatgtctgtaaataaaggtacattgtctgtgccaggcccagtggttcctgtacatgtgggccaccctcaggctagacgagagctgggtggttggttacagagccagcaatgtctgcttctggtctcagagtatcatatgtgatcagtttagaaatcctccctcatcccactcacctgctcaccctcttcaccactgacagcaggtgctggccctccacttctaggaaggacagagtgcccttgtctcctgttcccaggtcagcacctggagcatgtcaggagagggtccagatggatggttgtgagaggatgttaagtccccagatgcttcctcagagggccgcagtctgcagatttgtttgcccactctctcccaggtgttagaggagataaccttggtctctacaaatgcagcacctacttccatggagttctgggctccactgacccagcctgcactgaggaaatggcgttgttgccgactccaccttcctggaaatcctgcttgatcctggagctgaggctactgctctgtgctgtctctgactcaggctgcatgcctcctgggcacaggctgggcatcaaggtctctgtgccctttggcattgaacagagcttcagggatcattttaaggagactggattttccatgatcttttctagctgggtcctagaaagtattcctgctactgggtctgtatttggaatcagaccttttcggttggagccaggcaaaactgctgctctctggctcctctgagcaccgcccctttctccccacagctgtctgtctgcccaatcagttccggtgcaccagcggccagtgtgtcctcatcaagcaacagtgtgactccttccccgactgtgctgatgggtctgatgagctcatgtgtggtgagtggtttcaggcagctccttgagggggcagggtctggtgtggagattgggtggagctgtggaacctgaggcacctaggaggctcatttagtgagtggccttctttagtttctttctgttggtggaatgaaatgccctgacacaagcaacgtggggagaaggggtttatttgggttcacttctaggttacagtccatcattgtgggggagatccaggcagaaactggaagctgctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcatgcctactcataagctctctttctcttctcttataaatttagggccaaaactcaggttcccatgtacccacaggccaacctgatctagactgtctaacaagtgattctaaattgtgtcaagttgacacaaaccatcagagagaggcaacagctagaaagcagagactgagctgtggagtttcctaatggggtggagtgctggcaaagccagacatagagaggttggcctgcttgggagtctgcctccccgtgagctgttggcctcagacctgagtagcagccacacttttgctactgggaccctccttggtacaatctgctctatagcagaggagacctgagattgcacgtgcctcaagaaaaatgaagtgtatatattgtacatacatgcacacttataaatatgccgtaaatatcccttggataacattgatacccaggagtgcaggtgttactgtggatgatgggtggttggggcagtcagagaaagcttgctagaggctgtcaatggagacaggaaggaattggaattcagagagatgtaatgctttgctgcctgtggctactctatccactgcatggggaaccagggcttagccctcagctctggagaggagggcatatgggagagggcagtttccccacggactcagacaccatctcaggttagacactttgggctcagatggaggagttagggttgctgatgtcctctgtcttttgctaggcaggggcctcatctggtgaggtcagcacatgggctgccataggcctggtgtgcttgctgacactccccacactcaggccctgtcctctgaggcagaaggtttttttttccaactccttcaggttgtggaaggaatggagctgatgtctgtgggactgttggttcccaaagtgaacatacttttgccagctgaatcagggatgtgtccttctcgttctggtggccttgatataagggctctgcccccaatagacccctgtagactggcacccagctgctcacacctaattccagaccacccatcccagctctcttccaccatgacacaggctagggaatacttgttgccaacctccgcccagtgcactgtgggcaatgccatgagagcatggctcagggtcactggaaaggaagcagggttggccaggcagagaagacaggtgagggagccccctggcaggcccaggaacagcggcagtggtcccagagtgagccaaacccatgtccccagctcacctgctactcctgcagctgctggggtttgggcaaaggtagcccttctagggtcacagcatgtttcccgtgggaggtcctccccctagggattaatgtgagcgatctatccctacccaacagaaatcaacaagccaccctctgatgacatcccagcccacagcagtgccattgggcccgtcattggtatcatcctctccctcttcgtcatgggcggggtctactttgtctgccagcgtgtgatgtgccagcgctacacaggggccagtgggccctttccccacgagtatgttggtggagcccctcatgtgcctctcaacttcatagccccaggtggctcacagcacggtcccttcccaggtgaggagcctgaagcatttactctgtgatggagggggtttggttgagttgcctgggaagaacctggagggtcacccacagaaacacggtcttccaggggtgacactttttgcttcaaaccctgtcagcagcagggtgtgcccatttccatgcctcttgagggtgaaagtagctgtttcctctgaggccacctgaagactgcccaagcctctgcagctttgtaggggtagaaggcagaacttgtcaggggctgcgacagcatcactctcccaggattcttaggatgcctggcctctgtttgtgtggtatgttctccactcagccttcctgagaatttctctgagtctgagtgctttctagagacttggatagcttgccctggtatcgccagaaacccagatctgcaggaggtgatacatgactgcccgagtaggagttttgtgggtgttgggaccgaggctgggcatttgctcattctgacatggcctgtccattcccacaggcatcccgtgcagcaagtccgtgatgagctccatgagcctggtgggggggcgcggcagcgtgcccctctatgaccggaatcacgtcactggggcctcatccagcagctcgtccagcacaaaggccacactatatccgccggtgagtgaagcaggcaggcgaatggatggcagtgggagactctcccctcagtgctggctccagggacttcctgggtggaaggctttctaagctagtgattcttccagcaccccagagaagggtgctgagtgatgccccccacttctcaccccagagaagggtgctgagtgatgccccccacttctcactcgtgctattgttttctgtgtaggagagggtgacctgtggctattgatatggtcgacaaaacacagatacagaaggggatgtggctcagttcttagggtgcatgttccaaggtctgtgttctatcccctacacaggatagtgggtatagagatggaggtagaaggatgtggaatccaaggtcatccttgtttacacaaggagctggaggacagcctgagagacatgtctttatatctcaaaaccgaaaataacaacctggtgtcagggcgcacacacttttaattttagcccttgagaggcagaggcaggaggatttctatgagttcaaggctagtatagactacataacaagttctaggacagctaaggccgaaggggctcaaaaatatagatagtgccagacatcaacatgctggcttttccctgtgcacacagacctgtggtcatgtcatttatatatcagatgcaggaagaagtttgtgactaataataagcctgaataatcctaacaataccctgcagtaggttatatgaatgtaacagtgaagatagggctaatgggatggtttatcagggcaaggggcttgacaacaactgccagcctgagttcagttcctgggagccacgcgctagaaggaggaaaccagttctctccggctgccctccaccctccccacacactatggcatgtgcgctggcccccaaccaacacattgatgtaatttttttaagaaagagtcaagacagatattagcattttcagacctaggtaacacaccctagagggcaaagccacagtgggggctacaatagtgggtgtccttggagacctcagtgcttgactgcatgttctgtaggcaccttgcctcgaccaggccttgcagcttacacaaaggcaaggacagccccttgagcttcttccaggggctccctagggagcctccccttgccccttggggtagcccttgtttgtgtgctgtcatttccttatcactcctccccttatcctgggtggatgtggctgaggacagtgttatctgaggtgacaggacaggagctgagtcttctgaaagttccagcgacatctggagtttagaacacctcactgtttttgtagtcacatagctatctcggctggcagagcagctcagaactacctctcgtaagttaaagccctgcactcagtgcactgagcatagtcacaggtctgcagacctgcacatcgaagtgggatccccaggaaaccagagtcagctcttcagaagcagctagtgtagtgtgctcagagtgcagtattcaaagagcacggaatacagatgctaactaagtcaaatgggactctaggagctatgtatacctgtgagttctctgggcattattattgtattttgagataggatctgttccaccatggccttgaactcatctttctgccacagtctccctaatacctgagattacaagtatgcaccgccactcctggctttcatgggagactctttatgtaagcttggagtcagaatttatgggtttataaggtatgaacttaattttctctaagaaggaagtggcttttcttattttttatttttaaacttcagttttaggtcattgtgaatttatgctcaaccccaggggataatatctcccaccccaggttctcacatggtaaaaagccacatacatgcagtctagtagcataagcaggacctagacaggatcctgcaaatgtggattttaacagcttacacacgtgcaggttggcactctagctcagtggtagagcgcttgcctctcatgactctagctccagattcagtccctagtaccacacatattgagaatagcatattgaggctagttgccaggatagtttacctgagcactgtggctcatgcctctactcccagcacttgagtggctgactctgaggattgccattcgtatgaggccagcctgggataaatggttagagcctgttttaagaataaaatttaaggggctggtgagatggctcagtgggtaagagcatccgactgctcttccgaaggtcaggagttcaaatcccagcaaccacatggtggctcacaaccatccgtaacgagatctgactccctcttctggagtgtctgaggacagctacagtgtacttacaataaataaataaatcttaaaaaaaaaaaaaaaaaagaataaaatttaagctgggtgtggtgatgcacttgagaggtagaggcaggcgaatttctgagttcgaggccagcctggtctacagagtgagttccaggacaaccaggactatacagagaaaccctgtctcggaaaaataaataaataagtaaactaaacataaaataaaatttagcaaatctgtgtgcaccttgggaggctgagttcagtgccaatctgttctgcataatgatttccaggctagcctattttacacagtgagttggagtttagcttggtttacatagtgaatacccggccaaggcagggctacatggtgagacattgcctcagataaagaaacaaacacacagacagagaagtaaataggaccaagtgaagtaaagcagttgctcctgaagagccttctcagagcctggcatttgatggtagcaatgcttatccagcccctgtgctcagacattacatgttagcgcatccctaggaagtgtgtgtggtgaccacagcctggcttattcctcagtgggtgtagatgagatgcctgttttttccttgtcacaggtggggtcactgggagctgtcccaatcttagtacctcaaccttggtacctatctgggtgtcttggtttgtcattttgacctcttttgctagaggggacagttccccttcatgccagcagagggccacacttgcaagactgctgctgtcaaaacacaactagtctagcgtaggattaagcacttgggaggcagaggcaggcggatttctgagttcgaggccagcctggtctacagagtgagttccaggacagccaggactacacagagaaaccctgtctcgaaaaaaccaaaaaaataaaaaattaaaattaaaatacgtgtcacagccaggcggtggtggtacacgcctttaatcccagcacttgggaggcagaggcagggagatttctgagttcgaggccagcctggtctacaaagtgagttccaggacagccagggctatacagagaaaccctgtcttgaaaaaaaaacaaaacaacaacaacaacaaaatacgtgtcactttgaggctagcctggtctacagagtgagttccaggatagccaggactgcacagagaaactctgtctcggaaaacaaaacaaaacaaaacgtgtcactgtgaggaaatacccaacacaaacaatttaaagcgggatgggggggtagggggggagtggtttattttggctcatgggttcagggattcaaaggtttcagcctagagttttttgaaccaaacaacatggtggtaggagacggggtggagggcagaaccgcttcatgagttcagactggagagaaaggggcacagaaaggagctgaggctaggtcttcctcaggaacctacttccaagtaggctctgtcctcctttttgccacttcaaatgctttcagaccatgtttcatctaccattaatccgttgactaggtcctggcactcaggatctgatcagagacatacttagaggggtctgtcaccaagcccccagcaaagcacatctcacagtccagtttgttgtcttcccatcacagtcagtggtgagtggcaatgtgcacagcttcttgaaaaaggggtgagccaccacctctacctccttctccaacctctgtattggttaaagctccagcagggacttggggcatcttgagtaggagccaggtcacagggaatggcaggagatacaggagtgaaagtcaagtgcagccagtgggaggtatctgagggaagcagagagagaggcacacagcctctgcagagagacctactgctgctgggctcagggctaatgggagtgctcttgctgacactgccccctactggccagcacagtaatgctgagagggccgaggacatctggttgaaagcactttggtctccatgcctctgatcagcagcacctttggggaagatggctgatgccacccctctgcttcctaagtttcactagctctggaagggttctggggaccacaggcagagaatagagctccagaccccaggctggcaagctgagtaaatgattcagccaggagacgcttggagtaacccgtctccctccctctcctcagatcctgaacccacccccgtccccggccacagacccctctctctacaacgtggacgtgttttattcttcaggcatcccggccaccgctagaccatacaggtaggagcttgtcctcgccttccctactagtgagaagggccttgtctccgccttcctccatgtgtgtcccatgggctctgtctatgctgtttgcctctccttgctgggtttgtggggtgtggctgagtgtgagctcagagctggttttatacaagtgaatacatacataatgggcttctccattgcttgagacacctggagcacggccggccttgaaggaatctagaaaaggattcgctccccctccctccagtgctgtctcactgcatggaaacgagtgcttaggctctgctgtgtctcagctcagccatggccctggtcaaaacctgactaatgtaacctccattacgatgatttttcaattgtgtgtgtgtgcctgagaagaggccagaggcattccctggagctggagttacacacaattgtgagctacctgatgtgagttttgggaatcaaattctggtcctttgtaagaactatacatgtttctaaccactgagccatttctccagctaaagggtgatttttgctcctttgttaagacagtggcctatctgagctggaaaccccaaaagcgctcagccagactccaacccacaagttacctatattggggttctcagaccggttctcctgagtgagagtggtgctgtgagcattcctaatactggggtgatgcaaatagcttactctttttcataagaccccaatggtatgccatcaaaaattcacaccagagaaccagtaagtctattggtcggtttgtcttagaggggtgcaggggcccctgctctgtgtcaaaagtctttatccaccaccacagtatgcctttaggaaatctttctttttttttttttggtttttcgagacagggtttctctttatagctcctctggctgtctgtcttggaactcactttgtagaccaggctggcctcgaactcagaaatccgcctgcctctgcctcccgagtgctgggattaaaggcgtgcgccaccacacccggctcaaggagcagccttgtacacaggtggctaggcacacatgtgaacttcttctgtgttccttctaggccctacgtcattcgaggtatggcacccccaacaacaccgtgcagcacagatgtgtgtgacagtgactacagcatcagtcgctggaagagcagcaaatactacctggacttgaattcggactcagacccctacccccccccgcccaccccccacagccagtacctatctgcagaggacagctgcccaccctcaccaggcactgagaggagttactgccacctcttcccgcccccaccgtccccctgcacggactcgtcctgacctcggccgtccacccggccctgctgcctccctgtaaatatttttaaatatgaacaaaggaaaaatatattttatgatttaaaaaataaatataattgggatttttaacaagtgagaaatgtgagcggtgaaggggtgggcagggctgggaaaacttttgacagtggagaaaatatttataaacttaattttttaaaacatacctgccattcctttgtgcctcgtgaatatttgagtattgagcctgttcccaaagaacggatttcaccccactggatggccgccaccgggtgagcatgttcctgggcatggctgtccttctatcaagcccccttaggcagacagaggctgtgaactgacctgtacagagcatcgttcacatgctgctcaaaggctcaggtggtttcccattttgcactgcatgttgtgttcctgggctataagctgtgttggcattctggctcatcctggtgtcaatcataagggccagaggccaaggtagccctctgaccatcccacctatttagaccccattggatggagctatgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagttgctctggtcatgtcatagacagtgccttttgttcctggaagcatctagtgagcagaacctgaggtctgtctacacgttcatctgggcagtatggaatcctggtctctgtcctgggcaggggtctcctgtctgacaggtgatgaagtaagttgtgtcatagattgaggagagtgggtgactgacagttgaagggggtagacaatgtcctgtcacatcagcttcaagcttgatggaaaatgtggcattggagagaagtcagaatgaccacactcagttttgggtgtgacaacacctgagaactgaaaggaaatctagaggttctggcctgccaatggagttctgaaatggaattcttgatctattccaagggggctggaaatgcagagcaaggtaaaagtggctaaaggaaggaaggtctgtaggagagaggactagggactgcaggcactgcttcactagaacatacaagagttgctgtcctggctgagatttatcaggagccccccaggatgatggtcagacctggcaatcttagcttagactggggtaaaggcctatctatgggtcctctataaacagatgcaattgtgaatggatctgattgacacttgtcactggtggttctcctaagggttctgtgaaacaatgccaggggagactgtccccagcagggatgatccttgataagacaaaggttgtgacctactaaagctcagaggtaatgggcaggcctaagtgaaccattgagcttaatagataactcaaaggactgggggtgattcaaaagcaactatatcactgagaagcccaattcagcatgggccacaactccctgatactgcatctctggatctcaacttggaggtaactgcagattggagcatctcttctcagcagccattattaagctcgtatagcttttgagagggaccttcctgaggcttgtgaattttgtttacttttatgccttgtaactttcctgtccttcctgagtcttagattttcccagtgtgttcctgatgtggaacaaggcaaagggaaggagcactgtccagtcattgccgccggtctctaaggtcaatttagtcaaggtctcttttagagttctatttaccctttctacctatcctgaactctggggtctataaacacaatgtaaaatgcaattaatccccagttggatggccagtccctgacttacctgggcaacaaaggcaggtctgttgtcagaccctattaccttaggtattccgtggaaaaatttcttctaggattttcttaaccacaacattggcagtttccttttttcgttgaggaggcctccacccatcttgaaaaggtacgtataaaaacttctactgggaagctgcttccatctgtgtaccagtttggaacacctggccacagctggttgcatagatcacttcggatcccaatttcttccacaagggatgtccacacagcagtaaacgggcgaggagtcgtccgtttcaggcaggaaggtagcagagttgaggatagcaggaggagcaaacatgtcccgttcagtcagcaacagactctggtagtgggtcaaccaggcatttgtcatccattggtctgggggctggcagataatgcttttaagagagtggggggctaccacagttatttgctctcccaaagttaatttgtcggcatctttaacgagtaaggctactgcagcaatggcctttaaacatatgggctatccgctggccactgggtccagcttcttagacaaatgtgtcatgggattcttctatggccctagagcctgagtaagaactcctctggccacccccgccctctcatcaacatagaggatgaagggtttatttagatctggcaaagccaaggctggtgcagtcaacagggcctctaatatttcaaagactctctgatgttctgatgaccatcggaattctccactttctttggtcaggaggtacaagggggcagccagtgttgcaaacccaggtatccaaagtctgcagaacccagcggtgcccaagaattctctcacctgtcttggagtagccagtgccagtatttgagtcacagtcctttctctttgcaatcggcacattgatccttctctaaagtcttctggatgggtcttcttcctccaagtctaggttccctgttgcccaggtaccctgtctattctcaggcctgttccttcctttatgctcctctactacttgcagccaaaatcctgcttacattcctctcctatcttccatcccttttattctttctttcttcatctctctcttgtgatacaccttttctgtctccttgactaaatcttgtaaaccatggcatgtaatccttctagtctctgtaacttcctcttaatatctgatgttgactgccctataaaagccatagcaaccttggcttgttgactctcagtggttgggtcaaaaggaatatagcatctataagcttccatcaatctttccagaaaaacagataggggctcagtagggccctgcatcacctctcttaccttagccaaattggtggggcgtctcgctgctccctttagaccagagcccggtggtaaactgccaacctctccctaccttgagcagtgttgtagttccaatctggccggtctagagggaacccagcgttaatctcattgggtaggttgtttgggactccattcactccaggaacatttttctgagcctccaggagaatatgctctttttctacagtggtaaatagaacctgtaggagctgctgacaatcatctcaagtgggttgatgagaaaacataagagactccagcagtcaggctggccggattctcggaaaaggaggcatggtagggtctgcagagattgtgggtccacgggcaggtcgcctacagcaaaggaaaagcagaagtggtggcaggagctccatctgctgggggactctgggctctgcagggaatccatggtttgatttatggcggtgaattctggatgaggtaaggctgttgatccgagtgggacccaggtccactctgaaaaacaatggctttaacttcaaagataagagccaagtcaaaagtcccctctggtggccactctacatcaaaagccagccactcggaggcgcaaaaagtctgccaaggtcccttcttaatttctactgaaagattatggccccttgatctaacttcagtccagtggtctaaagtcaaacttggggaggggggtcattacagtctgtcttattgtccaatatcacagaaaacatgaaacagacacaaaaaccacacacatactgacaaatggacacacaaaaccaactcagaaatgcaaaaggtcagggaagtgcgaaaatcctccaatctaggaagactactgactcttcactccccaccccagatggactcctggagtccttcccctcgctcggggcgtaccccagagctgcacagccggtgattccagcacgtctgctgttcacactccatgcctcacaccgaggtacgggtctctgcagctgcaaatttcagcactgaaccttgctggctcacaaaatatttttagacaagaaacctcacctccaagtgggtcttcaggtgccaatcccggatgagcccccaatgaaagaccccgagaggagtcccttgctcaagcctcgggataatagcggacccccaagaactcatgagagaccaagcttgatgcaaaccacatgaggctttattggggaaagccagaactctggggacgactcatatcccacacaggtgtagaggagttgaccccgaggggaaagaggtcccagtttttataggccctgggggcggggggaggagggaggaataggggatttccagatctaaacaatgtaaaatgattgatttctcaagaaatgggtatgggagggaaacaaggaaagagtttaatgaaggtgcagtaactccagactggccccggctgtggttgctggggagattttctgactatcccagcaaccaatatcacaaacacctggcagtgaggtgcagcagtgggcacacacctgggttcaaggaacggtcagaacattggcagacacacgggttcaaggagcggccaaagcattgtgcacttctatttttctaaatcagtgaagctacttctactaacaatgaaatctattttgccaatttcagggcttctgtgaccttttacattctgtctgtcaggatctttcatactgtctgtcctgtgtccacagcccttggtctacatctatagccaccctgagctacggaggcagtgtccatcttgagtgaatagtccacatgactggaagtttgctggggctcaggttacatttagcttctttcaaaagatcagggctggggtcccaccctccaggacctctctggcttcttgctggtgatctgtggtggatctcaagccacggtctgtctgtctgtctgtctgtcctccccccccctccccaagtgtcttcttcacttccttttccaggagcttgatcactatagagtggtcagcatgcctggtgggtccctgtttcacagactgggcagctatcagccatccttttagggaagtccagatccttgccagctctcacactgtaaacctgtaaaaaccagcagggaaagagagtgaacttcaaggctgcactggatggttttgtgtcaacttgacacagctggagttatcacagagaaaggagcttcagttgaggaaatgcctccatgagatccaactgtaaggcattttctcaattagtgatcaaggggaaaggccccttgtgggtgagaccatctctgggctgatagtcttagttctataagagagcaggctgagcaagccaggggaagcaagccagtaaagaacatccctccatggcctctgcatcagctcctgtttcctgacctgcttgagttccagtcctgacttccttggtgatgaacagcagtatggaagtgtaagctgaataaaccctttcctccccaacttgcttcttggtcatgatgtttgtacaggaatagaaaccctgactaagacaaaggccaagtgggtgactgcttgggtctcctaggagactctggttcctcctcatgaacctcaggagctcttaacctgacccagcaacaacctgtgtgccagccctgcccttctgggccttgtcctctgccagggctgtaatggccccttttcattccctgcatctgtgtcagcagagtttggaagagaagagagaagaacgaaaggcactggggcatcctttctcaggttgaacttttttttgttttgtttttgtttttcgagacagggtttctctgtgtagccctggctgtcctggaactcactctgtagaccaggctggccttgaactcagaaattcacctgcctctgcctcccaagtgctgggattaaaggcgtgcgccaccacgccctgctatctcaggttgaatttacctactttacagtttttatgcagagctcctctttctgttgcagtatatgatgggagatgtccaaatgccctttggggaagtcagagggtttgcttgtttgctttcttttacattacaatgaagtcaattgaggcagctcctattttgctccccaagtttaaggaacttaaaggtgttctctctccactctgctgattgggcttaaaacaaaatcttaaatgtgtgtgctcttcaaaatagactgaaaactgaactgttacactctagagggaagtggtgggaggagaatggggcagagagagaaagaggaaaggagggagggagaaagggagaggtagagaggtagagggaggaagaggtagagaggaagaacaaagaaggggggagaaagggagcaagagcaagggagagagggagggagattgaaagagggtgggagaggtgaagagaaagaaagagggagaggaagagagagagggagaggagacccatcaaacctgcaaggtttaagacacagagctcaatctgtgtcacatgcaaagcttgccaagttggtcattcttctgactccatggctctatgggacaggcaagtggggcttcaggctcaggcacctccttccctagcaagctctccctgacttcaacgtgcctggctaggttaggaatgagtacaccatatttgacaacttatgggctaactaccctggtcttagtgaggtgacaggttatctcttagttgtaatatgtatgtccctggaacccacctgagtctgggagaaaaaaggcaaagcagatgccagcaggtgtcttcactacaaatgaatgaagggatggtggtttggtggaccactgtatgactcacccagatggtgggagggggctggtttggttcagtgaggcagttgggctttgtcttcacagatagcacagaaggcaggcccactcccactccaagctgtcccctctcacccccagctggtccttcctgccagggtccagcctttaactgctgccctgccctgaactttctgctaccttaactctttatcaataggcctcagttttaacaatgtttgttactacttctgtggcctcaggcaagccttctagcctctgcgttccagagttaacatttattgcctctcttaagtgcctggagtggtgtgcttgaccctggctgatagttgttatcacttgtacttctgagaactggagagtcagaaaggttaggtcacctggccaaggtcacccaacccctatatggcctctggtgacagaatgctctggtccgtagttagctagtgtgtacaatggggactatgatgtggatctactagcaatgaactctttctggaatctgcttccaggaacagctctcttggaaggtggactggaggccagggtgggtttgcataactgcacagccctctcttgttatcctggtagtggaattcagagccagaatgagtgaggtggaggactcaagcatgctggaccccgtgtaaagaacaggggtgggggggggttcagagactgggaacccggagaaagcactgagtgtccaacaaggcaggtcctgtctccttcagtccaagggctaggctctgtcattttcccaggggatagatgcctagaggtggcctagaggagacactcaggagataagctctgtgctctctgagcttcagtgaagcctgggcctgggactgctagacctactggaagagatatgcaggcaactgctccctgtctgaggtgtgagcattgccactcaaggtctgtgtgactcagctacctctgctatccagtctcccatcatagctgggctcgtcctgcctttgaagctccaaggccccaccctggggtctctgtaacacccttcccctccctgctaccaacaccccagggatttagagctctgtcctgtcctatgacttactactttcccaaaagagtctgtcccttagcttgatcaccttggtcacttgctttccagatggcatgggaaggcctgcttcatgaaagacttccaagactcagagactttgttgactatggtggccagctgcagcgtgcctgaacttatggtcctgtccacactgaaccaggcagattattcatagggacccaaggggagcaccttggtatcttttcctgttgctgtgataaaatattctgacaacagcaactttagggagaaaaggttcattttgtctcacaggtcgaggccaatatggcagggaagtcaagggagcaggtgtgggagtctgcccgtcacatcacatcacatcacatcacaaccagccaggaggtagagaatgcttgtggtcagctcagtttcacctttttagacagccccaggagaattaaaaaccaggattagccatgacagtggttaagtgcaagacttgagagtagggaccctgatgtccaggaccccagttctggggcaaggtaaatgtgtagtactatacgtataggacactagcagttggaagaaattcatgtgtaaaattcttctctgtgacaaaagatacagcctggtttcctttgtattaagaaaccttacattttgaccccattttcagggatgccactctactttgtctgaagtaatttaattgaaggtcttcgataaaactatgctatggagaatgcgggcatcgatcccgctacctctcacatgctaagcgagcgctctaccatttgagctaattccccagctataattaacttccgtcgcaggttgtattgtgactcacgtcatcaccggttttccccccccctcgtcccccgcggccgttaccccaccgcctgctgtcattgtgttaccccaccgcctgctgtcattgtgttaccccattggcttcttcgcatccggagctacacagccgggattggtttggttcatttgttttaaactacattgactatgcggattggtggtcccaagcgtctgtcacgcgaggccccgctgttgctacggggcagagggacccagcctaagcttctcccaatttctgacttgtttctcagactccggggtcctagaggttccggatccgtcaagaccatgggaaaaagaatgcgcctctcgcgtttgactgacaagacctcaaagccaatcgaagtggagtcgagggaaccgctgggcggtccaataggttgtggggggcgggagagacaagccaatgatccgtgtgaaggggcggggtctatcctgtgattggctgcggggcggccggagggagggcgggggtaactcaaggcctgcttgatacgtccgccattttgggcgcttcgctgatggtgtcggtgaacctttttcccgcctgagcgcgactaactgcgggtcttgggcgcctccaggtaactcaggggagggggcggtggcgcggagtgtgcgggtcgcgcgggcaagcggccgaccgatcgtggcggtggtccggtcccggcggcgtggggagggagcgtcccggcccctttcccctcccccccggaatcggctgcttcggcggcccgggaggcggcgtccagtcctggccaggaccgggccgcccgctcctgtcagccgggccgagcgttggcagtcagccgagccgactgcgaactttggacgccgaggtgactctgggcttggctcggcgggagcccaggctcggcgaggcgcgccccgagccaagtcgggggtcctgggcgagctccccggctcccgcgcccgggccttcacagcgacttctcgggatctcctggagcttgtcaactcgctggagagcttcgcgaaggcttttgttggactcttgtcctctgagaaacaagttgtgtgggtttctgggcattagcagagtcatcggaacacacaaaaaccagttccgagtctctcggggccatcgcagtgaatcttcatcctccgccgttgagtctctcttttatacagacgcgggcattggagattccctggtgttttggagctgaagtgaggagttacccttcttgtggcttcaagcacctcgcttttaaagctcggctcactgttaa

SEQ ID NO: 1406 - DNA, 4129 bp, Mus musculus
tccacacaccatgcgaggaggacaacggtggctgttcccacctgtgcctgctgtccccgagggagcctttctactcctgtgcctgccccactggtgtgcagttgcaggacaatggcaagacgtgcaagacaggggctgaggaagtgctgctgctggctcggaggacagacctgaggaggatctctctggacacccctgacttcacagacatagtgctgcaggtgggcgacatccggcatgccattgccattgactacgatcccctggagggctacgtgtactggaccgatgatgaggtgcgggctatccgcagggcgtacctagatggctcaggtgcgcagacacttgtgaacactgagatcaatgaccccgatggcattgctgtggactgggtcgcccggaacctctactggacagatacaggcactgacagaattgaggtgactcgcctcaacggcacctcccgaaagatcctggtatctgaggacctggacgaaccgcgagccattgtgttgcaccctgtgatgggcctcatgtactggacagactggggggagaaccccaaaatcgaatgcgccaacctagatgggagagatcggcatgtcctggtgaacacctcccttgggtggcccaatggactggccctggacctgcaggagggcaagctgtactggggggatgccaaaactgataaaatcgaggtgatcaacatagacgggacaaagcggaagaccctgcttgaggacaagctcccacacatttttgggttcacactgctgggggacttcatctactggaccgactggcagagacgcagtattgaaagggtccacaaggtcaaggccagccgggatgtcatcattgatcaactccccgacctgatgggactcaaagccgtgaatgtggccaaggttgtcggaaccaacccatgtgcggatggaaatggagggtgcagccatctgtgcttcttcaccccacgtgccaccaagtgtggctgccccattggcctggagctgttgagtgacatgaagacctgcataatccccgaggccttcctggtattcaccagcagagccaccatccacaggatctccctggagactaacaacaacgatgtggctatcccactcacgggtgtcaaagaggcctctgcactggactttgatgtgtccaacaatcacatctactggactgatgttagcctcaagacgatcagccgagccttcatgaatgggagctcagtggagcacgtgattgagtttggcctcgactaccctgaaggaatggctgtggactggatgggcaagaacctctattgggcggacacagggaccaacaggattgaggtggcccggctggatgggcagttccggcaggtgcttgtgtggagagaccttgacaaccccaggtctctggctctggatcctactaaaggctacatctactggactgagtggggtggcaagccaaggattgtgcgggccttcatggatgggaccaattgtatgacactggtagacaaggtgggccgggccaacgacctcaccattgattatgccgaccagcgactgtactggactgacctggacaccaacatgattgagtcttccaacatgctgggtcaggagcgcatggtgatagctgacgatctgccctacccgtttggcctgactcaatatagcgattacatctactggactgactggaacctgcatagcattgaacgggcggacaagaccagtgggcggaaccgcaccctcatccagggtcacctggacttcgtcatggacatcctggtgttccactcctcccgtcaggatggcctcaacgactgcgtgcacagcaatggccagtgtgggcagctgtgcctcgccatccccggaggccaccgctgtggctgtgcttcacactacacgctggaccccagcagccgcaactgcagcccgccctccaccttcttgctgttcagccagaaatttgccatcagccggatgatccccgatgaccagctcagcccggaccttgtcctaccccttcatgggctgaggaacgtcaaagccatcaactatgacccgctggacaagttcatctactgggtggacgggcgccagaacatcaagagggccaaggacgacggtacccaggcagccctccatgctgacctctcccagccaaagcctgagcccagacagacagccacacgacctcagcattgacatctacagccggacactgttctggacctgtgaggccaccaacactatcaatgtccaccggctggatggggatgccatgggagtggtgcttcgaggggaccgtgacaagccaagggccattgctgtcaatgctgagcgagggtacatgtactttaccaacatgcaggaccatgctgccaagatcgagcgagcctccctggatggcacagagcgggaggtcctcttcaccacaggcctcatccgtcccgtggcccttgtggtggacaatgctctgggcaagctcttctgggtggatgccgacctaaagcgaatcgaaagctgtgacctctctggggccaaccgcctgaccctggaagatgccaacatcgtacagccagtaggtctgacagtgctgggcaggcacctctactggatcgaccgccagcagcagatgatcgagcgcgtggagaagaccactggggacaagcggactagggttcagggccgtgtcacccacctgacaggcatccatgccgtggaggaagtcagcctggaggagttctcagcccatccttgtgcccgagacaatggcggctgctcccacatctgtatcgccaagggtgatggaacaccgcgctgctcgtgccctgtccacctggtgctcctgcagaacctgctgacttgtggtgagcctcctacctgctcccctgatcagtttgcatgtaccactggtgagatcgactgcatccccggagcctggcgctgtgacggcttccctgagtgtgctgaccagagtgatgaagaaggctgcccagtgtgctccgcctctcagttcccctgcgctcgaggccagtgtgtggacctgcggttacgctgcgacggtgaggccgactgccaggatcgctctgatgaagctaactgcgatgctgtctgtctgcccaatcagttccggtgcaccagcggccagtgtgtcctcatcaagcaacagtgtgactccttccccgactgtgctgatgggtctgatgagctcatgtgtgaaatcaacaagccaccctctgatgacatcccagcccacagcagtgccattgggcccgtcattggtatcatcctctccctcttcgtcatgggcggggtctactttgtctgccagcgtgtgatgtgccagcgctacacaggggccagtgggccctttccccacgagtatgttggtggagcccctcatgtgcctctcaacttcatagccccaggtggctcacagcacggtcccttcccaggcatcccgtgcagcaagtccgtgatgagctccatgagcctggtgggggggcgcggcagcgtgcccctctatgaccggaatcacgtcactggggcctcatccagcagctcgtccagcacaaaggccacactatatccgccgatcctgaacccacccccgtccccggccacagacccctctctctacaacgtggacgtgttttattcttcaggcatcccggccaccgctagaccatacaggccctacgtcattcgaggtatggcacccccaacaacaccgtgcagcacagatgtgtgtgacagtgactacagcatcagtcgctggaagagcagcaaatactacctggacttgaattcggactcagacccctacccccccccgcccaccccccacagccagtacctatctgcagaggacagctgcccaccctcaccaggcactgagaggagttactgccacctcttcccgcccccaccgtccccctgcacggactcgtcctgacctcggccgtccacccggccctgctgcctccctgtaaatatttttaaatatgaacaaaggaaaaatatattttatgatttaaaaaataaatataattgggatttttaacaagtgagaaatgtgagcggtgaaggggtgggcagggctgggaaaacttttg

SEQ ID NO: 1407 - protein, 737 aa, Mus musculus
HTPCEEDNGGCSHLCLLSPREPFYSCACPTGVQLQDNGKTCKTGAEEVLLLARRTDLRRISLDTPDFTDIVLQVGDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIVLHPVMGLMYWTDWGENPKIECANLDGRDRHVLVNTSLGWPNGLALDLQEGKLYWGDAKTDKIEVINIDGTKRKTLLEDKLPHIFGFTLLGDFIYWTDWQRRSIERVHKVKASRDVIIDQLPDLMGLKAVNVAKVVGTNPCADGNGGCSHLCFFTPRATKCGCPIGLELLSDMKTCIIPEAFLVFTSRATIHRISLETNNNDVAIPLTGVKEASALDFDVSNNHIYWTDVSLKTISRAFMNGSSVEHVIEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERMVIADDLPYPFGLTQYSDYIYWTDWNLHSIERADKTSGRNRTLIQGHLDFVMDILVFHSSRQDGLNDCVHSNGQCGQLCLAIPGGHRCGCASHYTLDPSSRNCSPPSTFLLFSQKFAISRMIPDDQLSPDLVLPLHGLRNVKAINYDPLDKFIYWVDGRQNIKRAKDDGTQAALHADLSQPKPEPRQTATRPQH

SEQ ID NO: 1408 - DNA, 156843 bp, Homo sapiens
  misc_feature (1)...(156843): n = A,T,C or G
gttcatctcaggcctggcaagaaaggacatgtgtcccctggagatgggttgggggcatgacacacatgtctggtgtttgctctgatcaaaggcaaggctgtggctgcagctgtctggcgggccgtggcgctgaacaggtggcctcgctggcacaagctgcccttcccagatgatcaggaaaaggtgtgttcccggggaccagatgcttctgagcaatgtccaaggtgcccacaagagcctgtgagggatgactcagcactgggaatccataaacccacaaggccccagagccaggtcatggggtgctgggcctcctgggatggcctttcctactccctctgttcctccttgaggagcggaggcagctgaggtgggaggaacacgtgcagaaagagagaaggagctggcctggcctttctccatggtggcaaagatgcagctttaaataaacttaagttatttatgtatttatttatttatttattgagacaggatcttgctctgttgcccaagctggactgcagtgatgtgatcacagctcactgcagcctcaacctcctgggttcaagtgatcctcttgcctcagcctcccgattagctggttaaatgattgtgaccaaaatgctgacagtgatatggacaagccaaggccagggtgatgagtctcagatggaaatgaggaacttattgggaactggagcaaaggtcactttcgttatgccttagcaaataatttggctgtattattttcatgccctagggatctgttgaagtttgaacataagagggatgacccaggacatctgggggaagacatttcttcccttcctccttccttccttcctttcgagatcaaatcttattctgtcaccaggctggagtgcagtggcatgatctgggctcactgcaacctctgcctcccaggttcaagtaattctcctgcctcagcctctccagtagctgggactacaggtctgcgccaccacaccaagctaatttttttgtatttttagtagagatgggtttcaccatgttgaccaggatggtctcgatctcctgatctcgtgatctgcccacctaggcctcccaaagtgctgggattacaggtgtgagccaccaagcgtggccataaattttgaagcagcaaagcattcaagatgtggcccagcttctttgaattccctatgctcaaatgcaggagcaaataaatgaattaaagttagaagttatatttaaaggtaaaacagagcataaaagtttggaaaatttgcagcctggccatgtgacaaagaaagaaaaagctttttcaggagaggagttcaagccggcagtggagtaacctcttgctagaggatttgcataactaaaaaggagccgactgccaataactgagacaataggaaataggcctcagaggcaaaaaggcctcaaaggcatttcagagatcttccacaaccctcccatcacaggcccagaggatgaggaggaaagaatggtttcattgtccaggcacagggccctgctgctctgcacagcctcaggacactgctccctgcctgcatctagactgttccagctccagccttggctcaaagggccatagtcacagctcaggctgctgcttcagagggttccagccatacaccttggcagcttccatgtggtgttaagcctgtaggtgtgcagagtgcaagagtgaaggaagcttgacaccatccacctagatgtcagaggatgtatgagaaagcctgggagcccaggaagaaggctgctgcaggggcagagccttcccattggaggggaaatgtggggttggaggccccacatagagtccccactgggacaatgcctagtggagctgcgggacggggccgccaccatccacaccccagaatggtagatcaccagcagcttgcaccctgcacctggaaaagccgcaggccctcatctccaatctgtaagagcagccatggggactgaattctgcaaagccgcaggaatagagctgcccaaggccttgggagcctgccccttgcaccagtgtgccctggctatgggacatggagtttaaggaggttattttggagctttaagattgaatgattgctctgctgggttttggacttgcttggggcctatagcccctttcttttgaccgatttctcccttttggaacaggaatgtttacctaatgcctatgcccccattgtatctcagcagtaaataactgttttcatttttacagtcttgtaggtgaaaggaactcatcttcagatgagacgttggacttgggaatgggatttttgagttaatgctgggatgagttaagactttggggggctactgggaaggcatgactatattttgcaatgtgagaagaacatgagatctggggggccaggggtggaatgatatagtttggatatttgtccccccaaacctcatgttgaactgtaattcccaatgttgggggtggggcctagtgggaggtttgggtcatgggggcagacccctcgtggcttggtgctgtccttgcaatggtgagttctcgtgagatctgctcatttaaaagtgtgcacacctccctgctctctctctctctcgctcctgcttttgctgtgtgatgcacctgctctggctctgccttccacgatgagtaaaactccctgaagccttcccagcaaccaagcagatgccggcaccatgcttgtacagcctgcagaaccgggagccagttaacccctttctttataaactacccagtctcaggtgtttatttgttttttatttattttgagacagggtttctctcttgtctcccaggctggagtgcagtggcacaatcttggctcactacaacctcctcctcccgggcgcaagtgattctcctgcctcagcctcctgagtagctgggactacagatgcacgccaccatgcctggctaattttcatattttcagtagaaatggggtttcaccatgttgtccaggctggtcttgaactcctgacctcaagtgatccactcaccttggcctcccaaagtgctgggattacaggcgtgagccaccatgcccggcctcaggtatttctttatagtaatacaagaatggcctaacacactgcacaagccactacctctctgacttcagtttccttttctgtaagatgggtttgtgaagattaggtactgtattagtttcctgtggctgccataacaaattaccacaaatctggtggcttaaaacaacagcagttgattatctcacagtgctggaggccagaagtctgaggtggaggtgttggcagggctgtgctccgtctggaggctctaggggaggcttcttcctacctcttgcaacttctggggctccaggtattccttggcttgtggctgcatggctccaacctctgcctcatcttcacatggccttttttccttcactctcctcttctgtctcagatctctgtctgcttttcttttcttttatgagacagagtttcacttttctccctcaggctggagtgcagtggcgcgatcttggctcactgcaacctccgcctcccaggtgcaagccattctcctgcctcagcttcctgagtagctgggattataggcacccgccaccatgccttgctaatttttgtatttttagtagagatgggatttcatcatgttggccaggctgctctcgaactcatgaccttaggtgatccacccacctcggcctctcaaagtgctgggattacaggcttgagccactgtgcccagcctctgcttttcttttctaaggaccatttgtccttggatgcagggtccacctggataatccacgatgagctcctcatctcaagatctctaacttaatgacacccgggaagacccttttcctaacttggttaacattcacaggtcccagggattaggatgtagatacatctttttgaaggccactgttcaatccactgtatgtgtctttaaaacacttataaatgagaatgaagcctgaatgtcaactccttcatctgcagtgaaaaaataagactgctctgtggaccagactacttagttttatttttcactgcagattatttttcactactcatgtgggcctgcccagggcattctttcccaggaggcaagttatgtggcaagcaaaatgatcaggagagtcaaacaaacagctgcagaaacggatggacgatgactgtcagaaggaggagagaagtggagggtgacagccgaggtgagtgcctggctcattcatcctcactccctctcttgaatccatgttaatcacaatttacatgaatgcagtgctttaaaattaaggtatatagagaaaccccatctctactaaaaatacaaaattagctgggtgtggtggcgcatgcctgtaatcccagctactcgggaggctgaggcaggagaattgcttgaacccgggaggtggaggttgcagtgagccaagatcttgccattgcactccagcctgagcaacaagaacaaaactgcaactcaaaaaaaaaaggtaaggtaaggcttatgcttataatcccaacactttgggaggccaggccaggaggatggcttgatcctaggagttcaagaccagcctgggcaacacagtgagaccacagctgtcccccatctctataaaaaatttagaaaaattttttaaagtgctaaaattacaggcttttttaaagtggtaggattataggccggggggtggctcatacctataatcctagcactttggcaggctgaggaaggtagattgcttaagccctggagttcaagaccagcctgggcaatatagtgaaaccccatccttcaaaaatattagctgggtgtactggcacatacctgtagtcccagctacttgggagactgaagtgtgaggatcacctaagcccagggaggttgaggctgcagtgagccaagagtgcaccactgcactccagcctgggcaacagagtgaaaccttgtctcaaaagaaaaaattatccaggtgcggtggtgcatgcctgtagttccagctacttgggaggctgtggtaggaggatcacttgagcctgggaggttaaggctgtagtgagccgtaatcacaccactgcactccagcctgggtgagacagctagacattatcttaaaataaatgaaaaataaaagtaaggtagaaagagtatttttaaaagtcttattggaggttcacatcagcactgagagataagaaatagagcagatatcatgattcccactttttgaatgcagaaactgaggcccagagaggtgaatccagcctgtgtccttcacaccccagctggctcatagaaaccatggcctgttaccaaccaagccctccagagcccagcactgtaggccgatggcggccttccctggcctgctcctggggcaggttgctgagaagcattgcctgttttggggagaggcctgcggcagcctgaggaatgagcctggcagtgggcactctcactggggcctcctccggcgctgccctcaggaagattctgtggctcccaaagccccaggggcgcctctgaccacagcagtcagtcctgccgggttggggggggctcttgtgcccagcgtaacttcacagagccagcacgttccagcctgggagggaaaccaaaaggcactttgcccaagtgtcaccgggctgaaacgacatcctcatgggcccctgtccccggaagcaatgagattggacaggtgctgagcccctgttacttcattgggatggacttgcatctaaggaacgaactgagagtgaacatttccaaatttgaggcctaagaaaagtttgttggcctgatgagctgtgacaggcaaccgtctggggaagtggaagctcagcacatcctccggttacttattacgttactgaagggtctaaaaatgactgtccttggggtgctggaatcctgcagaataaaatagtgctgaattttaattcattctttgcaaatgaatgttctcaaggctccggttggagtcaggcaccctgggaccttgcagtagtgtgctttgggtcccaggccacagcacagcccctttctttttttttttcttttttgagatggagtcttgctctgtcgcccaggctggagtgtagtggcgtgatatcggctcattgcaacctctgcctcccgggttcaagtgattctcccgcctcagcctcccgagtagttgggattacaggcgcccgccaccaagcccaactaatcagctaattttttttttttttttttttttgagacggagtctaactctgtcgcccaggctggatggagtgcagtggcgcaatctcggctcactgcaagctccgcctcccaggttcacgccattctcctgcctcagcctcccaagtagctgggactacaggtgcccgccaccacgcccggctaattttttgtattttaagtagagatggagtttcaccatgttagccaggatggtctcgatctcctgacctcgtgatccacccacctcggcctcccaaagtgctgggattacaggcatgagccacctcatctggccttttttttcttttttttagagacggagtcttgctctgtcgcccaagctggagcatagtggctcaatctcggctcactgcaacctctgcctcctgggttctagcaactctcctgcctcagcctcccgagtagctgggattacaggcacatgctgccatgcccagctaattttttgtatttttagtagaaacgggggttttaccatgttgcctaggctggtcttgaactcctgacctcgtgatccaccctcctcggcctcccaaagtgctgggattataggtgtgagtcaccgcatccagcccatagtccctttcctctctgggagtctctggtggccccttcataatgcttttttttttttttttttaattcttggtacattttctatgtaatcatttcaataactgactgtccagtagagtctttagtttttctgtatcccttcccaaatttagaaacctgacttgaactttgggccagttgtaatgtgtcctctatgacaggccatcctgggcccccttccctttgttcctgtggccggagccctgagcaggccccatccacttgagtccaagaggccctctctcctggctgctaccattgtacccacctgctggccaggcccccacaggggcctctttcctcctgacagtctcatccccactcagcagccagagtgccttctttataaatgtagatcagatcctttcactgtatttgttcatccaacacacatttactgagcacctactgtgtgctaggccctggtacgggcacaggaaacacatcagggaataaaactacactctctgctctcctggagcttccatgctagtggagagaagaaagatacgtaaacatgtaatgagtcaggtggtgatgagtacaaaggagaaaagtaaagcagagaaatggagtagaaagtgctggcaatagtgggtggtggtggtggggggtgtggtttgcaattttcaacaggggtcctcaggcctgactgaggagctgaagaggtaagagagtgagccacgaggctaagtggggtgaaagagttggagcagaaaaggtgggaggatcaccaggcatgatggcccctctctgtagtcctaactactagagacaggctcatgcctgtcatcccagcactttgggaggccgaggcaggtggatcatctgaggccaggagttcaagaccagccagaccaacatggtgaaaccctgtctctactaaaaatacaaaaataagctgggcgtggtggcacatgcctgtaatcccagctacttgggaggctgaggcaggagaattgcttgagcctgggaggcagaggttgtggtgagccaagattgccccactgcactccagcctgggcaacagagtgagatcccatctcaaaacaaaacaacaaaagctaactacttgagaggctgaggtgggaggattgcttgagcccaggagtttgaggttgcaatgagctacgatcacaccactacactccagcctgggccacagagtgagaccctgtctcaaaaaaaaaaaaaaaaaaaagagtcccagcagagaacagcaagcacaaaggccctgaggcaggagtgcacctggtgtgtttgagaacccacagagacaccactgtggctggagcagggtgagatgtgggaagggagtggctaaggaagctgagaggtcaaggaagaagtgtggttggagcaggccctgcaggtgccgaaggcttttgcttctttcctgagatggcagccctcacgagccctggagcttccctggctgccatgagatcaggtggaagggggtcgaggctgcaagtggggacgcatgagtgggtgacaggtggcagtagtagaagtgtaagaagagctgggagtctgggtctcttctatcttgaaaatagaaccccaggctgtgctggtagagctggatgcagggtggaagaagggaaaatatttttgctgcttaaatcctagcctggcttcccattgctcgtggggtgcattctcgattcctcttccccgcctgaggtctgacatgtgctggccctggctggcctctcctgtaccttctaccaccagctccagctcatggcctgatgtggttcctcccccgaatccagcgaccaggctgccctctgccccagcgcctcctccgtggatgtctgctcttcctgaactgccctcccaccggacggctgctccttggtagcagctcaagtgtccttccttccctaagccagtttccccaaacactgcagcacaacgcccttcatttctcatggcattcttcatggcctgtcaatggggcttttgttgttttaattttccgtcttcttgtttttgttggtcttcctagaatataaaccccatgagggcagaggcgttcagcctgactccagcctggcaaagctgtcacaaatctggaggaacacacacgttcacgggcactcagttctgtgaggtactgcaagccctctctgaacctgcaaggtggccattgctgtccccactttacaaaggaggaaagagtgcgcggagaggttctacttagacccgccaagggcacagtcgttctagaaagtagcagactgggagttccaacttgggcttgctggttccggagccccttctgtgccccttccaggctgtgcctgggtgagattcttctcctaccagcacgtcttcttcctggagggttcagtggctgagctgacaccggtgggcaagaggccctggcgggcttgttgaaggactcaaaggtggcgtctgggagcctggcgggactttctccctgtcagcctagaggcacttttagaggagtgtgtctgtttcgcagtcttcgtgtctcataattcataactaaggtagagggtacacatttagtttacagtaaaacctcaaacccacctccactcccagccggccacttctctccctgttcccttctctgccctccacaggtgagaacaagtgtccggggccgccccgtggggccccaggctgcccgccctgaaactgcctcgctgtgtgcccttgggcaaccccgccctgctccgtgcctcagtttccccactcatagaggctccacaggtgacacacctggctccgggccccgatcggccgccgggccccgcggggcggaaaccccgcgccaagcctcccggaggcacctccagggcagggcggggagcgcggggaggggccgcggggacttgcgccgctggggccgcctggccgccggccggctccggggggcgcccgcgggagggcgcggccggtgcggggggcgcgggtggcggcggcggggggcggagacgcggcgcggcttccgctcccgcgcgcccagctccctcctccccgtcgtcctggtccgcggcgcccgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcgggtaggtgggcgcaggccggccgggggccgcgggttgctcggacaatggcccgggcggccccgcggccaagtgcgcgggcgccgccgccgtctcggaagcgacttggcgagttgggagcgagttggggcgcgcgcccgggatccccctgccgtccccggcgtccccgccacgcgcgggccctttgtctccccacccgggccctccccggggacgctgcgtcccgggctggcgaggagggcgcccgctccgccaggtgcggcgcgggcgggtcctcacctgcccgagcccgcgggaagccgggagccgagccgagcccgcgctgggcccgtgtggcccgggccgggcaccgagcggggacttggggcgcggaggcgggcctggcccggggagccggttcgcaagcctgtttccagcggccgcgcggccgccccgcgtgctccgaggacgggctgaagttgcagcgagaaagttctgagcccgggcgcggggcggcctggccggtggcgctgctcctgtgagccgcgtggctgtgggtttccaagcggactgacacctgccaggtgcccgggcgacccgaatgccccgtgtggccgccgggtccccagatagtgtccatccccgggtcggctacgcggaggtgacgtggtcccagatcgcggggcagtgggggaggcaggcttgtgcctcagttgtacactcccgtggggagaggtagggcgggggaactttctctccaacttttggtgtttcccagggggtggagttgaggtcaggaggactcaggaaacttaagcagtcgtgaaacgctacacatgttcttttaatttggagattgccatgtggtttttcaagcaagcctcttgctacctaaatcattctcttcggatgtgcgtgttttgtttttctggagtatggctggccaagtggcacggccgcaagtgcctgtgcacgccgcggctcctgttctgtttgtggcagtttagcggggaggacctcgggcccctttgtctgggcctccttaaggcaaacagctgtctccctgaatatttccagtgtgaatggtgcagcggggtggccctgtagtcagatcccccaggctgcagcctctgcttggaggtgtgggggacagcggggaacaggaggagcttggagtttgtttcacgtcctcctgcctctgacccaagcctagagattctatggacagtttcaccccaaatctgcctctttcaggagcgtgtttacattgtggggccttgtctggagctagcaaaacaaggtgaagacaaaacagcgacagtatctggggagtacaggccagcgccgctcctttttccggaaatgcctgggtcaaggaggcaaaaggggttttggggaaactgtttgttttaaagggggggtttctaggccgaccgcgttgcctttcacctcattgcagttttgggttttgtgcacgttttggggtgatgttgctggagtcaaatgcctgtcgtccatgtggttcgagcccctgaggagaaagaattatagctgtagagttcagttgtgtgtgaggcaaaaatagagttgattattttaacattaggcagcaaggcctgggagccccagtgaatgtggtgatccaggcctaaaatggaaggaaagggaggaatctttctgcagaacggttttgatgttatatccctggttttactgtgtgaaatacatgcctcggacctcagcgaagccagtaagtgggccgctaattatttttcctgattgcttcctgttgcaattggaagctgtgaacgcacggaaatggctttgttctagtggtcccagtgctgagaacttccccagctcccaagccctagtcctctctcctcggggcccaagtgcttgttccagggccggcctgtccaggcaccccctctccccctggaggttcctcctgtagatgcccaaggccaaggccgggccctctgggagagcccagaagggctgagtggggttaaccaagtgctgtgtggagcaccctgagagagtcccctccaaagcagggccccgtgtgtttagctcccctcttcagttccaagaaattcgccggtgaacccgatccagcatttgttcagcactttcctggggagattcacttcgtgcttcctgtcgtttttggaacccgtttaatttcagccgtgctgtgtcactgctcaggcatttagtagaactcacacacacgggtgggggatgtaggcaggtgaggcctctgagttgctttctcccttgcagcgacgggttgcagggctgatgggggtggaggggtttggggtcagacccacctgggtttacatgctcagtggctgtttgacttcgggcaccatacctagtttctgttatctcaccccgttcctctcccaggctatggggagccctaactgccctgtgtgagacctttagccccatccctggcagagctgcagtgagcgcagttgtgtgtcagcgtcctcgatctttctggccccagccggtctagaggctgttattacaatagtctggatttttcctgtatgaccttggacatccagtccactgacaaactcactcactcaccgctgcagccctcgggggcaggagtagttagttagcactgtggacagagcccctgcgcccagggtctgattccagcctggccgcttcctgtgctgggaggcttaggaagctgatgctacctttgtgtgcctcagttttctcacctgtaaaatgggaatagaatccttcctaccatgaattcagtgagttaacgtgcacctggcccggtataatgctgttgctgttttgctttggtgtctgctaccgagtgaagtgctagggttgagtgcgatagaatggcagataaggccccgcccctgcgggcagagcttcccatgtagaggggaggacagggaaagaagctttgcagctatgcagaggtgggcccacgggtgctccttcaccctcggggtgtcctgcgagaggcccttagaggccagatcatgctgtggagtctggttgtgatccacaaggcagcggaagcttctggaaggctttaggcaggagttacaggaaatgcaagctaaagccagatctttcctaggtgaaaggtgtcgagttgttttttttttaaattgaggtgaaacttatataatataaaatattaaagtatagaaggcaggcatttggtacattcacagtgtttacaaccctctcttctatcaagttataagagatttccatcaccccaaaataaaacccatacccattacacggtgacttcccgttccctctccccggatcccctggtgaacaccagtcgactttctgcctctgtggttctgcctgttctgggcattttgcatgaagggaatcttacaatgcgtcttcgtggctgacttccttggttactgtaacgttttcaggagtcatccaagtagtaccacgtatgggtgtttcagccttttattttttttttgaaatggagtcttgctctgttgcccaggttggagtgcggtggtgcgatcttggctcactgcaacttctgcctcctgggtttaagtgattctcctgcctcaggctcccaagtagcttgcattacaggtgcccgccaccacgcccagctaatttttgtatttttagtagagacgggatttcaccatgttggccaggctggtcttgaactcctgacctcaagtgagctgccggcctcggcctcccaaagtgctgggattacaggtgtgagccatcacgcccggcctatttcagccctttttgtggctgaataatattccattgtgtggagggaccacattatatttgtcagttcatccgctgattggattgatcttggttggttgcatctcccagccggcacgagcaggtctcatgcctcctgcatcctggtggaggtggctggtgggaggatctggcctgagactctcctgccgaggttcaggaacgagccaggtgatggggacaagttggggagtcagtgctggcatctcagaggaggggcctgggccctgagaggagtgctgggagggcagagtgagggccaagttcaggttacagaagccgtgagacagccggacatctgtggtttgtgaggctttggaaacacttaatgcgctctccaaatggggagtctgttggggaggccctggcgggagccggggctacatccaggtcctcggcttggtggccttgttcacttatttgttcaggaagcagcagggtgtgggctctgtgccaggccgccctggagggctgtcctggggccagtgaggtccaagtgtgatgggcggaggcagctgtggcttgctacgagccggcctcagggacccaccggctggctccggctgctctctgcattctcttcagctctggagagccgtgtgccagccctcagcctcagtttcctcatctgcaaaatcgggacgatggtgtccaccttgcccatgctggtggggtcccaagagctggtgtctggggtgagggagctgggggccaaaagctcctgccctggggcatccagctgtcctttgaagagtaccccgagggtgtgactgagagccagtccccagcacccttgtccagatggggaccaggaggtgggtgaagatatttggggtctgagctctgtgctggttgcccccgagggggcctggagccctgagttacgagcagaacggggtgctggtcctatccgttccctacctgggtagtgggggctgccttcctgggttgggggtggggggagctccctgtgtccctaagccatgcagaggcatgcgcatacgcgctgctcttaggcatgtgggtggcgctctgaggtccctgcccattccccagccccatgtggtggtccctgtgctccaggtccagcctctggtttccagtttgtcctagtttgtcaccttgtagggggcagttgacactttgctggcctgactcgtggtgtgccagagcccgtggctgctgggcgactgtgcctctttctctcagtggcaagagccttattttctaatagagcctgatgggccagaggttccgccacagggacactgttctctgtctctcgtgcttggggtctcttgctgtggaccccctgggaggttgtcctgggggtgcggggattgtgttttctgggtattttcttatttgctctattggagtgtatttaatttaatatatatattttaaacatcttttagtttgccttaatgtaattttttttgagatttaatttttttttttttgagatggagtcttgctctgtcgcccaggctggagtgcagcggtgtgatctcagctcactgcaagctccacctcccagggtcacgcctttctcctgcctcagcctcctgagtagctggaactacaggcacccgccaccacgcccggctaattttttgcatttttagtagagacggggtttcaccgtgttagccaggatggtctccatctcctgatcctcccgctcggcctcccaaggtgctgggattacaggcgtgagccaccacacccggcctgcttttttttttttttttgagtcttgctctgttgctgaggctggagtgcagtgattcagtcaccgcttactgcagcctctacctcctgggctgaagcaatcctctcacctcagcccgcaagtagttgggacctcaggtgtgcaccaccacgcccagctgattttgttgttttttgtagagacagggtttcactatgttgcccaggctggtcttgaactcctgggctcaagcgatccacccacctcagcctcccaaagtgctgggattacagacatgagccactgcgctgggccttaatgtagtttttcttgtggttaaactgaggtgaaggttcactcaaggaggaaagtggtttttagccttttgaggggctcaaggaccccttcaaggatatgacaacggctcctctcctgagaaggtgcctggtgggggcggcacaggctccactccaccccattgcaagaatccagggccctgcagggctcagagccctctccctgcctccctgtggggcattgagaggcactcaccttctgagggcctcagtttcctttttttgtaaaatagaaccagctgattccaatctctatggtctcttctagcacggagcttcacgttttttctcccttcaggatcctgaggcctctggatcgctagagattgggggtgcccccagaagaggcgctgcttctgtgccctccctcaccccaccgtgcctggctccttgttttttttttttttttttttttgagacaggagtctcactcacgcccaggatggagtgcggtggcacgatctcggctcactgtaacttctgccaccctggttcaagcgattcttgtgcctcagtagctgggactacaggcatctgccaccatgcccagctaatttttgtatttttagtagagacagggttttgccacgttggccaggctggtctcgaactcctgacctcaagtgatctgcctgcctcggcctcccaaagtgctgggattacaggcgtgagccaccatgcccagcctgcctggctgattttttaaaatttgtcgttgagatgggtgtcttgctttgctgcccaggctggccttgaactcctgggatcaagcgatcctcccacctcagcctcccaaagtgttgggattacaggcatgagccgctgtgcccagcctattttattattattattatttaattttattttttctcactattgcccagctcctggcctccaactcctgggctcaaaggatcttcctgcctcagcctcctgagtagctgggactgcaggcatgtgccatcacaccctactttgtacttttgcttttctgtctttgctcttgttaaaagccaagtgccatttcatagtacacaggtgcacttgacagcatttacctgattgaggagtttttccagccttcattgctattacaaagcatgcttgctcgtgtgtctctgcatgtgtataagtgtttttataggatacattcctagtcaaagagtgtgtccatttctgtttttaaagatattgaggccgggcacagtggctcatccaggtaatcccagcactttgggaggttgaggcaggaggatcacttgagtccaggagttcgagaccagcctgggcaaaattgggagaccccccatgtctacaaaaaatttaaaaaattagctgagtatgattgcacactcctgtagtctcagctacttgaaaggctgaggtgggaaaatctattgagctcaggaggtcaaggctgcagtaagccatgatcacagcactgcaacagatctagcctgggcaacagagcgagaccctgtctcaaatacatacatacaagcatacatacatacataactcctaaaaggctgtagcagttcatacctgcaagcatctacgagaacacacactttcctatatcctctctgatgctggcaattacaagattttggtttttggtgttttctttggtccagtttggttaaaaattataacaccttttgatttgcacaaccctcatttctggtttattggtatttacttttctgcaaattgcctacacttatccttggcccatttttctgttgtctttttcttttcttttttcttcttcttcttttttttttttttttgagacagagtctcgctgtgtcctccaggctggagtgcagtggcgcgattgccatcttggttcactgcaacctctgcctcccgggttccagctgttctcctggctcagcctcccaagtagctgggactacaggcatgcgccaccacgcctggctaatttttgtatttttggtagagacagggtttcaccatgttggccaggctggtctcgaactcctgacctcaagtgacctacccatctccgcctcccaaagtgctgggattacagacataagccacggtgccagcctgtttatctttttcttatagatttgtgggaggtctttatttggtatggactttaattctttgttctgtttgtttcaggtttcactgctggtctgtagctagtccttcatccttgtttctggtggtacattatcataaagatattaagaagcttcatataatcataactctactttttccctatggcttttttcctatcccttgttactccatctccagattataaatatatcctccattattttcttccaggactgttactgttttatgttttacattcagacattattctgtctgggttttttttttttttttttttttgtatatggtatgaggtaggggtctggccagtgaatagggagttgtccaacaccttggtgggatggtccatcctatccattcattgtaaatgctgctcttttatgtgtagtgtccacagacacctgggtcctgattccagacccttcactgtgctccactgcctgtgagtgtctttgtgtaccggaatgctgctgtctccatctctgaagcatcagaacatattttaagatcagttatgtaaattcccacctcattgtccttttcaaaagacgtattggctctgcttgcacgtttatgcttttgtggtgaacttcagagccgtcctatcaggttccaccctttgatctcttgatctggggacggtaaatggtgatatccagcaggtgtcagagggctggattttaaatggcctccgatgagctggcggtctcaggctgtggaagtgaattcatctgctgggtgcagtggagccggccttgacatttgtgggttttgctgacatttgtggaaggctctggaggtgccctttgtgccgacttgcccgagccactcctgctgcccaactcactccggtgtctgctcaggaaagaaattctaatgcacactaattttagcattagcccgatggcaaatataattactgagttaattatcactcccctccctagttaatcccagagcaaaatgtgggcacctttcatttcttccttgggatgtacccctgtattagttcagatggggaggcggtacctgcctggcaaagctctcaggaaattgctcaacggggcattaatagctatctgagcgtgtggcctgggctggaacacaccagcctgggtgctgggtgccttccaggctctggccaccttgggttctgccccaggaaggagcagactgtctcctctaggggacctgaagcttaacgtcctcactgtacgagatagttttggagcaagatatgttctggggcttgcttctgcgggtaaaggccatttctccaaactttcccccagagcgaacttgcttcccaaaaggagtctggatccgggcgtggccgtgctgccctggccgcctcctcacttcagctggagcctccgagctgacgtccatgcctattcctcctgagcactgtagacacaggccccagctctgtcccctgccctctcctccactcagactccctgggctctgaggctttacctacaggccctgcggtgcatattcagtgaaagcctagattcagagccaatgacatcagcttttacttggtctccttgctttctggaacctcccctttgcccatttatcttatgctctggccagattaatttttctccaagtagttttcatcacatccttccctttctcagacagtcgtgcccattctccagcatctgaagttggaactttttggcctggcaggccgtgccgccctgagcagacctgcccatcttctgcccctggtgtgggcacttctcttgccagatctgtctggaaccttccatggtccacccaacctgggagggccttgaggacaggggctgtcttcgtctgcgcccctctgcctctagtgtgatgtctggtagatgatcagtaactgttctgaggccaaggcctcatctgtccagggagcagatcttacccatcttttacctcctctggctcgaattctgctggagcatgagctccctctagcctaggttgtagaacacctgtctggctatgtgacagcttctgggccaagtgtgaggacccccatggtcctgcagtaagagcccatatttctggggtgtgggaaacccagtgtaccccaaagggacttgactgtgaagtcccgggtccacgtggtacccaccagcctcctagggcccagactccgtgagatgccacggtgggggcttgggcatttgcagccttcacttggcattcttaccattttcaggaaactttatataaacatttttaatcatgcaaaaaaggaattatggaataataaatgtttatattaaaaagtcttggtggttttgattgatttatttattttttgagatggagtctcgttctgtctcccaggcttgagtgcagtagcacagtcttggctcactgcaacctctgcctcctgggttcaagcagttctcctgcctcagcttcctgagtagctgggattacaggcacccgccaccacgcctgggtaatttttgtatttttagtggagatggagtttcaccatgttggctgggctggtctcgaacttctgactcaggtgatccacttgcctcagcctccctgagtgctgggattacaggtgtgagccaccaagcctggcttggtgctttttaaatttattttgagatagagtctgactctgttacccaggctggagtgcagtggtgccatcacagcctactgcagcctctacctcccctgggttcatgtggttctcccgcctcagcctcctgagtagctgggactacaggcacacaccaccaggcccaggtaattttttaaaacactttttttgtagaaatggggtccctccatgttgcccaggttcatttggaactcctgggcttaagtgatcctcttgcctcagcttcccaaagtactgggattataggcgtgagccaccgcgcctggctactttggtacttttgagttaaaactatagagtaggtgactgagtgatatttttaatgcgttctcaagaatttgaacacgaagagagtgtcaccctcccaggttatgcccccgggagttcatgcacttgccacctggtcgctgctcagggggcccagggagtttgctgcagtgccggaggactcctgggtcccggctgtgcctccccgcagccgcctgctcccttgggacactcattcatttgctgtggccactgccacccacagtccttgcctcgtagactccactgcagctctggttacaaagagcgagtggtcagggactcctgacctgccatgcagggccccgtgggcttgtggtggctttggtgccgtccgctgcgtctgcctcttagagcatggagttctccttctcaggagggctgagctgctggagctctagtcctgccgcagagcagcccccaagtgcggcgttgcctgtccctgtggagcaggtgactacctggctgcgggcggaacagcaggccatggctctggtagtggtctgtgacagcatatcaccctgtgggacagatccccgggacctagtggggtgggatagtgagagctgcgtccacaggggaggctcagagacttgtgtgcccagtgtggccctgtgtgctgacccagctgggctctgccctgtgtggcccccagggtgcccggcgtgtgccctgatggcctggggcagagctccagagagccacggctggccgagggctcacggattctcacccgcccccagtgcctcaggagacacctgggcagcgaacagcttgaggtgtgcagaggatgggtcacgatgggagggaggcacaaggggtgctttccatctctttggccaccagttttaattaaaaaaaaatttccatctgttttgaaaggttttatcctcttaaggaaatgacgtttattaagcaacagccccttctgctcatcgtccagctgtgcccactggcagagcagaggctggtgggattccgcctgctccacaccaggaggtgccacttggcttcccagtgtcgaaggccttcttggactcagcacaccttcacggccccgtgggctgtgggtccctgggttgggcatgactgacttggagggtgatgagagatctccaggatccaggcaggtctggcacgccactgggtgctaggcgctgggctctgggcggcctccttgctgtgcttttctctgagggttgagggagccctgctcagagaccaccaggtgagctctgggggtccctctgggctcctgtgccctgcacagcccggttctgaccacagacctcctccatcagggtggactatagcccagagcgggataccaccacgcccatcaccccccacccctggagcccctgaccaaggcccttctgggtacttaaccagtgatctgatctcaccacagtcagggattagggcctctcccggagggctggggtccaatggtatgatgtgtttcaggtgagaaacaggttcagggatgtccccagcctcactggctgttgttggcagagcaggatgaaaggcagacgggaatgcagaattgggatcttgccctgacccctgtgatccgtgaggcccttgagctagagggatgcactcagtcgaagtgcccgcctcttgctttgtgttagtgtgaagaggaggggtgggccctgttctattcttggctgcccacagcacctaaggccagcttggtcaccaaggcatgctggaaggtcaccacaggtggcacaggtggcttggggtgtgctgggcagcaaccattatgcagcagtggcctccaagcagaagctgctgtttcggacacccgaggtattcccagcctccttcccctaccccgaggtttgctggagtcactgagggggcagtagcgagctgcaggtgcagggtcggggtcctgggggttgcgtgtatgcgcagcctccagagaagcccatgcaggcccccctcacccgttcctgcctgacctgctgttgtgtcctgctcctagctctgcggtctgggacaagcacgttaactgcttcagagctcagtttccccatccgtgatagggaatgatctttatgctcccacaggctcgtcctgaggctgcagagaggcagcgttgaaaagtacctagctcagggcctggctcagtgacggttagctgttagggttaccatcgcatcgcaattgttactccatagtgacgaccccccggggactctggacttgttcagctcagctgagaggctgcttggccgaaaccatctcagctctgcatagtgtggcctggtggcctgtgggttgcgctcatgacaacgtggagcctattcagtcggtaccgagtgtgcgtccttgcctagctggcctcggcatttattttgtagctggagccctggtgggatggggtcaggtgggctctaggagtctgggggacaggtgcaggtaccttcgggtgcgcctcccctgggggcctctgctttgtcagaagtatggcagggggctgagggctgactatctatttgtaggtgtcaccagagcagtccccgcctctccttttcagaggacattgttgaggggaccctgccatctgcgtctgggctggctgcttcctctgtggggggctcctcccggctgaccagcagccctttctggccccctgcatcagcgcctccccactcagcttcactgctgaaggcagggccagcctgggcaccaggttcttccccctctgcccaaggtccctgcccacccgtcttccctcgccctggccgtgacggtcagtgcctttgccccgctctgacgaccaggccctgtgcgcagttggcgctccgtggttgctgagagatgtgctctccagtctgtgggccagatggggcctctgaagtggagggggcccaccctctctcctgcagcctgctgtggctccccatcgcctctgggatgagagcagaccctgcgaagccttgagctcctggccctccagctgtgagcccaggtgggaccacccagttacaagagcgttaggcctggctgtgtaggagacgtgtgtctccacaccagagtccttgcggcacatgggaagccttcatggtcctcatggtggggaggggtccccggggaggcatggagtctcgctcctaggttgctgtgtggcttcagcgctctgtacctccatgcccctgtcctgcagatgtcaacacccagttgaggagaacgtggactttgcccagtgttgtgcagggatggtggggccaggctggagcccacgtgtcctgccttcgccctggccaaggtgggggttatctgccctggccaagctgtgccgcccgtccctgcccgccccagcaggtgggggcctgcggtgggatcccacccatgagcagtagaggcttgttgacttactggcctcccaggctccccctccaaagccaagtcctccaggacggttcttgcccctgagaaggggcagtgtgggtgctgggctgcagcgagcccctcttcgttccatttcctcacagtcttggggacggagggcttgtcctggagcacaggaccgggattgtgctgaggtcctgggaggccacggtcatgaggggacccagtgaaggccaggaggggacaagcatccctccaggtatggggagggtcaccccagcgcctctgcggatctgacccactggctgcggctcctgtgcttgacccttttggcaaagatatgcagtggtctttcagttgcccccccttaggcagcatgaaaacaatttaactcttgcagaaagaacctgggaattgatctcccctgtcactgatcccacaagtgtgactttgcattggtttcttggtccccttgtgcccagtctccccatctgtaaaatggggtgacagtagttccacctcctatgaggactgagtgaagtcaggaaccagaagcagctcccacatgagactcagaaagtgtgacaggcgtggagggtagggacccatgaagctaggcccggcaccttaggaagaagagggagctttcctgcaggtttcccccggacggaatgtgtttcgtcctgtgcacctgcctgcagagcccctcgcacgctgtcagtccacaatgaatgcttggtggaagagttcacccagggcctgcaacaccatagtgctcagcttctccaaattcttcttaacttccagactcgacacgtaaacttgattccaaggaaatcaaagctgatcgtcaacactggactttgcaggcagctcccaaacccacatgcatatttacaactaagaaatgccagttcctcaaagaatgttagcctctgagatgcatcaggagaccaggaggcaaggggttaaaggcaaaccgtggcattccccaaatctgtccagttccctggcatggtacagtgtcgcggagcccgaggtggcatcttttgtttggctgctgatggcggccttcgggccttggcatccacgttgctgcaattttccaggaacagtaatcatttgaaagtagagctgccacgttttgctcaataaagggattttgtagagcgatgataaatttggcatgtctttattattattattttttcaacacttaaagaaaataaaagctggtacaaaggtatgtttgtttctgaaatgtgtttccttccccagatgttcttttctgccagttctaaaatgcgttctgagctcggtcctccagtttcctccctgtgaggaagaacaatgagacctttgtaaccacacaggggaaacggccgcttccctctgcagtgggcatgggggaggggctgggacgtcccacctcctcccacctcgatggaaaccacgagtctgtgccagcccagccgactgtcggggggtttggcagcctcctttcccatggtggtaatttgcagggtcatggctcaggggcaccgcagtctgcacctccgtccctggatccgtgcgtttgctgtgtggcctcgcagtaaatgcttccatctgcgtggcatttatggaccctggggcttggtactgtctgtgttatctggagtcgaacttgcccttttccttttctgtctgcctttcttgcatcaaatgctggtccccacccaaagggtagcccagtctgcaggacacggcgcagaggtagagttggtggcttcacgagggtccagtggggcacagaccttcctcggctgctctgtcgctttgtgacttgagactgcgtgggtggggtacctgagggatccgtgagcccgcccttcccacacgtgtgcatgcacacacacatgtgcacagtgcttcagaagtaccaccttagttggatttgaaggacagccaagagacctgtataaagcttgtagttagagtcgtttcgatactggcctgaattaagagcagtctccatggggttgctgtctgtggggtacgtgtttaatgaaaatccttgtttttaaataaatgtatcctgctttagaacacccaagatataaaatctagacttcatagacaaaaatagctaacatttgttgtgtatcacagtgtgccaggtgggctctaagagatgtttgatttctttaatccttccagctgccctgtgggctgggggccatccctaccctcattttacagacgaagaaactgaggctgggagaggtcaattaacttgctcaaatttggtataggcaaaactaggaattggcagacggtggttccagtgcctgccttttaattggtacttgaattatacgagtgttttcttccatcaataaaagaaatcggcgaacagcctcccatgggtttcagtaagtgcaagccctccttgtcatcccagacctcagcctgcccatttaatggatgaagacactgaggcctggagggaacagtgacttcggagccactctcctggactctgccactcctctcgcctcccatatgaacctgagtggccacatgaccctgggggagagctactcaactgtcccaaggagagggtgatgactgctggcctcccaccggccatcagcgccccactgactgacacccctgagtcagtctccaccctggaactgtttctctcactatttgccatggccttgggccgcttccgggggcttggcaaggcaggaggcgtggaaccaagatggtatgtaatcagaatgctatattttgttgaaaataagaatgttagtaatgggctggtttctggcaggtcaaactgggactctgaaatacatatttttctctgctctgccctaaaccttctaattagtgaaaacgcacatttgcagacatcaatcaaatgtcatattccctagcagcttgtcctgggatcactgagctggtcacattccacagttgctaactcagggcttgcagagtatgtgtgcacgtgtgtgtgcatgcgtgtgtttgtgagagagatacatgccttctggggagccctggtggcctgtttccttccctcccaggcccctgagcttctgctccccaccccgcccccagccccttgtcagcacatgcgcggccactgcaatgagatacagacgttcgcccaattaaaacacagttagtggaggacacatggctttcagggaaaactgctttctctcaggaagatctctgctgtgcagtattccatagctagaccccagctccactcaacagtggactccattaatagcctgggttttggaagaggcgatttgcttctggtaactggctccggtgcatggatgttccctcctcttgctggaatctctgcccgacccagacagtgcttgtgaaccagccctggtgggctccatggggttctgggtctgggaggcaaggacttgcctggggtcattctcattctgcacggcactagccatgctggctgcatgaagccgtatcacagagacctgtgggtcctttacatctgatcatcctgtcatttgtatctgtatctggggtggttagttgcaaacaattccacagtagccaaatcaagaaagtcactggctctcgcaggagcgcgattggtgtggggcgagcctgggggtgtagcccaggcaagcccttcaccctgatgcgcattagccttcttatccaggaaatggggggaggcggtctgggcccagggaggggagcatgccaagctggggatctccaccggtccaggattcagggcgcctctgaccgttctctgcccagtgcctcctgttcagttttacttttgtgttttccatttcacttctgcctctaggccagtgtttttcaaaatatgtttcctgagtggaaatgaaaaaatgttctgtgatcaggcgcagttgggaaatcctaggggagagaaagtgaactaggcttcctcaccgcaggacttctcagagcctttaaaatggtaattatgctccaggccttgtgcccctctacctaggcatcctttactggttgggaagagacggcaggttacgggtgagtccgggtaagtggagttgtgcctaagctgataacctgacgtcaccaacactgttctgtcaccttgctttggtgtggcttcttcacagttgtcacatctgggccgtttggagtgacctagcaagtcctttgcttgtctcccaggactttccggagtagccaagcagagccttcggccagttcccttgtggggccaggccctgcccgggagcacaggcaggagaacagctgcctccccgcctgccccagggccttggtgtcagggccatagcccccagctctgcggtggagcagcagggacctgcctggcccatctccctgttgagggaagacccggaggcgcctgtcctgttctgtgtgctccgaggtgtctgaaaccagctacctcattttctttttatcttttgcaagtgatttcttatttcctgctccacccccaaacgtgccccctgtatgtttcctgttcgcctgcttccctgacctttgaaatgtggtccctgctcgggaaacttgcctggacctcagtcaattatggttttcctctgggctgtgtgtgtgtgtgtgtgtgtgtgtgtttgagtgtgcaagtgtgtgcattaggattagagagaattcgatggggggccaggggccaacaggaatgggggtggctgagctgagaggccaagggcaggttccaggttgcattgagagccgaagctggtgagtgtgaggcgggcagatgtgaggtgtgtgtggggagtggggtgctgtctgggtgactgggctgggagagggcaggtgggggccaagctggaagaggtggtgttattctgtagcacctgatgtacacagaccttgggggtgcagctccaggctttctctctccccacccgcccctgaaggccccactctcccgccttctgcagccagccttccttttgtctgcccctgagctcctccgctcttgtggtcgttaagaaaagctttttataatccaagttggtttgggaagaggcaaactgtcctttcccaacagtcatatgccaaccctggccacatctattctggatttgaagcaaaatatggtatttattcattattgtcatgcaaatgtcagcagctcgctcattcttgatggagacagcacctggaatgggagggatgggtccacggccagcattggaggtgctcggccccagcacccgggccttgctctgcaggcagccctgctctgcaccgggccctgctctgcaccaggttccactgggtggcatcagccatgcctgccctgaggaggtgaagtgcgggctctctccagtgaaggtgcagaggcagggtgagctggcgggcttacggaggacgtgggcttcacctgggtccaggaggccaggtcacattcagccaagtattcatcagctgggtgtagagaccagggagggtttttaggggtgggaatggctggaggcatggaggtggtcagggtggagtctacgggagacttggtctactctggtgcggtgggattcatgtagagagagcccttgtgggctgaggccaggctgtggggtagatgggagagacctcctggcttagcaggtccttgggtggatggatggacggatggagggatgttgggggaattggtgggatatagatggttcagccaaggtggaaatgggggagtagagctattcctggggtgcttgaagatgtcagcaagtatcccactccagcttgagtttgcagagctttctctaaaaggcagaacatgtgcttggttaaaggaaacccaagattttattattgttgtaaatgtcaagtccctcattttgaatctttagacaactgcagaattgtgtcactgacttgggtaaaagcccaaggaaaaacatgaaattatgttgccaaaattgcggtcatcgtagctgcatgagggtttgagtggccaccgccaccccagtaggagagacgcgtagatgttgaatacactgtgagctgcgtgcaggtaattgaaacgtggatgtggggaaggtccctggcttcatggaactgtctacataaaagcgagcctgggtgtttcctgtttcttctaccttaagaaatttccacgagaagctaaggtatggttttgccaagaatgttgttaatggcccagcaatgaatattttcagccacttgtagacacctgaacttcattcttggcaaacaggtgtatgattcttggacttggagagactgaactttgctgtgctcagaatggaggagaccagctcacttgtactttgatttctccctggtccctgtcattttagcctgatcagtgctttttcaagcatttccccttgaaggggagataggactttctggctcagggatggggaggcttccaggcagccttaaacattgtccctgccccaccctaagtatctttgaagtttcatgttttatcataaagtctgtgagaatgttgcagactccgttatagtcatgctagttttatttttttaaatgtggtttgaattttatataaagtatatggattatatctgagaactaatatgcaaggcctgtatgcaaaacataatacaactttacagaaggacattggagaggactgcagtagatgttcacggataggaagacaggagatggagatggcagttgcccccagattgatcagtggattcagtgcaggggccggcagtgcgctctcctccctgttctttcctcccaccccattgcacaaatgttggtgcctggcatttaaagaagcagaccaggcgcggtggctcacacctgtaatcccagcactttgagaggccaaggtggatcacttgaggtcaggagttcgagaccagcctggccaacatggtgaaaccccatctctactaaaaatacaaaaattagctgggcgtggtggtgggcacctgtaatcccagctatttgagaagctgaggcaggagaatcacttgaacccaggaggcggacgttgcagtgagcctggatcgtgccactgcactccagcctgggcaacagagtaagactccatctcaaacaaataaataagaaataaagaagcagcatgtcgagggtggtgctatgtagaggtgtcgggggtgattggcatccagcatccggaagcaaggtggggtagggtgcagaggtgactgacagcagaggctactggagcagatgggaagctggttatggagctaataagtaaattgattgagcaaataagtaaacatatggatagtaacacaagccaggctttgcactttggagaaggtgcttacaaacttggacgagacagtacccagacacatagctgaaactgtaggtactgccacgcacacatgcacagaaatagagaaatagtcatagatgcatgtgtgtataaaagtgtatgtaggctaggcacggcagctcatgcctgtaattccagcactttgggaggctgaggtgggtggatcacttgaggttaggagtttgagaccagcgtggccaatgtggcgaaactccgtctctactaaaaatacagaaattagccggttgtgggggcacacctgtaatcccagctacttgggaggctgagaatcacttgaacctgggaggcggaggttgcagtgagtcgagatcacgccattttactccagcctgggtgacagagtgagactctgtctcaaaaaataaaataaaataaaataaaagtgtgagtatacatacacacgtacagttggttcttgttattcttgaaagttatgctccataaagtcactgggaaccctgaattattgaatactgaaccattgctcctaggggaaacatcgggctaggttcctgtgagcctcaggtcacaacgtttttgccaactgttcgatacctgacctggcttttttttttttttttttaagacagcgtcttgctgtgtcaccccaggctggaatgcagtggtacaatcatgggtcactgcagccttgacctcctgggctcaggccattttcctgcctcagcctctccagtagctgggactataggcatgcaccaccacacctgtctgatttaaaaaaatatacagatgaggtcttgccatgttgcccaggctagtctcaaacttctggcctcaagtgaacctcccaccttggcctcccaaagtgttgggattacaggcatgagccaccgcactcagcccataaccttgtcttatgtgtgtttctaagacaccttatttaggctgagtgcagtagctcacgcctgtaatcccaacagtttgggaggctgaggtgggaggatcacttgagcccaggaggttgaggcggcagtgagccaaggtcacaccactggactctaaagcctgggtgacagagtgagaccctgtctctaaaaagcaccttatttactgtatattgttgattcattaacattgaattcatggccaactacgctataactcatacctgaataaagcctctcatgcatattctctctgtaaggcgtggggcagcctcatgcacctaggagcactacacagcagcatatgtgcaggggacattttatacagcaaaattgcccacaaaaagcacagtgatgtggaaagcatggcactagctagaccgagagaaggacacttgcttacatctcgacagccggagcaagaagatggggcgttgtggcctcagttgacctcagtttggaacgtgtgatggtgactcagttttttcacactctgcaagtcagtgagtgattgcagaagtgctgtgaggtttaatttgggggatataaataaatgttagcaagtaggcgagctcaagtacggaatctgggaagagggaagactgtacgtgtatatcctacctccatcagcagagaggcctagaagcaatgaccccaagtagcagtgagcacaccagagcccaggtctgggtttctgaataccattctccacccaaaggagtcagagcttgtccacgaagaagctggttctagggctggggcaaggaaaggtacaagccgagcatggggcatcttattgtgtaagaaagcaaagaagttctggaggactggtggggacctctgggacagaagagccagcttagaggggtgctcactgtccaaatctaggaatatttgaacgtcaaaatgttgtgtacatgccttagcgaccaacccacatttaaaacaaattcctgaatgagggctgtaactgtagtcccaagtcattcttttttgtagctcataatagcccataatattactataccatatgtttgcatttacctatttttattttattttatttttttgagacagagttttgcttttgtcacccaggctggagtgcaatggtacaatctcagctcatggcaacctctgcctcccggtttcaagctattttcctgcctcagcctcctgagaagctgggattacaggcatgcaccaccacatctggctaatttttgtatttttaatagagacagagtttcaccgtgttggcgagactggtctcgaacccctgacctcaggtgatctgcctgccttggcctcccaaagtgctgagattacagtcgtgagccaccgtgcccggcctgcatttacctgtttttaattgtggtaaaatacatataacacttatcgtcgtaaccatttgtaagtgtgaagttcagtggcattaagaacattcatgttgctggtaaccactgccaccatccatctcccaccacaatttaataaatcattgaaaacagactttcttgaccacaaacaatggtgcagcagaagcatcatagatctctgtctgtcctgctggctgagctgtggcatccttccttttttatattgtaaaaactgtaaataaaatgccataaaaacgccagcgttgatctttgtggaacttgcggagctgactgtagaatgtgttgggggtataacaggaccagggcagcccaggtgtttctgaaggagacgaatcgggagggactcgctccgccaggcatcagggcagattgcaaagccttgtttttgcacatcatgccgatgcggggtggacagttagaccaagaggagcccggaagcagacccaggctttggcatcaggagctttggcatctggcagaactcctgtccctggggttggggtgtgaggaggtgtgcagggtagtagcgtgaataactgctttgaggagctgaagctagaaggtgcccagagctgtgttaggtgtcagagaagttgtttgtgaggcattgtgagtagaattaagtaacttgagtgcgtaattgcctctggggatcaggcctgggcatgctcaacattcaccaagtcatgtttgtttttcaatgctccagctcttcctcctccaggaagcctgcccagtctacccacagccaggtctacccacagtcagcccttcctcttcttagaagcctgcccactctaaccgcagccagatcttcctctgtctaggaagcctgcctggttcacccacagccgtgtcttcttcctctaggaagcctgcctggtccacccatagtcaggtctacctcctccaagaagcctgcctgatccacccacagccagatcttcctcctccaagaagcctgcctggtccaccaacagccaggtgtacccatagtcagctcttcctcctctcggaaacctgccaactccacccacagccagatcttccccatctagaaagcctgcctaccccacctacagccaggtcttcttcctccaggaagcctgcctgggccacctgcagtcagcttatccatccccaggctccaggcattacctgtccatgcattcatcccaccttttcttcttgggtggttttgtgtgtgcgtgtgtgtgtgtatgtgtgtatatcctgcccaactaacctgcaggctccttgactctggagccctgatgtcttctgtttctctgtctcttccatcatgctggcactggacgcaggatcattcctgactgattaatctctagcttgtgtccaggctgcagcttgctccgatgagcagttggaggcctagtgtaatgcttggtgaatatatataaggcatggactgaaaatgttgcttattttggtatagtagcaaaggattgggttaccttgaattgagtcttgtttggtgtaaccatgtaaataaacagtgtaaaatataggctattggaatggaagcccagacatctgttatgaattctatatataaatattggatatgcttacatgggttaaaatgagattgttggcacttgggttttcaaactcctgattctgctccgggtaggactgatcacgggtcctgggactcaaggcaggaggggccacgagctggcctttctctgacactgacttgccagaagtgggcgttcctgggagtggcagacatgcacccactagagatagatctgaatcaccccctcacattctcctaatagtgccaagaacccacagcagagtgcggggtgtactgagtttgtgctgagcaggggtgcctgaatcccggattgaagaaagtgttctacgcccgattaaaccaactgggaatccaggcaaaagaagacgttcccaggggaagccagcctgcccagtgtgcatggtgccttttaaacaaattatctgcattcccattgggatgaagttcacttgacaacattactcattggtttttttgcttttgtttagtttttttttttttttttttttttttgagacagaatctcactctgtcacccaggctggagtataatggtgcaatgtcggctcactgcaacctccgcttcctgggttcaagcgattctcctgcctcagcctcccgagtagctgggattacaggcatgtgccaccacacctggctaatttctgtatttttagtagagatggggtttcaccgtgttgcccaggctgctctcaaactcctgacctcagatgatctgcctgccttggcttcccaaagtgttggcattacaggtgtaagacaccgcgtcgggccttttttgtttttgtttttttgagacagagtctccttctgtcacacaggctggagcgcagtggcacaatctcagctcaccgcaacctccacctcccgggttcaagtggttctcctgcctcagtatcccaagtagagctgggattacagggacccacccgccaccacacctggctaattttttcttttttttccgaaacggaattttggtctgtcgcccaggctggagtgcagtggtgcaatctcagctcactgcaacctctgtttcccaggttcaagggattctcttgcctcagcctccggagtagctggtattacaggcgccctccaccatgcccagctaatttgtgtatttttagtagagatggggtttcaccgtgttggccaggctggtctcgaactccttacctcgtgatccgcccgcctcagcctcccaaagtcctgggattacaggcgtgagccaccatacctggccataatattcgtttttatgcatcattcctttttatggcccctctcacctccgtcaggtggtgaatagactacgtttcatttatccgttcatcggttatggacatttgagctgtttccatgttttggctttgtgaacactgctgttaacatgcgtgtacctgtatgtgtacatacatgagtagaggggttcagttcttttgggtatatatgtaggagtggaattactggtcataggatcattctatgtgtaactttttgaggcactaccaggctgttttccacagcagccagaggtgtctttaaaagcagttgtcaactgggcttggtggctcacacctgtaatcccagcactttgggatgccaaggcgggcggatcacctgaggtcaggagttcgagaccagcctgaccaacatggcaaaaccccgtctctactaaaaatacaaaattagctgggcgtggtggcgtgtgcctgtaatcccagctactcaggagactgaggtgggagaatcgcttgaaactgggaggccgaggttgcagtgagctgagattgcgccatcatactccagcctgggcaactagagtgaaactccgtctcaaaataaaaataaaaataaaaataaaaggaatgatcacttcctgtttcatgaatgaggaaactgaggctctgggagatgggaaatcctgcccggaatctcacagctggaggccaggccgggctttgaatccaggcaactgagtctgagtggatggtgtgtgctttgtgttggagctggcccagggctggatgaaggcaacatttaattaatgaaaaccactaccccctcccggctgttacctcttgagcgcttttctatgaagcatcctgtttaagcctcgcactctgtgatgtggaggtgcagtaattatccccatttcacagacaggatgttgaggtcagaggggttgagtgattgtcatgggccaggtctcagccaggcttgctaaccctggagtctgccgtctgctctgaagtggtcactctcagctggagagctgacctggcccttttgcctttgtgatgtacggtcctgaaaaaaatatttgcagaaatagcttcataggaacatatatggaatttggaattaaaaaatatattaaaaactatatatttaccagtattacaatatattacccagagacttgtctccctaatgaggccacctttactttttcaatctttgtctccgctggtgctttctcataactgccattcattctagtagaaatcatggttcacggttatgctgggtgtgtggtttttggtgttgacatgtcgaacgttttgttgttaccgcagtcattttgttactagttaattggtgctacctttccacggagacaatagtctagttacccctgccgctggagattgttctttttttttttttttttttttttttttttttgctattacaaataaggcctcagcaaatattgtgactcagacgttttccttctttctggtgtttcttgggacagactcctgcaggggtgatccctggggagagggcgtaattattttatgttcatgatgcggcagtcaccaccgtgtttctgaaaggtttgttctgcactctgggctgccagttgacattcggtttttcatggtgatctggtgggtcctggggtgtgatggtggccgggcccagctgcttcagccctcagcctgtccatcccccacccacacccagaactgaggctccaaggtgcagcctcaggtgtctgccaccctgtgcatccctcatcgccccaggtctgttgccctcccttctcctccttctcaaattacgctgcccagaggtcaggctagaggtcagcaggtccatcactggatggaatgacctggggcaggccaaggtatctgggggctgtgtagctgtgacccctgagcttcagggggctgtgaaacgagagaccttgggcacatgggcacatgacgtggtgggaaggcgcccagaggaccagcacccgccatgctacccccacactctgctccagtgtgctcccaccccaggacctttgcccaggcctgccggctccttctttcccagcaaggcctgctctgtctcaggtagcatgcagccccccgacccacttctcatgtagcatgcagccccccgacccacttcaccctgcaccatttccctgatctgcagcgtttatgatgtaacattactaaggtgtccttattggctatgtgtattgcttgtttattaccacccacgtgaatacggagccattcaggccgtgtcctgggtgtctgggtgggccagctggtgctgggcactcgcctgctggaggagtgagtgcccatggccagcccctcctggtgcctgggctgcgtctcctccttagtgtgctgcctctacaggcttttctcctgaactgtcctctttgcttttttttttttttttaagctttaaaagaagtttttgtagagatgcggtcttgctgtgttgcccaggctggtcttgaactcctggcctgagatgatcctctctcctcggaaagtgctgggattataggtgtgagctacggagccggcccttcccttctactctgctactctgctgttctctctccctcccgtcgggttctgctcctgccacgttctcccctctccccaccaaaggctgggttttctttgtcagggctcctttcccctttggagaagagggggctgtagggccttggtgcgaggccctccagtgacaggatcccccatcacccagagttccacaggccctggtagggaggagggggagcagaagaggaggtgccatctttgcctgctggggaagggcaggggccacccacacagagctctcccatttgctgtggaccctggggccactgccagttccttccaaaggaaagccagctccccaggtggtgggagagtgatgtggcttcctcttaaacttaggaattgagtgtgtggttgcttctaagtgccttagaagccggagcggctcctggaaagagcctgcctgccacagcgggccttaccctggctgtgcccacagatgtccctggggcctgccgctcctgcccggctctcctggcctcccccggtgtgggttgggaaaagcacagcaaattaaaaaacacctccatctctggcctttgaagaatgcatctgaacagccgagagtgtaaaccgtggtgaaatgtggtctttccagtttggggagaagcagggcagagctggggcttttgtacccagggtttccaagagctcctgcctccctcggctgggctggccagggccccccgctgggacctccagctgtaatagggaaggttttactgggttgctggccactgtggactgcccctaagggcaggtatgcctgcctttacccgggttcccctcctgcctggaagatacagcccatgggaggcctgttgtctgtgggatcctccagcatcagagacactggggccagcgtctgcctggtgaggtgcaggcctggcaggcccggtcccccacctgcttgagcacccacggtggtgggggctcgctgcctcccgagacaatctatgtcattgttgtccaaggaagctaatttagagtagaaagttccgtgtccagtcccactctgtgcgtgtgttagcaggggactctcgggccggagctgggtccaccctggtagggggacttcatggggcctgggcgacagcactgtgtatttgtgtgtgtgtgtgtttgtgtgtgtgtgtgtctgaggaggtggaccagtttctcaaaaggcctgtgaccccaagaaccaaggaatttcagcctgggtggatcacaccttcactggtgagtgggacaagctgggggccctcgccacaggagcagccagggcatggggcacagttggcctcattcacaaaatgggagtataagtgatccctgctctggcggccaggacgatgagtgggaacacaccgtgtgggggctgcctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccaggagctcctgcatcctgggcgtgattcctgtgtgcctgcagaccccctcgcggctgccatctcatcctttggtgcacctgttggccagacctcctggtagcgggtgctgcactcccctgaatgtgccggggcctgggggcagggacctgggctcctccctcactgagtggagggaactcagtgtcttggagttggggtgcctgcaggctgggtggtgcaggtgaaatgcagacctctcagctggtgttccagagcagctgccttcccccgcccgagggacttcacccgcagcccagtcaggggtggcgcctgggtgcatcgcccgcaggctgggtaggggtggagcctgggtggccctgcctgtgagctgcatagttgtcgcctttgaccctgagttttcttcgttatctgtttggacctgtttggggcaggcaggggatgagatctgaagataaatgccttagctgtgaccatctccttttgtgagaggtcaatgtccagttccgctgcagttataacatcccattttttgatttctttttattttttcctttttctttttgagatggagtctcgctctgtcacccaggctggagtgcaatggggtgacctcagctcactgcaacctccacttctcgggttcaagtgattctcctgcctcagcctcctgactagcaggggttacaggcgtgagccaccacgcccagctaatttttgtatttttagtagaggcaaggtttcgtcatgttggccaggctggtctcaaactcctggccttaagtgatctgcccgcctcggcctcccaaagtgctgagatgacaggtgtgagccaccgtgcccggcccagaactctttaattcccacctgaaacttgccgccttaagcaggtccccagtctccctcccctagtccctggtcccaccattctgctttctgtctcaatgaatttgcctaccgtaagtacctcatataaattgaatcataaagtatttgtctttttatatctggcttatttcacttagcataacattcttaagtttcatccatgttgtagcatgtgtcagaatctctctcttttttttttttttttttttttttttttttgcagacagagtctcgctctgtcatctagactggagttcagtggcacgatctcggttcactgcaacatctgcctcctgggtccaagcaattctcctgcctcagcctccttagcagctggaactacaggcgcgtgccaccatgccttgctaatttttgtattttttgtggaggcagggtttcaccatcttggccaggctggtcttgaattcctgacttcaggtgatccacccgcctcagcctccccaagtgctgggattacaggcatgagccaccgtgcctgaccagaatctttttcctttttgagactgaatagtactccattgtgtggatggagcagattttgccccgctattcatccctcagtagagggacgcttgggttgcttccatgtttgtttgtttttttgtttttgttttgctgttttttgagacagagtctcgctgtgtcacccaggctggaatgcagtggcgcaatcttggctcactgcaacctccacctccagggttcaagtgattctcctgcctcagacttgtgagtagctgggattacaggtgcccgtcactacgcccagctaatttttgtattttagtagagacggggtttcaccatgttggccaggctggtctcgaactcctgacctcaggtgatccacccgcctcagcctcccaaagtgctgggattacaggcgtgagccaccatgcctggctgcctccatgttttagctgttgggaaggatgctgctgtgatccaaggtgtatgcatatctgattgtgtccctgttttcagttcttttgggtatataacccaaagcgaaattgctgggtcatatggtaattctgtgtttaagtttttggggaactgccatgctgttttccatagtagctgcaccatttcacatttttgccagtggtgcacaagggttccagttgctccagatcctcaccaacacttgctattttgtttttttgatagtagccgtcctaattggtgcaagatggtatcttattgtagttttgatttgcatttccctgatgattagggatatattaagcctgttttgatgtgtttattggccatttatatgtcatctttggagaaatgtctgttcaagttgtttgcccatttttgagttggcttagttgttttctcattgttgagttttaggagttctctgtatttcatggatattaatctcttagtagatctatgatttggaaatattttctctcattctgtgggttgcctttttactctctcgatagtgtcttttgatgcacaaaatctttagcttcccatgaagtcccgtttgtctttatttgtggcctatgccttcctgttgtttgactttcacagtgtccctcgttgccacaaagaactgtagacctaagatgatgacagcacgggtggggcggcggaggcgccgctgtcattttcctggcctcaggtcctctgtgtgtcctcccatcctgtggagcatgtctcctgggaatgggaggggccaggatttgagccagtgcttgtcttggcagggaggcctgtgctcggaaccatctaccccactgcgctggggtctcctgggccatgctctggccctttgtgttcccagctaccctcatagaggctgcaaatctttcccctgctgaaatgaaaccaactgaactaactacaggattcagttctgtgattgtcattggctgagttgagtttgttttggctttctctttcttggtgaaggtgggagtgtggggttggctgggctcccccatctgcgcaggaggacccaggggtctgcagttttcatgaggaatgtcagctgtttcaagccaaggcttcagatgttttttgggggtgtttgtggccagcccagcctagccctgctgacagcagacacggactgatggagctccctggaggcccttaacctcctcctgtccacatcttgtgttcactcctcatgtggcttcttagtccctctgagtctgtgttgggggttgctggaccctcctggtccgacgtctgaggtgtctggtggggtgatggtctgaaggcctctcctgatttctcattgagcccgttgtgggaatgagaccgttgtctgtgagatgaggcttcttgcacaggcagaaggggctgagggctgcggtgcagagggaggtgagggagccagcctggccgcaggcagatcaggaatgcttggggtggggtggtggagagaagtgtaggtgaggccagaggccaaggccttggaggccaggctagggggtctgaccttgttctgcatggcactggcacagggagctgtggaaggtgtctgagccaaggggtggcattccagagtgaccctttaaatgtaggaatgtccagaagcagggtgggagaaacatggaatacaggggtggatgggaagctgatgccacggccaaggaaacgggcctgagcttggacagtggtcaaagacttgtaagggaatcttgaggctctgtctggcctgggctctgaacccctcaaaaaatgtggccctgtggctgggtctgtagcgagcagcatggccagtgctgtgcctgcatgtccccgtcccctgtgtcaggccaacaaaggggatgtggcttctctgcagaacaggacagggcccctgtagcctctggaggacgatgtgggaggttttgggcatggcaggaagggtcacccatatctgggggaacagacgtaacagttggtaaacaaacaggtgctgtcaccgaatgtgggaagaaggctgtttgctgcgctgcaggagcctctgaatgatgcgggccggggctgcccaggcaacttcctgacaacgccttaggggtgggaggaaggaactggaggtcttgggcatgggcagggcagtaccaggagtgctctgggcatagtgctccatcccagggctgtgtatcttgctggcttagccagtggccctcacggtttgcttctgccccacagcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtaaaccctgctgcgactccacctgggtccagggggcggggagtgtcaccatttctctctcgaatttgcatgagcccaagttgtttttcagaaaaagggtgtgactctgaaaatgaacccgtgggggggttggctcaggcctgtaaccccagcactcggtgtgactctgaaaatgaacccgtgggggtgttggctcaggcctgtaaccccagcactcggtgtcactcttaaaatgaacccgtgggggggttggctcaggcctgtaaccccagcactcggtgcgactctgaaaatgaactcgtgggggggttggttcaggcctgtaaccccagcactcggtgtcactcttaaaatgaacccgtgggggggttggctcaggcctgtaaccccagcactcggtgcgactctgaaaatgaacccgtgggggtgttggctcaggcctgtaatcccagcactctgggaggccaaggcgggcagatcacctgagtccaggaattcaagaccacactgggcaacatggtgagaccccatttctacaaagtatacaaaaatgaatcgggtgtgatggtatgcacctgtaatcccagcttcttgggaggctgaggtaggaggatcatttgagcctgggagatcgaggctgcagtgagctgtgatcccaccactgcactccagcctgggcgacaaagtgaggagatcctgtctcaaaaaaaaaaaagagctcagctttcaagatttgttattgttgaaggaattacttccccttgagattccatagttatgttcctttttttttttttttttttttaattgagatggagtctcccttgttgcccaggctggagtgcagtggcacaatctcggctcactgcaaccttcgcctcccgggttcaagtgattctcctgcctcagcttcccaagtagctgggattacaggcgcccaccaccacgcccagctaatttttgtagttttggtacagatggggtttcaccatggtgtctaggctggtctcgaactcctgacctcaggtgatccacccacctcggcctcccaaagtgctgggattacagacgtgaaccaccgtgcctggcccatagttatgttcctttttaaaacttgcatgtctgaggcaaccgatgtggttggccatgggtttgaatggttaaacacatctttgctgtgtgtatggtgggcggcctgggaagtgcggacgctcaggcaggtggaatttgcaccttctcctggctttctaattgcattggctgaaaaagtgcagctccttgtctggaagcagaacctgctgggagtggttctcgggtccgttctggaagctgccctgtgtcctcctcagctcctagtctggctgagttcacctgggcccttgaaggctcagggcctggccgtgatcccaggtggggagagcgtgggtggcaggaaagctttggagtcgaagtccggggtggagagtttaaggggaggtggcccagctccactggccagctaggccaggtcaccccagactcccgagcagagggaacagtttgcttggccaccccttgtccctcctttgtcccttttcttgcagcctgggagtgactctgggggccgtacacacacccttacctgggctgtgctaagccctggcccttgctgacctgtcaggttctgtgctgggtcagtgtcagaactggttggcagaggtcttgactagaacacaagagccatttcccaccacccccaggctcagttggaagccctttgcctgttagttcattcagtgtcaccacagtctctcagcactcccagcctggacctcaccggttgaggggccggcctagatcttctttgcgcaatggcacgatctcagctcactgcaacctccacctcccgagttcaagtgattctcctgcctcagcctcctgagtagctgtgattacaggcgtgcactaccacacctggctaggttttgtatttttagtagacacagggtttcgccatgttggccaggctggtctcaaactcctaacctcaagtgatccaccctcctcggcctcccaaagtgttgggattgcaggcgtgagccactgcacccagcctgacctagatcttctaggttagaaagtcccaggagtgggcggccatgcatccaggcctgccacaggagcccgcctgccctcctccctgaagtcagggctctggaagcccttcccttggccatgccctgtgggacagtgtccaagctctggagtaggactgaagacccctgggctctagtcctggggccaccaacttgctgttgccctttgcagtgacctccccctgactcccatggtgccggctgcaggagccgggcgggaggggctggttgccagatcctgcagatgcccctcctctgggcctgcccagggtagtgggaatgagggtgtggggtgagggtctgtcctcaccaaggctggtgtttgggagctcaggaagcagagtgccatgtggccaagttcacctctttgatctgtgtggtgacttaggaagccattgactggcttctgacgagcatgggaagggctggagcctttcagagcccaacaggtttgtgtgagagccaggcgtgtgtgtgtctgagcaactgagtgtgggagtgggaggatgtgagcgtgtgtgtgtgtgtgtgcgtgtgcacgcatatgcgtgcatacgtgtgagcctgtgtgtgtccgtgtgtgtgcatgcatgcgtgtgagtggatatttgtgtgtgtatgagtgtgcgcatgtgactgtgtgtgcacgtgtatgtgcccgtgtgagcgagtatgtgcgcgagagtgtctgcatctgaaccagtctgtgtgtaagtatggggtaccagcaggggtgggacacggtggaatttatcgccaaagtattttgagtccctgaggtcaggccagagcagcctcgtgcccccactacctgagaagtgcccccggcctcccaggggtgctgtgctgggcaaccactcatccctggagcccctcgtatgccctcgctgccctccgagtgggctagccacccctgcagctgccggggagccagctgacctccggggcagcctctgttccgcttggtgaactgttgccctctcagccctctccccctgcactgtggctccaggagtcgcggggttactgaccttctttttggaagggtcggctggtgtagcagtgtctctggctaggagggggcatctgcagtagtcggagaggctgaagatagcagcttgctagaagccctctcccagggccggcctgcggttgctcaccagcggctgccatggccatcgtgtcgccaggacctgcgctcctcctgtcattgcgttccctcccagcgtgggtcgctgcagctccctcacctcccaaccaggcatccactgcatttgtgagcccttgcgcctggtcctgctccccacgcagcgggtatagcccagtctctggccctttcagtgagtgggaggagatggtaaatgaatagtatttgaaagggacgtgtgcgtagggggataaagcagtgcttgggtgctgtggcgaggggcttccgtcggagctcaggtgctgggaaggcctcttggtgacttttgagtcgagactggaagcagatgaggctgagaaccgtgtggctgtctgggggcagcgcggtccaggcagagggatcagccagtgcaaaggccctgggctggtttggggcggggcctgtttgaggggctgtagcagaatgtagggaaacagggcccaaggtgtgaggagaggacacatgaggtctcgagcagaggaggtgccagctctgactcgtgctggaaggcatcccctggtggctggagcgagagtgagctgtggggtgggtggcgtgggggcaggagccctctccacggttattaccgggatcctggcgacagaaagcagcagcggggacacctcacttgtgggggtaaggagtggcgagatttgggatctgttctgaagagaaaagacagctggatttgctggcactctgcatgtaggttcgataaaaagatgagacaaggttggcacggtgccactctgtgcctcagtatccttgtctgtacagaggcgtgaccatgctgcatgtcatgaggaaaacaccaagaacagtttgtgagttcaacaaatgttagctgtcgttataataaaaatgccctttcctcgccaccagaagtccagtctccatgcctacgtggttttgtctttttacttctttatggcttttgctatgttggttgggaagtgctcagtgctaggttgggaggtgatcagtcgggaggtgctaggtgatttgttgggaggtgcatgatgctcagttgggaggtgctaggtgctcggttggaaggtgattggtactttgttaggaggtgcttggcgcttggttgggagttgttggtgtccagttgagaggtgctaggtgcttggttgggaggtatttgattgggaggtgcttggcacttggttgggaggtgctctgcacttggttgggaggtgctcggtgctaggttgggaggtgatcagttgggaggtgctagatgctctgttgggaggtgcatgatgctcagttgggaggtgctaggcgcttggttgggaggtaattggtacttggttgggaggtgcttggcacttggttgggaggtacttggtgcctggttgggagtagttggtgtccagttgagaggtgctaggtgcttggttgggaggtatttgattgggaggtgcttggcatttggttgggaggtacttggtgcttggttgggagatgctgggcccttggttgggagtagtctttcccatgctcagatctgagctggctttgcctgcatcatctctgcgagccaactgtccctgtttggctctggcttttcttaactatttgaaatggttcctttacatgcttgcctctgaattctctcccagaagccctccccaggatcacacctgtggctgttcactcccacccctgcccctggggcaaagttgaccttagtgttgattcctgggcctctccccacaccttccctttgctccagtcatttgaatgagagagtgaaaacagtgagatgccggctcccactcatcagatccagtgatgctgatgacgccagccatggtcctaccctgaggtgctgactctgtccctgtaggctccatgtctccggagagggagagggagagggagaggattccagcctgtcacagcgcccgcggcagcaacccctgctcgccaaatactgacttgaatagtggtcctcaggcataagtgtgggcgctgagtcctggggcaggactgctgtcctgagagtggggacagtggagggtgggtttgtcctctgtcctggccacaggcacacggttgcgaggagcatcttggccttcctcccggccctgctagagcccccgtcatctcctgtgccctcctgcagtgctgtcccccaccagggtccttcctcagaggagggggttcctgccccggccatcatcaggaagggggtctctgggtccgagcgtccacctcagtgtgcacgtggccaaaaggatcaagagccctgcagccaggggggcccctcctgagactcgacttcgttgcagtttcagcaatgcaggtggccccgtgcggacatccaggcagggttgagggaaggcacatccctcccaggcccagggtacccatgtgggtggcagagcgggctctggggatgaccctctggcccctgaggatctggggccagaaagacactggcttagcatgggaggagtccccggcctgtaccagcctgacaaggggctgcagtggcccccgggtctcaaattaaagccagggtgaaacccaaccccctctttaaaatgcaaaatggcccttccctaaaataacacacaaccacaaccgcagctggctctgcacgaaggccatgctgcagctcttttcttcggaagtcgattttcctccgtggaatttggctgggcttgtggtagcgtttgagactctgcaagagcacgtccacgccaaccagtctctggtcaccgactggctcgcaaattccccatttaaggaaaccagcaggcctctgttatgaaactcggggaaggaatgtgaattatgctccatgcggaggctcctgctcctgcacgttttccagccttttccatgggccacggtggagcatttggggaaggcctgtgtggattcccccccaagtccagactgatgcccctgataccttctcaggaggtggcggagggtctgggctctgtccaggctcctaggggtggggacgtgcaggtaaagcaaggcgtctgccgcaggcacgcgggagccttccctgggctggctgccagcaccttggagtcccaggctgccaggaaaagttcacccacacccgggctttgctggcgaagggtgagtcatatgatggccgggctcgggccctcagcagacaccaagtgtgttcccagagcagccgctcagcgcctgtaacctggaacaggccagcctttcggggcctcagttttctcatctgcctaatgggaatagcaattcccaccttccctttgttggttgggttctcactagatgcacaggagacagcagcttgagagggactgtttggagagctgttccatgtgacacccctcttaccctgtccccacggggccggaggagcaggggcttggtgatagcagctgggcgcagtcagcctctgcagggaagagggcatgtttggttcgaggctcctatgccctcattcttgttgatcttgtcacagcccctctggaaggtggagatggtactcgctcaggaacgataccactcaaggaagcatggccccctggatggggtggcccttggtgcacctgaggctcctgaggctgcagagcaccatggtgggggaggaggcggctgtgtgtctgtcatttgcctcttctgctgaatggagacccccagagggcaaagcggggcttgttctccctgtgtcccgggatcactctcatgcctggcttgggcgagctgcctgtttctaaatcacttgctaaggctgaggggaatggggtttgccgcccaccccaggaagaagggagcaagggagtcagcaccattttacaaggaccaagagtgggaggaggctcctcagaggacattctgggcactgtcccctttctctgctgtgaagggtggacaaaacacaataggtctgccagcccttgtgtcctgtggctcatcccagctggctgggatgggaactgagtcctccaagctggtgtggttcccctctggtctccgctgagagtcacgcccagcctctgggcacacaccctgtggtcacctccaaacagggcacactgggcactggtgggggtgggacctgccatcccagacctggtgtctgctcactttgtcttggttcattggccagagatcacgtaagggcgccctgaggatgtgcttgtttctcatggatgggtgatgcttgtctcttgggaacatggagaagcaaagccacgtcgcccacagacctacccaggaacagctgcagctgcaggttcagggtccatcccagccatgggttttattcttttttttttgagacggagtgttgctgtctcccaggctgagagtgcagtggtgtgatcttggctcactgcaagctccgcctcccgggttcacgccattctcctgcctcagcctcccgagtagctgtgactacaggtgtccgccaccatgcccggctaatttttttttttgtacttttagtagagacggggtttcaccgtgttagccaggatggtctcgatctcctgacctcgtgatccgcccatctcggcctcccaaagcgctggaattacaggcatgagccaccgcacccagcctttttttttttttttttaggcagggtctcactctgtcatccaggctggagtgcagtggtacagtcacagctcactgcagcctcgacctcccagggctgaagggatcctcccacgtcagcctcccaagtagctgggactacaagagtgtgccaccatgcccagctaacttttttttaatttttattttttgtagaggtgggattttgccatgttgcccagggtggctcaagtgacccacccacctcagcctcccgaagtactggaattacaggtgcaagccatcgtgcctggccatgttttgttgtttttaaatagacttaattttttcaaacagttgtaggttcacagcaaaattgatgagcagcaggtactgagttcctatacatccctgtcctcacacccacacagccttcccaactgtcagcatcctgtgcagggtggtacatttgttacaactgatgaaagctggctgacgcaccatcacccaaaatccacgtttacacgagggttcgcccttgatttgtacattcttggtttagacagatgagtaaggacatgcacccaccattccatgtcatacaggatagttccactgccctgattttctgtgctccactcattcatccctctcctctccaactcctggcaaccactgatgctttactgtctctgtgtatttgctttttccagagtgtttagaactggactcatacagattggctctttcacctactaacatgcatttaagtttcctccatgtcttttcatggcttgatagatcatttcttttcttttcttttttttttttttgagatggagtctcgctctgtcgcccaggatggagtgcaatggtgcgatttctgctcactgcaacctccccctcccgggttcaaatgattctcctgcctcagcctcctaagtagctgggactacaggtgctcactaccacgcctggctaatgttttgtatttttagtagggacggggtttcactgtgttagccaggatggtcttgatctcccgacctcgtgatccacccgccttggcctcccaaagtgctgggattagaggtgtgagccactgggcccagccgatagctcatttctttataccactaaataatattccatcctgagtgttttgaattgccttttagaggttcatttacagcattttcatggtagcaaaaaaatcagaaataacctgaagttctttaaaaaacttacagcagagtacactaggcaatcatcaaaagaacaaggaatctttctatccacaagaagggaaggtgcccagaatttactgttaactgagaacaagttggaaatagtatattttgattgcccagcttaaggcaggaatacctgaaaccatacctgttggttatttccgatgggtgagattttagggcaagttcactgtctgttgtttcatgtctgcatctatgcagacaaaaacaaaaaacagatctgtgttagctgcttctcttgccctgcccccgtcacaggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggtaggtacccacgcagtcctggggcacccctttcccctttgtccccagggcttttgaaggcgttccttcttaactcaggcctacagactcttctctgaaactctggggccctgaggaatgcaggacttctcagaacttggaacagcgtcagggtctgtgtggcatttgccaccagcccttgaatatttctatagcaaatgtggcacgttcattctaagtagggcagaaaagactatctgtagcccacacccatgcacagtttttttttttttaactttgtttttttgagacagagtctcactctttcacccaggctggagtgcaatgtcataatctcagctcactgcagcccccacctcccaggctcaagcgatcctcccgcctcagcctcccgagtagctgggactacaggagtgcgccaccacacctggctaatttttgtatttttggtagagacggggtctcacatgttgctcaggctggtctcaaactcctaagctcaagggatccttcccctcggctcccagagtgctgggattacaggcgtgagccaccgcacccggcccatgcaccaaatgaggttttgtcaccagatgagcaacaaaagctttccatcttcagagcgttttggattttggaattgttggggagggcttatggcccggcagggttgtgaacagtaaccctgtcacacgcaccacccccaccctggccctatcccagctcaggcatcctgagggcaacagccggaagctgtctcagttattggtgcattccccagtctcaccagggggccttccacatggtcagtgctcaataaaatgggccgagaatgagtaggaagggttttcccctcgttggttaattgcttttagagccttctggtcagcatagcttcccagctctgtacttaattaccccttatagaaacatcccttctgtgtacaggtgaagggcagtttattcactaaccaagtgctgcctgctgctagccctgtgctaggtgtcagggatcctcctgggacggcagaccccattcctgcactagtggagctcctggcccaggcagggatgtggcaggtgtctgtgcagagggcagtagtgactgcatgggaggactcagtggctggatttctgcaaacacaggccaacacccacatgaacagacttgagggcttgggcagctttgctccacacttgccaggcctcgtgtgttagttatccattgctgtgtaacaaaacagcccacaacttaacagcctgaaacagcaaacaggttttttatggggagggagtcagtgatgaggagtggattagctgggtgcttctggctcagggtatgacctgagggtacactcaagctcctggctgggcctcagtcatctgaaggtttgagtgaggccgggacatccacttccaagctcattctcagggcaagaggcctcagtttctcctgttcctcttatgctgagccacacatctcttttgggctggtttgaaaatatcctgttgtccctggaagtgcagaccagcgggtctggtttgagatttggaaatgtggttaccctgtagactgtggttcttgggagctgagtgatcttacagttatgaagggtggacaagaggatagaaaggctgcagctgggagtgccctggtcaaaggatggtgacaggggacagtgagggtgatggaggttgaaacatgctaatggtggtggcggtggcggcagcgaatccttccatagcacttactgttttccagggacgtttatcagttcatttaatgctcataccacctctatgaaacgtttgctattatgttttatttttatttatatttttattgttttgaggcagggtctcactttgtcacccaggctggagtgcattggcacaatcatggttcactgcagccttgacctctttttttgtttgtttgtttgttttttttttttttgggatggagtcttgctctgtccccctggctggagtgcagcggcaccatcttggctaactacaacctccacctcccaggttctagcgattctcctgcctcagcctcccaagtagctgggattacaggtgcccgccaccacgcctggcaaattgttgtatttttttagtagggacggggtttcaccatgttggccaggctggtcttgaactcctgatcacaagtgatccacccacctgagcctctcaaagtgctgggattacaggcgtgagccaccacacgcggccacagccttgacttcttgggctcaagtgttcctcccgcctcagccttccaagtagctgagaccacaggcacgtaccaccacgcctggctaatttatttggtattttttttgtagagacgaggtttcaccatgttgcccaggctggtctcaaactcctgagcttaagccatgtgtccacctcggcctctcaaagcactgggattataggtgtgaaccactgtgcctagcctgtgtttgctattttgatcccctgtgcacagagaagcatgtgaatttgcccagagccacacagctagtcccagccagggttggaacatagggtctgtagctccagggtctggtctgttctcagcctctctcccacctgcttccccgcgggattcttctgcctctgcagcggccatcgctcttcatgatgcacctggggctattcacatggaagcgtcgtgtgttgggtgacgagctctggagccacacagacctgtgcaggcccctttatctgtgactgtggctggggcaagggccgaggctgaccttccctcagtgcttctggctgaggcagagcatggcccagggagcaaccgagagtgatgggcctctggcttctctcactgaaaaatggccacatgggctgggcgccatggcttacgcgtgtaatcccagcactttgggaggccgaggcgggcggattacgaggtcaggagatcgagaccatcctggctaacacggtgaaacctcgtctctactaaaaatacaaaacattagccaggtgtggtggtgggtgcctgtagtcccagctactcgggaggctgaggcaggagaatggcgtgaacctgggaggcggagcttgcagtgagctgagatcccgccactgcactccagcctgggcgacagagcaagactctatctcaaaaaaaaaaaaaaaaaaaaaaaaaaggctgggcgcggtggctcacgcctgtaatcccagcactttgggaggctgagacgggcggatcacgaggtcaggagattgagatcatcctggctaacacagtgaaaccctgtctctactaaaaatacaaaaaattagccgggcatcgtggtgggcacctgtagtcccagctactcgggaggctgaggcaggagaatggcgtgaacctgggaggtggagcttgcagtgagctgagatcccgccactgcactccagcctgggctacagagcgagactctgtctcaaaaaaaaaaataataaaataaaataataaaattaaaaaattaaaagtaaggccgggcgtggtggctcacgcctgtaatcccagaactttgggaggccaaggcaggtggatcatgaagttaggagatcgagaccatcctgggtaacacggtgaaaccccatctctactaaaaatacaaaaaaattagccaggcgtggtggccggtgactatagtcccagccactcgggaggctgaggcaggagaatggtgtgaacccgggaggcagagcttgcagtgagctgagatggcaccactgcactccagcctgggcgacagagcgagactctgtctcaaaaaaacaaaaacaaaaaaaaataaaattagaaaattagctggccatggtggtacatacctgtgttcccagctactcaggaggctgaggcaggaggatggattgagcttaggagattgaggctgcagtgagccatgatcacaccaccgcactccagcctgggtgacagagcaagaccctgtctcagaaaacaaacaaaaaagacaacattgtggaaaacagtttgttgattccttgagacgtaaacattgatttacgtatgacccagcaattccgctcctagctgtatactcttaagaatcgaaaacaggtcttcacacaaaatgtgaatggacagtaatgtccgtagcagcactgtgcacaacagccgagggtggaaatgacacaaaggtcccccagtgggtgaatggatgcacagattgggttctgtctgcacactggaatatggttcacccctaaaacgggatgaagcactgacatgctacagcctggatgaacctcgaaaacatggtgccaagtcaaagaagacagacatcagaggctgtatattgtgattccgtttatatgagatgttgagaatgtgtgtagttaagtccatcaaaagtgtttgccggggctgggggcggggactggggagtgactgctgccgggtgtggggtttgcctgtggggcaatggaagtgctttggaactagacagaagtggaggctgcaccgccttgcgaatgcactaggtaacactattcactttaaagtggtaaatttaggctgggtgcagtggcttatgcctgtaatcccagcactttgagaggccaaggcgggtggatcgcctgagctcagggcttcaagaccagccttgggcaacatggcgaaaccctgtctctaccaaaaagataccccccaaaaattagctgggtgtggtggtgcacgcctgtggtcccagctactctggaggcggaggtgggagaatcgcttgaacctgggaggcagaggttgcagtgagctgagatcacaccactgcactccaacctgggtgacagagtgagaccccatctccaaaaaaaaaaaaaaaagtaaacgtatgtcctgtgaattttacttcaataattttcttaaaaaacagcatcaacaaaaatgaacagaagaggtggtggatctgcagagcccacagctcccatcttccctgtgccacttcatgagtgtcaccctctcctggcaactgtgctgagggctggggacgtggcggggaccctctgcccccaggcccaccctcagggagcctgtcacggggcgagggtcattaagcaaataaaactgcacattaccgaccacgtcacattatgatcctgtttccagtgtccataatctcattacacccgagtcctcatttgctgggcactgtaagcatctagaaaagaatagctgtttctcgggttgatgccaagtttcatttactctgaaagtataaattatgagcattgtaagaaggagcgagtgcacatggcctgatttgtatacagaggttaaagcgttgggcaggagaggtgtgctttttgccaggcatggcttcctcctttcttccctgggggagactttgccacttgacctgggggagcccgtgtgtcaccatcacaggctgtgtttgggaggtgccctgtgcacgccgggagaaatgtacgagggcgccagctcctggggctcttgacctggcctcacttgtctggttgaaagcaaatgggaagcctggcatggtggcgcacgcctgtaatcccagcgctttgagaggctgaggtgggtggatcacctgaggtcaggagttcgagaccagccttgccaacatgatgaaaccctgtctctactaaaaatacaaaaatcatctgggcgtagtggtgggcatcagtgatcccagctactcgggaggctgaggcaggataattgcttgaacccgggaggcggaggttgcagtgagctgagattacatcactgcactccagcctgggcgacagaccgagactccatctcaaaaaaaaaaaaagaaattaattgggtcagcagcaatgactgtcgggggaccctcctgatggctcctccaccccgcttccctgactgcaggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttctgtgagtgccggctggggcgcgggggcgagggtgcgggggctggggggagcgggggcgcggggcaggggagtgggaggatgcgggggcgtgggggtgcgcgggcgtgggtggggtgggggggcaggtgacccctccctgcagaagcccatgctctggggggccccctctctaaaggggtacctgctgcaatggagggaggtatgtggctggctgggggacacgggcctgcagaggacccctctgcagagctcatgggggctatttcaggctcagcagtggcaaggggatttccaaggaaggttgcctcgttttcaaggcccagaagaagttgtctgtgtgtgtgtgtatatgtatttatatacacatacacgtatgtgtgtatatatatatatggttatttatatatacatatatatgtgtgtgtgtgtgtgtgtgtgtgtgtgtgtgtgtgtatgtatttttaatagagatgagagattttgccacgttgcccaggcttgtctcaaactcctgggctccagtgatcctcacaccttgacttcccaaagtgctggggtcacaggtatgagccaccatgcttggccctgcaagtcgcgtatttatcaatgaataatctgcccagaatcagcagttctcagcctgggggccacgctgggttgtgacagaggtccctgatggggaaatgcaccagcttctgtgacagtggggctgcggctctggggacagtggcccactcccacagggaccagggatggagatttctggccaggccattatggaaggtttggactttgaattgaaatgtggggcctaggggtgccagctgttcccagagcaggacacaggagggtggggctctctggagctgtttcctggtgagaaagtcgtggtcacaaaacccatctacacttggggcagcatgagggagggagaggttcattttgatgagtttgttgttccagttatatccgtattttggggctgctacacccagctttcccctggtttgaatgaggtgctggaagcatttatcgagttccgttcaattgctgttggtcatagaagggcttgggagagtgacaagcttggccatcccagcaagagggacagtgttcctatggaagctgctgggtccacacatagcacaaagacaagacaagccttttgcccaggagcccattgtctctggggttcccgtcactaccacacaggcaggtcctgaccccggccattggagcgtggggggcagcctttgcagaggggtgtcctttgggggctccgaggagctggggagggtgttctagtcataggagcttggtgggaggaagcagatggggaggatgtcactccatgggcaggtcacatctgggtgtgagggtggccaggaaggtcacggctggttttggggaaattgcaggccgtctggccaggctgagggccccatgtggacggggccagcgatgaggcaggtggaatggtgcccgcggggaggtccctgatgccacttgaggccgatgtttgggcagagggacacactggaggctgtcacgggggacgaggcaggatgtgactcattcagaaacaagtgacggtcctcttctggaaccttctctcactctgtcctggttttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtgaggcggtgggacgggacggggcgggcgggcggggcggggcctggcgggaatgggttgcggccgccgggggtgccccagaaggaacctcggcaaacccgttcgaaatgatccacttggcgggtgtggtgattcaagtctgtggtcccagctactcgggaagctgagttgggaggattgcttgagcccaggaggtcaatcctgttttgttttgttttatttttgccccagatattttccacttttttactctccgccttggtcctcaggcacttggtgcttcctgggactgtgttgcagtgaggcatggctcttctcctctggggcaccggctgaggatctttctttccaggtgtcggttcggggcgggcccttcgggaaatcacacacgttcaggatgcagctcgccttcggggatgctcccgggcctgggatagccagtctggcctctggggctgaccctggggcctggcaagcgagggggtaacgagaggtgtcaggaaagcgccatccctgggaccagtcctccccgtttctgtagcgtgatggggcccagcttgcagaaggtggtgggggacagggcctgcttcctgtgccggtgtcccactcgggagggcagggggcttccaagtgggctggcttccacactcaggaacagtcctaagggcagagtctcggtgtggggccccctagaaggactctcctggcatccggtggatggagaagtgtccttgctctcactgctgtctgagcacatgggggtcctgactttaggaacagtttcctggtccccctgttcttgctggctagggtctgtgtttgtgtgcagcggctggggtgtgtgtgtggtcgtggcgcccgtggcgtgtgggtcttttctctgctccctggcaggggtcctgcgtttggtgaggattttccaggtttgtatttgtctttctctttctgagagcagggcatctttaatgaagacatggctgttacatcaaagggtctgtccgctgtgccggctgctgcaggggatggttggagagcctccccgaccaagcatcttgtttcccaagtcgggagaaggagaatttgagaaatggggacttgggcggcctagtcctcacggctctggacagcaccccattcattcatctgcttgctcattcattcgttcatccatccatttgctcattcagcaggcatttgtcgaacacttgccgggtgctggcattgctccgaggcactggggaccccgcggtgcagacagaatcccgggcctctggcgctcgcactctgggctctggggctgggtgggtgggggagacggcacaagtgagtccacgagggagtcagtgcattagaaagggtgagtgtcttggacacccgctcctccatcacctctggggcccttcgctgttgaccgttcacctcggcctcaaaggcaatgttgagagagaaactggacccagggaaggagtccagatgagctgcctcctgagtgacctggcgacaccaggggtttggaccaagcaggttaagggaggattatagacccttgaaggggaggagtggtttgaccaggttggatgagccctttgtttacagaggaggccagggcaagtcaccagcctggggttgcccacagcaggtggcatagtaggttctagcaggtggggtctggctcccagagccatgagtttgctgctgccccatacctgggccctggtggagcaaggccctggtctccctcgcagactgccccaggacgctgcctgctccctggaggagggggtgcctcggctgcacaagcctcagcggagaaggatgcttggcttgctggctgcccgggaaccttggccttctcagagtttgttttctttcctgcctgtctgttggtgagaagaggctgaactcagtgctggagctggaccctgcgctctgcagtgttggttgaagtcctggcggaaagggaaagagtgaggacatacgggctcatgacggcagggagtggccaccacagtcagggccgggggacggaggggagagagaatcaccggaatatggcaaaggtgtaaaacaggcagctcgggccgggcgcagtggctcacgcctgtaatcccaacaatttgggagtccaaggcaggtggatcatttgaggtcaggagttcaagaccagcctggccaacatggtgaaactccatctctactaaaaatataaaaattagctgggcagtagtggcacgggcctgtaatcccagctacttgggagactgaggcaggagaattgcttgagcctaggaggcggaggttgcactgagccaagatcatgccgctatactccagcctgggcaacagagtgagaccctgtctcaaaaaaaaaaaaaaaaaatgcagctcgtcctggctagtctgaaaaaggtggagcatatatgttgcccaatatccacaaatattccagaaaatatctgagaagaaagcagttaatgagacgggcctgttcccctgccccgaggcacacgtgtggtgggggccatgtcaggaagcaagccggcacacagatggacataggacagacctggatcgggtacggaacacagcaggggctgagccggagactcctgtactgggggtgtggccgcctgagccggcaggtcagaggtctctctcaggaggcctgagatctgaaggactaaaagagggaaaggcgagaaggaacagcacgtgcagcggctttgaggcaggagcatgctggtgttgggaccgacttcacgggctgtgtgacctgtgtagtcatatgaggtgagctctgttgttgacctgaaattcctaccttttgagtaaggggctgtctgcacttccattttgcagcggtccccgcaaattctgtaacgggcccggctcgtgtgtttgagaagctgaagggaggtctggaggtggtctcttactctcttggtgtgtctgtctccacattttatcttctgtttttttgttccccagccctccctgcgtttttcctgtatgtgactgtgtgtctgtgtgggtgatcgaaccgtaaggcttcctgctatttatttcactttatgcactgcagaagcatttgcgattgcaggaggtaaatatgtatcaaagacatgagttttagtgaaggatatctttttttttttttttttttgagacagagtcttgctctgttgtccaggttggagtacagtggctcacagcagcttccacctcccaggttcaagcaattctcctgcctcagcctcccaagcagctgggattacaggcgcccgctactatgtctggctaatttttgtatgtttagtagagatggggtttcaccatgttggctaggctggtcttgaactcctaacctcaggtgatccacctacctcagcctcctaaagttctaggatcacaggcatgagccactgtgcctggcctatgcctgaacaatatcttatcaagacatgtcttttagtcatcctcccgctatggggcgtttctgttctctttgtgtttttgccatttctgagtcttgctgctgtgggttgggagtgggcaggtgagagctggcttggggcctggccactggagttagagggagcagggcctggtgtctgttgccaccatcgattggtgatgtctgcctaaacactgtgttgcatctgctggggatgtctgccttgggagagcaatgggcatgtaggaagcaggtgtcaccatctctgttcttggggtgtcaaagcaaggctgggtgtggacatttgtcgaaggagtggggaatggacacagcccccaacaagcagatcgtgcagtcgtgcctgtcaggtgccttgccctaacagtggaaggatcatttgaggtcaggggttcaagaccagcctggccaacatggtgaaaccctgtctctactaaaaatacaaaaattagccgggcggtagtcgtgcgcctgtaatcccagctatttgggagactgaggcaagagaacatgttgccctgggagcttttgttaagggtccctgtgtggctccctcacgtatcagagttccaggaacgggtgtgggccctgataaaatcccagactcatggctcagtgaagtcgcacagctggacaagcttggagacccccaaataacttgcccaggctaccctggcttgcaaagggccactgctcatccaggggtgacggagccgtgctgggtgcctggcatccagtgggtgcccagtgtccagctgccatgtccactgtccatgcccttatcaccttcatgttgtcaccatgaccggcgccttaggtgctgtggctggtgccaggcccgtgagagctggggcaggttcactcagggtccaggtttgcctgcatcgtcccagaatcctcccatacctgggggagtgggctgtcagtgggagccagtaaaggggcgttgatttctttcccaaccagaagaggcaggggctatagacttaggtggagcccctggctctttgctggctcccagggttctaacagctgggccttctgagccctggggactggctgctcgtggctgagcccttcaagggcattgcgctccttctgcaaatgtaattcccagtctccatgtccaggcccagagcagccctggggagtcctcagggctcattttcctgcaagcgggggagagggggggacaggccctgtggtgattagaggaggctgcctgcgctcacagggggtggttaggctacccagaggaggaggcccctgcaggctggcagggggcctggtggctctggccccagccctgggctctgtggcatggagctgacaccacagacacctgtggggttggaccgctggactagcagcgagccctgcccttccagttggatagcttttccattccagagccgtcagggccgcagggctgagcacgcagctccacgctccctagagactcagccgtcaggggtcacctttctctagtcttgtgggaactgtttttgccctcagccgtgagaggcacttttacacataactcagttggagcatgactggcacgcaggagaaaaacattttgtgtcatttataggccctgcttgggcgagactctgggccgggaacgtccacatgcagccagtgtggggactgttttactctgagcctgaatctttctgctttggttccagatgccgtgtgtagggtgttctgtcaaagggaggaaaaagctcctcaatgagacagaaagatgcaactgggagtctggttttgcatgaggacgtgagcgtttcagttcacttttttttgtaagcatggttccccagtctgacctcagagctgcctggagatgggccccacccgcttcccgttaattaacaggctggtgctcggtgtggatgctggctcctccgtctccctgccctgggcccttttgaagctgaagtgttccaggggcagctggtgtggaaatagagttttctagaggttttagagttgagaagaaacctaaactcttcttagaagcatttcaagggtttgtcaccaggatggctctctgcaaatttgaggtggttctagaagatcttcccatatttcttaatccagagggagatggggatgggcgagaaacggctttgtccttaaggaagtcatgttctggttggaggacaggcacggcctagcattgaagctggtgagtcagagccggacctgtgagcggggccagaatggggcgcgggcttcagacttcacaaagcagaccacgcggcagcctggggctttagtatccaaatgtcctgccctccaggtttcattccttgccgtaaaatatcacgttaaaggaaaatgttttgttaaaagaccacagtcctgtcacctgagcacagtcgctgttctcggttcctctgtggctttccaggctgcaggtgcccattggtattgcggccgtgcgcccggcgggcatgaattagctgtgccgcctggctgctgacgggacgcctcgcctcgactgaaaactacctggagctgctcacccaggggcaacgtgaagaaaacgtgaaattctgtcgcttgttgcagctgacagcacggctgtgaggtcccagtgggcagaggcctcgtgcagggcacctcaccagccgggatgtcagagctggccagaaggagcggtgcccatggagggctgccagtgcccagagagccttccgaggtgtcacgttgggcagtgaaattcagagtcgggcagaggaggccctggggtcacacagggatctcctccaggctatgggttggtgaggtccagtgtccgggggtgaaggatagaggctctgtggtgagggctctggagctggccctgggctagcggaaacgcaggtaacgaaggaggctgtgctggtgggacttgtgcctgttcccgagggaggcattgtgagtgatgtttaggccaagaggattcaggatggaagacatggcttggtttgtagttgggagccggccaaggagtggtgttgagaaagtgcagtgtcaggcagacccgggaccgtggcggtgaggaggtgcagtgtcaggcagacccgggaccgtggtgatgaggaaatgcagtgtcaggcagacccgggactgtggtgatgaggaggtgcagtgtcaggcagacccgggaccgtggcggcgaggaggtgcagtgtcaggcagaccggggacttggagcacctagttccacttgcgggctgacacttctattttttgtcatcgtgttgggagcttaggaaagtgacttaacctctctgtgcttcagtttgtccgttggtagaaagggggtgattatactccccgctccatggggtttggaggaaggctgtgtgggttgtgctgagcagcgtgatggtgcaggctgtctgggtcagtgccgagggagcgagtcttccttcggcggttgtaatcagaagtagcttccaaggctgggtgctgccaggaggagctggggtgggtgaaggggcagtggggagcacggctcacacggccagcgggtgacctggggaggacggaggggggtgtgctgggcgcttcaggcgtgtggctccctttcctgtggggcgaaggtcaggaggggggcagggcctggctgtgtcagaatcactcagactcttaagacacatccagagtccccagccccaccccaacccaacgcacccactccaccagaagaaacggggcaggtgggggccaaatctgtgagttcccaagggaggactgtgtggggcaggttgtggggggcggcgctagcatggctggaaacatctcgaggtttgaagccagagcctcaggtgagactcaagggtccctgggactccctcctgggtgtctgaccgtttatctttcatggagttacaggcgaagacatttctgtgatgtcttgaattctgctttttcctgattttgagcaaatgaaagccagctgggtgtagggagtcaggtgccttccccaaggaaggggctgagagggtggtcacaccaggaccccaagggacagggagcagcgttcccaggggcacacaggcggcctcctagaggtagggatgcgttggtggcggggggggccccgcactgctgtgtgccttcaaggtggcactatttacgtggcccctgagctgcagggtgaccgctagccctgggctgtgtcctggctcccccgcccctcctgaagtgacccccatgagacagggcaggtatatcccacgagcctctgccgcccagcgtggccggggctcagtgggaccatggcggctgcgatgctgctctctgcagctcagagtcactctcatccccagcagtcgagtgcagagcctgggcctccggcctccccaccccctccacacagccccaggaccaaggcagcagctggcttcggtttctgccatgtttttccaattatgtggaatgagctaaaaacagcaggagtgaggccttatttgggagttgccaccgccatcctcggaagctgctgttcctcactgccacccctccagccccatcctctgtggaacgtgcccctgttcttttgacttttgtctcctgcacatccctcctgcttgggggcctttgggcagtgggcttagcggcgtgcaccatgccactcgggccacacatgccctggccggtggctctcagagctatgtccagagggtggccaggcagtgctcccggcagcgcccagatgaggctggggtgcggcttggggatttgtgggccgctggccacagctcacccagacagagttttaacagatgttcgtctgtcagggacaggaaacaaaaagaagtcggggatggagtgggggcagcgggaggaacagagggggccactgtcgagtctgacgggcagactgacagctggagccgacggcaaagcccctcacgtccctccgtctgtccgggcggattagctcaggaagcagggcccgctcagctcggggccgaataacgggcgtttgttcccagagtctggctgtcttgtcacttatcagggaagtaggtcaaagggaaaaaagaaaggaggtcctgtggggccgagtctgccgcggccgggcagtgattggcgttgactttgcaaacagaaggcagctgctgttctcagccatggaccgtgaatttttaatagcaagaaaatcagctcacacggttcaggaagttgtggaagaagcctgagtgctaactttatttttttaattgaggtataacttgcaggcaataaaacgcacacattttaacgtgtacatttggattaactttgacagctgcatatgtctgcataactaccacacggtccagacagagaacatttctaccactgggaaagttcccggtgcccctttgccatcctcaacccccgccccctccaccactctcctgacttctatcaccttggattagcgttgcctgttccagaactacatggaaatggaaccacgcagctgtgctcttctgctttttggcctgaatactcactgtcagggctgatgcaagaggagaggggcgcatcatattcctggagaacgctgtcaccgtggagcgggggcacagggggaatggcatctctgggatgggtgaatgctgtgggcgcctttccacaggctcagagttagactgtggtcactggttttgtcccctgcagcctcttccatgtcccccttgtgactgcagcataagcccagctccatgcggaccccagaccagctccgcagctccaacagcttccctttatcttcagtggcgagctttgcgcttgcagggtgcggggcctggtgggacgcccacgttgcccagacagaacccttgtgcggctgcgggcactccttgccctttccgcatttggtgatgactccttgtttcgtttcactgaccgtgccctgtgcctctgctctccctccccagttccgtgtgccctggggtcagtgatagaagacacggcccctggaccccaagtctgctgagctgacacctcgggctgccgctcacctgcagagagacactagaaggctccgactcccttcctggcccccactctgtttttctaccttttaccgcctattccaatggaaatgcacgatttgtttctccctgtgcacatctgagtgtggacctccctgcccctgctcgtgctgtgcccaccacctggagcacccttcccctgccccctgcccccggccacagcgcccctccatccagaccccactcctgcacacggctcctccgcccgtgcgcagccctctgagagtgtggcaggtgcaccaggctctgctctagggagcttcttcctcttcctgtgtcccacgggaccaacatcgggacccaggaaacaggctgggagagttcggtaacaccttcaagagggtttgagagctgaggttctttggtcttcagtggagctggcagtgactttcttgactttgtcaagagaagccccccgtctctgtgccacctctggggatgtgattgaacggaaatcagagcatccgagttccagcctcagccctctgctgtgtggctgtgaaatgtaggccctgtgtgccttgctgacctgggagggtcgaaaggacggtgtctggggaaggatgcataagttgtagagtgccctgcacttgtgataggtggggccgcgtgaactgctgatagccatcttctgtcagttggggcagtggcattgtcacatggttccattctaatccgttattttggctactgccactgaggcggggtgggtgacaaaagtaacgtttcttgggggccactgcagcggtcatggtcctgagccctatacccaggcacgcgtcctgggagctgtgtgaggggtcgtccgtggctggccctgcttctttttttttttttttttttttttaattgagacagagtctctctctgtcacctaggctggagtgcaatggcgcgatctccgctaactgcaacctctgcctgctgagctcaagcgattatcctgcctcagcctcccgagtagcttggactataggcacccgccaccacactcggcttattttttgtatttttagtagagatggggtttcaccgtgttagccaggatggtctcgatctcctgaccatctcgtgatccacccaccttggcctcccaaagtgctgggattacaggcatgagccaccatgcctggccggccctacttcttaaatgggcctgaggcacatggtgccgagagctcgctgaggtctatggaggaagggcgcagatgggatctgggcctggcgtcctggccggcccccaaggccttctccacagagtttccatgtataccggggtggccttgcggaggggcgcagccatgcgtcaggctggagccagctgcagaggccacagacagggtgtcatgagcagtacaagtaaccgctgctgtccattgaacacctactgtgtgcctgggttcagaaaggcaccctgtgctggcttttaaagaattaggccgcctgcctaaaggggggagtgtggccttctttttcatttaagtcaccaactgttttatacatccacgcccctaaattcttcagttttaggcaaagatgagagggctgcccaggcgtcatttgctcaacaaaaccacacttcacttgtgaggctgtgttccctcaccagggtccccagcaagggggtgtgagtgtttagtaccacagggagggctggcgcggtggctcacgcctgtaatcccagcactttaggaactcctcacctgaggtcaggagttcgagaccagcctggccaacatggtgaaatcccatccccactgcctgcctggggagtggccatgcagccatgggcctgaggttgtggtggggcatgggggcagaggcaggcagtggggggccacaggaggggctggctggcaccgagggatgggagaggaagggacccgcctgcaggtcccttcctgaggccggcactgacttggtcactctctggctgccctgaccccaggcagagcagcgactttcctgttttagagctgagcagacagagcccctgactgcaggccaaggtgcctgccagctgctcctggagggccatagcctctctgtgcttgctggaaggtcccaggcaccgtgcaggtgacagtggccggcctcaggttccagcagagccagcatcgggcccagccacttcccttgtgctttgtgaccctatggtcacttggcacaggatcccgggtcaaatgctgcggttgcggcatttgccccaccacttacccctgggggcagcggagaaacttaatcaattgctaaacaacaaaaataatctggccgcctgccagctgggaagccactgtggccaggctgtttatggccttgggatctgcgcagtggacagtggcctgcaccgtgaccccgttcatcctgcgtgccccaggcccaggaggtggctcaagccctctgcctcctgtaagggcacctgagaaggaggccctggagctgggagcagagctgggggtgggcgtccgggcagcagaggccgattctcagctttccctggatctcagctttccccggatctcagctttctgctacccgtgtgaaaagaagccaggagaacacagctatcctgggttggtgccggctgtggtgggaggcctgcggtgggagcctccgggggccactggacctttcctgggtggcctgtggcctgggagctgcacttggttcggtgcagggaggttgtgacatccactctgtctgcagggatggccggggccctgcggctgggtgatgaggtgggatggaggtgtccggggctgccctgcctccttttgccaaaataacaaaaattatcttgtttgttgtgaaaaaacctgttttcccacattggggcatggagggtattaactgtgatgaccttctgagttcctgcacactggtgacccattggcagggtctcctcctggctctggcaggggtggctcaggccgctgggtgacggtgtgctggccagatagttcctggggctgcaggtggcttctttcgccccatccctcccatcccctttcattcttcctgtcaacacatctcagaccctggacaccgaatgagccgtcggtacccacaccccagggcaattcagtggaggggtaggtggctcgttcccccacgttgccccaggaagaggaccctgtccccggcatcctgacccacctcccttagagaccgagagcctctaaggataaacccattcacccgtgtttcagaggcttttttttcctcttataaaataacatttatacgttcgctgtagcaaggaaaacattataaaaaatagtgaagaaaatagaaattacccataattttgccacacagacttagttgtgtccatgtatcttgtgcaccttttttctgtttacggatcaaaatcgacttttagggtcaggcgcggtggctcacacctgtaatcccaacactttgggaggctggagttggggttggggggtggatcactgaagatcaggagtttgagaccagcctggccaacatggcgaaactccatctctactaaaaataaaagattagccaggcgtggtggtgggtgcctctaatcccagctactccggaggctgaggcaggagaatcgcttgaacccaggagacagaggttgcagtgagccaggatcacgccactgcactccagcctggcaacagagcgagactctgtctcaaaaaaaaaaataaaaataaaataaataaatacataaattgacttttaggagattggttcaaacaatgtgtgtaatgttgtgtctgagtgtttttcatttatcgttcatgcaaattccgacatcattcactcttctccagagtgtgctgttttcctgcctgtgtcatcacccgtcaccttgaatgccctcgtttaggtaaaataagtacattttattcaaaaatatttgaggacatttgggttgtctccaggttcttggtcttgagttttgctgttcttgtggagccatggtggtgtctggttgcaggaacctccatgcgttccagctgctgcttctgcctgtgttcttagagaggaaatgctggggtccgcggttcccgggctgctgaccaggaagcctgcggtgctttacggcccttccagaagcgggagatgcccccacttaagtgtcagacaggcctttccacctcactggcagctctgagcggctcccttctatttgcagatgactgagaagttaccaatttccacgtttactgactgctgtttctcctgttaatttgtatttatagtcttcgctaatttattgctagggttttggtgttgtccctattgacttgtatgccttttaattttttaaacaacattaatagacttcatttttttagagcagttttaagtttacaggaaaattaagggacaagtacagagagttccttccacctgctgtcctcctctcctcctccccaccttccctccttcccctattgtaactttctttctgatattataaaagtcactcatggctgggcgtggtggctcacgcctgtaatcccagcacgttgggaggcagaggcaggcagatcacctgaggtcaggagttccagaccagcctggccaacatggtgaaaccccgtctctactaaaaacacaaaaagttagccaggcgtggtggcgggcacctgtaatcccagctactcaggaggctgaggcaggagaatggcgtgaacctgggaggcagaggttacagtgagtcgagatcgcgccactgcactccagcctgggcaataagagtgaagcttcgtctcaaaaacaaagtcacacacgcttcttgtacgagggtcatttggccgaggggccagatggctcaccatctagttgggacaggccatgagctcggaatgctttttacatatttacatggttgagaagaaaatcaggagaataatgttttgggacatgggaaaatgacatggaatttgcattttagtgtccataaatgaagttttgtttgctcccagctgtgttgactgaggcaggctggcttcctacagctgcggcagagctgaggaggcgggaaggagaccgtgcaggccgcagcaccgaaaatatttgctctctggcccttcccagagtgcttgccgacctctgtccgacagctagaaggaaggataggacccgtccgacgataaccactgttgacatttgagcgcgtttccttcccggcttttgtgtgagagtggcagtctgtttgcttttgtggtcgggatctgctgcacgcacggcgggctgtttgcatgaggcttcctggaggatagggctgggctcggagctgcacgcagtggggcgtgtcctgcatgcagtggggcctcagaagagagctgtggtgggcggggcagtgccaacgctggtgggtgccaggcctccacgctcagatcagccccggcgacaggtttgggccaccctctctctggcctctgtgcagtggcccaggccgtctgctctgcctggcacacttgcctctgtccttccactgaagcgctcctcttaccctctgctcccggctgggtacgttgaattgtgtccctcaaggagatatgctaaaggtctaaccccaggaacctgtgtatgtgatctaatttggaaacagggtcttggctgatgtaatcaagcgaggatgaggtcaccctagagtagggggcctatatccacggtgctggtgtcctcatgagagcaggtgagcagacactgacactcaggggtgaaggctgcatggagtcagaacagggcttagtgcgatggcggccacaagccaaggaactccaagtatttcctgcaacaccagaagctggaagatgccaggaaggatcctgccctggagccttcggagggagtctgtccctgcagacgtcttgacttttgattgcagggatgcatgtcttagggtgtgtgggggggtgcatttctgatgttagaagccacctggttggtggcgatgtgtcacgggagccctctgcaggttctgcgtgtccatgtggtcggggacagaggtgggcagggacggacggtgtcgagctggacatgtccatgacgtcggccatcccttgggatggcttttttgttttgaggataaggctgcctgccaggaagctgtgccctgcctggcccttgccccaagcccctggcctgtgcttggcctcgcggaagggatgtcgcccttctctcctgcatgcgtgcagggaggaaggggagaggtcagcagcccgcctggaggaggctcgggcgaggggaaggtttcactttcaggcaatgttgtggggctgtttaaacaaccccaaagaaaaccatttggccaaactgttagtttccaaacattttacttccttggtgtttaaataaattcctaccaagactctgtagctggtcccagggaaggagttggcctctcttctttatagcccggcacagtcagtcccctgcacctgcccctcccaaccccaggcctgcttccccgtggccatggctgctgcccggacctctctacacacagaacctcctggaggccagctgtgggcaccagccttggcagggctgtggcggagcccaggctgctggtactctctctgcagctgctccctgctggcctggctggacagagtccccaccaccactggggtcacctctgtgctggtcacagctcactcagaccttcaggcaaatgggttggatcctgcctctctcccaggtgtctcagtctctgcaaaactcaaaaacctcagaggccttgcagcctgaggggtgtcagagacacctccttcgaatcagtaaacacctacagattcaccccagcagtgaaaggactgcttcgccacagaggtttgatttactcctaagtaattggaagggatgccgagaataggttcctcatggtgggactagaggccctctgctgacctagttaacagagggctagggctgggtgtgctcagcccctgaaggttctaggcccatttgggacaccccgccagaacctgccacaacctgccatgtggtgacagctacctaaatcccagaggctcttgagctggagagcagacctctcaatctcagcaggccccccacacagaccccataaccctagtctgccttcacagtacagttcgtggctatgtgttcacggatggtgttgttcacctaaggtctctgccctgtgaccccaagggcgtcctgagggcagattccaagtctgtttcgtccacccctccttccctagcagcgggtccagggcctggcctgaactagcttcccacagagatactggtgggatgatgaaggcagccaggcggcaagtgaaaaacgcacttcctgcatgtgctggctcctgggattgaagtgtttgaggaagcaaagtgaagtgagctttcctcttgcggctgtgtgtccttgggccgggagcctaccctctctgagcgttggggtccttgtcagtagaatggggcatcctcatagctcaaggggtggtgtgtgaaaattgtgctattgtgttactttaatgattttttttttttcgagacaaagtctcaccccaacgcgcaggctggagtgcagtggcgcgatctcagctcattgcaacctctgcctcctgggttcaagtgattctcctgcctcagcctcccaagtagctggaattacaggagtgcgccaccaggcccggcatatttttctatttttagtagagagggggttttaccatgttggctaggctggtcttgaactcctgacctcaggtgatccacctgcctcggcctcccaaagtgctgggattacaagcatgagccaccgcgcccggcctactttagtgatttcttaggaggacagagggaacgggctggcaagacaggcttggaatgtgttttgggatcaagtgccggtttctgtctggcactggcgttctctgtggggccatgatggacacactgctgaggtcaagcgtgattcgtcttgcgctgtgcctggcagtctcattggaaagttctgtagacatcgtgtggatggggctcttcccggccaagcccttggggaccttccaggactgtgatctccccacagtggctgttaagcagggacctttcgtgaagtggagtctctggtcccctccaagtcatagctagacagggactcgggcatcgccaagcctggctgattattcactggatgaggagacaggcccagagaggggcaggaacctgcccgaggtcacccagcaggccccagaggtttcggtctcggattctccctgctcatccctggatgtagtgctgctgtggatgtggttctgtgctgggggctgtggagagcagggggcttgtgccaggaccccagtgagggtggcgccctcgccatgaggccgactgttggtatggggcggccatccactggggtgtggggaggaacagctttcctgaggaggaggtggcgggaggaacagcttccctgaggaggaggtggcggtgctgtgtgacctgggccttgaaggacaggtccattgtcaacagaacattttgggagtggagcctagagggagaaaatttgttgaaattcagattcccctccccctaccaatacacaccaaatcagatgcccctgaccagatctaaatttggctctcagagatttccattgtagctgggcacttggggaaccttctaagtgctgcctctgcctctccccagcctgcctgcctcagtttccccagccctgggcccgtgtcgctgttgccatcacgtgggcgccctctagtggaggaatcagattatgcactccggggcttggagcaggagtcaggaggggctcctgtctttccttgaaacgttggatgccgggatcctggaacagtctctgcattcctcctggcgagaaccagagcctgggcacaggggaccatctgttgtttgaaggctgcagcctggcagggcactcaggagatctggcagttggctgcagggccaggtctaggggccagggcatcagggaggctctgggctggttcagccccgggcccctttgcagattgtgacctgggcccctgtgcaggggcatggccacaggatgctgggaggggtctctgaccctgaccttcttggctctgtgcatccttgagaccagaaaggtctggaacaaatgagtagacgatgccctaacctggggagggagccacatcctgatcccagcaacctcgggaaggatctgtcaggattatggggcaccctgggggccccaagtctgcatgggtctccacttgcaatttctgtaggaagctctgataaatccaaactgggggtcctaggacacagtcagaaatgctgataccgttgtgtgtggagcctcgggccctgggggtcaggagcatgtggagggtgggccacgggggttcagaagagaatcctgtaaccccccaccccccaaactgaagcccacttgagggccatggctgaaaggttggggggtctccgtgcgtcctgtggagtgggtggtgaggagtccttgggtttgcacgcctctgggcctgagcggcgggaccccgtccacagcggatccctgggccctgttgctcagatgctctcagagtgttgctgtggccacggagggagcctgagttaagcttctcttgtgccggttgtacgctgtcaggtcacactggtgagttaggcagggcacagatgcccagagcagagggaactttccttggggattcaacacgtgcaagtcttaggggctggcaaatcctgccctcagctagagagggggcttttatttgagaccagaatcacctgagcatcctcctgtccccagctgtgtccagcctgtctgcagggacatcctgagaggaccaggctctcccctcatccacctgcctaagtgccactctgaaccctgtccacctgtgccgtggaggggcgtgacctcaagctgctcagccagcagcaggcttggccctggggggcagcagagacccaggtggctgtggggtgggtgcttcgtggcgtggttctgaaacttcgttggaagtgtgtggacagtgccttgcctgttctctgtgggaccctatttagaaacgaggtctgagttactgggggtcatcactgtgttctgatggcccagctgtgtggaggccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggatgtgtctggccctgcctaggagccccccggcacggtgctggggcctgaagctgccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaatgaggaaacaaacagtgccagcctcccagaggtgtcatgaggatgaacgagtgaccatgtagcatgggctgggtgcgtgtcacctaacatcaccagcctttgcaaggagagccctgggggcctggctgagtatttcccttgcccggcccaccccaggcctagacttgtgcctgctgcaggcccttgacccctgaccccattgcacctgtctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggcgggggctggggcctggagccagggccaggccaagcacaggcgagagggagattgacctggacctgtcattctgggacactgtcttgcatcagaacccggaggagggcttgttaaaacaccggcagctgggccccacccccagagcggtgattcaggagctccagggcggggctgaagacttgggtttctaacaagcaccccagtggtccggtgctgctgctgggtccatgcgtagaaagccctggagacctggagggagccctttgttcccctggcttcagtttcctcatctgtagaatggaacggtccatctgggtgatttccaggatgacagtagtgacagtaagggcagcctctgtgacactgaccacagtacaggccaggcctctttttttctttttttttttttgagatggagtctcactctgtcgcccaggctggagtgcagtggtgtgatctcagctcactacaacctctgcctcctgggctcaagtgattctcctgcctcagcctcctgagtagctgggattacaggtgcctgccactgtgcttggctaatgtttgtatttttggtagagatggggtttcaccgtcttggccaggctggtcgcaaactcctgacctcaggtgatccacctgcctcagcctcccaaagtgctgggattacaggcatgagccaccacgcccggtcaggccaggcctcttttgaacactttgcacaccatgggtcttttcatccaggggggtaggtacagttgtacagttgaggacactgaagcccagagaggctcagggacttgcccagggtcacacagcaggatgtggcaggtgtggggctgggcctggcagcgtggctccagctttccagcatagaaatctgtgaaagcagatagtttgtcggtcggtaggggagactttctgagacccgccccagcggctcagagggtagtagccaggggccttcctgggggctcataacccagaacactgaatgggaaaaccctgatggaggaggcgcagtggagctgtgggtgccgatgggaagtcccagaggagctgggaggtcagtagcggtgctgccctctgtggagcacttagtgggcaccaggtgtgtttccaggttcatggccctgggacctgaagctcagaaggtgaagtaacttgcccagggcacccgtcgggcagcggcgggcagaggatttgtgggctgtggagcctgtgctcgtggcccagccctgggggttgtgagtgtgctggccggggagcttttcctgcaagtggactggtgtctaggagccagcatgtcaggcagcaggcagcgggagtgcagcaggcagcgggagcacagcaggcagagggcggggctcgagcagccatccgtggaccctggggcacggaggcatgtgggagagggctgctccatggcagtggctgaagggctgggttgtgccccgaggagggtggatgagggtaagaagtggggtccccaggggctttagcaagaggaggcccaggaactggttgccagctacagtgaagggaacacggccctgaggtcaggagcttggtcaagtcactgtctacatgggcctcggtgtcctcatctgtgaaaaaggaagggatggggaagctgactccaaggcccctcctagccctggtttcatgagtctgaggatcccagggacatgggcttggcagtctgacctgtgaggtcgtggggtccagggaggggcaccgagctggaagcgggaggcagaggggctggccggctgggtcagacacagctgaagcagaggctgtgacttggggcctcagaaccttcacccctgagctgccaccccaggatctgggttccctccttggggggccccagggaacaagtcacctgtcctttgcataggggagcccttcagctatgtgcagaaggttctgctctgccccttcctccctctaggtgctcagctcctccagcccactagtcagatgtgaggctgccccagaccctgggcagggtcatttctgtccactgacctttgggatgggagatgagctcttggcccctgagagtccaagggctggtgtggtgaaacccgcacagggtggaagtgggcatccctgtcccaggggagcccccagggactctggtcactgggcttgccgctggcatgctcagtcctccagcacttactgacaccagcatctactgacaccaacatttacaaacaccgacattgaccgacaccgacatttaccgacactgacatttaccaacactgtttaccaacactgacatctactgacactggcatctaccaacactgacatttaccgacactgacatttaccaacactatttaccaacactgacatctactgacattggcatctaccaacaccaacatttaccgacaccaacatttaccaacactgaaatttaccgacaccgacatttaccgacaccgtttaccaacaccgacgtttaccgacaccgacatttaccgacactgatatttaccaacactgacatctactgacgctggcatctactgacaccgatgccagcatctaccaacaccgacatttaccaacactgacatttaccaacactgacatttaccgacattgacatttactgacactgacatctactgacactggcatctactgacactgacgtttaccgacactagcatctactgacactgacatttaccaacaccagcatctaccaacaccgacatttaccaacactgacatttactgacactgatatctactgacactggcatctactgacaccaacatttaccaacaccagcatctaccaacaccgacatttaccaacaccagcatttaccaacaccgatgtttaccaacgccgacgtttaccgacgccagcatctaccaacactgacatttaccgacaccgacatttaccgacactgacatttactgacactgacatctactgatactggcatctaccgacactgatatttaccaacgccagcatctactgacactgatgtttaccaacaccgacatttacgagcaccgacatttactgacaccaatatttactgacatcaacatttagccatgtgatgggggccggcttgggggcaggccttgctcttggcactggggatgctgcagagaccagacagactcatggggtcatggacttctgcttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtggacatgtttgatccaggaggccaggcccagccaccccctgcagccagatgtacgtattggcgaggcaccgatgggtgcctgtgctctgctatttggccacatggaatgcttgagaaaatagttacaatactttctgacaaaaacgccttgagagggtagcgctatacaacgtcctgtggttacgtaagatgttatcattcggccaggtgcctgtagacacagctacttggagactgaggtgggaggatcgctggagtccaagagtttgaggccagcccgggcaaaggggacacaggaatcctctgcactgcttttgccacttactgtgagatttaaattatttcacaatacaaaattaagacaaaaagttaatcacatatccactgccctgcttaagacagaaaacatgggtgttgttgaagccagaggcagctgctggcctgagtttggtgattggttcctaagcagttgaaggcagttttgtttttccatagatgtctgttctccctttgctgggtgcagcctcgccctgctgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcctgtggacgcagcctcgccctgccgctgtggtcgggtttcagtggcctcgtcccatgggcgtgctttggcagctttttgctcacctgtggagcctctcttgagcttttttgtttgttgtttgtttttgtttgattttgtttgattgtttgtttttgttgtcgttgttgttgcccaggctggagtgcagtggcgcgatctcagctcactgaaacctctgcctccttgggttcatgccattctcctgcctcagcctcccacatagctgggattacaagtgcccgccaccacgcctggctaaattttgtatttttagtagacagggggtttcaccatgttggtcaggctggtctggaactcctggtctcacatgatccacctgcctcggcctcccaaagtgttgggattacaggcgtgagccaccgcgcccagcctctgttgagcatattttgaggttctcttggtgccagtgatatgtacatgtgtccccatcgcaccatcgtcacccattgaggtgacattggtgcctctcctcggggtggatgcctccctctgtttccagcaacttctgaaggattttcctgagctgcatcagtccttgttgacgtcaccatcggggtcacctttgctctcctcagggctcccaggggaggcccgaatcaggcagcttgcagggcagggcaggatggagaacacgagtgtgtgtctgtgttgcaggatttcagaccctgcttctgagcgggaggagtctcagcaccttcagggtggggaacccagggatgggggaggctgagtggacgcccttcccacgaaaaccctaggagctgcaggtgtggccatttcctgctggagctccttgtaaatgttttgtttttggcaaggcccatgtttgcgggccgctgaggatgatttgccttcacgcatccccgctacccgtgggagcaggtcagggactcgcgtgtctgtggcacaccaggcctgtgacaggcgttgttccatgtactgtctcagcagtggttttcttgagacagggtctcgctcgctcacccaggcgagagtgcagtggcgcaatcacggctcgctgtagcctcaatctccctgggctcaggtgatcctcctgcctcaccctctgagtagctgggactacagacacataccaccacacccagctagtttttgtgtattttttgtggggggagatggggtttcgctgtggtgcccaagctgatctcaaactcctgaggcacaagcgatccacctgcctcggcctcccaaagtgctgggatgacaggcatcagccgtcacacgcagctcaatgattttattgtggtaaaataaacatagcacaaaattgatgattttaaccattttaaagtgaacagttcaggctgggcgtggtggcttatgcttgtaatcccagtactttgagaggctgaggtgggcagatcacctgaggtcaggagtttgagaccagcctggccaacatgatgaaatccagtctctactaaaaatacaaaaattagccgggcatggtggcaggtgcctgtaatcccagctactcgggaggctgaggcaggagaatcgcttgagcccgggaggtggaggttgcagtgatctgagatcatgccactgcactccaatctgtgtgacagagcaagactctgtcttgaaaaataaataaataaaaaaaattttaaaaagtgaacaattcagggcatttagtatgaggacaatgtggtgcaggtatctctgctactatctacttctagaacactttcttctgccctgaaggaaaccccatgcccaccggcactcacgcccattctcccctctctcccagcctctgtcaaccactaatctactttctgtctctgggggttcacttcttctggacgttttgtgtgactggaatcctgcaatatgtggtccctgcgtgtggcttctttccatagcattgtgttttccagattcacccacacattgtcgcacgttatcagaatctcattcctgactgggtgcagtgggttaggcctgtaatcctaacattctgggaggccaaggcgggacgatcacttgaggcaggagtttgagaccagcctggccagcctagcaagaccccagctaccaaaaaattttaaaagttaactgaacgtggtggtggtgggcacttgtggttcccagctacctgggaggctgaggtgggaggatcgcttaagcccaggaggtcaaggctgcagtgagctatgatcgcaccactgcactccagcctggacaacagagcaagaccctgtctgaaaaaaaaaacaaaaaaaaaagttcctttctttttgtggctggatgacatcccattgtatggccacagcacattttgtttgtctgtttatcgggtggtgggcagtggtttccaccttttgtctcctgtgaataatgctgctgtgaacatttgaattcaagtttttgtttgaacacctgttgtgaattatttggatatatgtgtaggggtaggattgctgagtcctatggtaatgttaggtttgacttactgaggaaccattaaactgttttcaacagtggctgcgccgttctgcatccccaccggcagtgtgtgagggttctgactttacctcctcacaaacgcttcttttccatttaaaaaaatattcagccaggtgctctggctcacgcctgtaatcccagcactttgggaggccgtggcgggcggatcacctgaggtcaggagttcgagacgagcctggccaacatggtgtaaccccatctctaccaaaaatataaaaattagccgggtgtggcagcgggcgcctgtaatcccagctacttgggaggctgaggcaggagaatcacttgaacccgggaggcagaggttgcagtgagccaagatcgcgccactacactccagcctgggtgacaagagtgaaactccatctaaaataaaacaaaaataaaaataaataaaaatttattaaaacattcatcacagccagcctagtgggtgtcccatgtggctttgcctcgcatttccctgataactaggatgctgagcgtcttgtcccaggcttgccacacctcagcactttgagatacgtcgcacagtccccatttgcgaacgagaaatgaggtttagggaacagcagctgtgtcatgtcacacagcgagcagggggtctctgagccgtctgaccccacagccgaccaagctccaatccttaccgcctcctagtgttgtggatgtagcccagggtgctcccacatttttcagatgagaacaccgaagctcaaaacaggagcgttttgtccacattggatacacgatgtctgtggtttggtcctgaagtcactttatatctcagtggtccagactggagtaggacagggggttctggggaatggggaaggtgtctcaggtgaaaggaaggaattccagattctccatactgtccttgggaagttagaagactcagagggtctggcaaagtcagacaaagcaagagaaatgcagtcaggaggaagcggagctgtccaggaacaggggggtcgcaggagctcacccccaggaactacacttgctggggccttcgtgtcacaatgacgtgagcactgcgtgttgattacccactttttttttttttttgaggtggagtctcgctctcttgcccagtctggagtgcagtggcacgatctcggctcactgcaagctctgcctcccgggttcatgccattctcctgcctcagcctcccgcgtagctgggactacaggcgcctgccaccgcgcccggctaatttttgtatttttagtagagatgggatttcactacattagccaggatggtctcgatctcctgacctcatgatccgcccgtctcggcctcccaaagtgctgggattacaggcgtgagccaccgcgcccggcccgatttcccactttaagaatctgtctgtacatcctcaaagccctatacacagtgctgggttgctatagggaatatgaggcttacaggccatggtgctggacacacagaagggacggaggtcaggaggtagaagggcggagagagggaacaggcggaggtcacatccttggctttcaaaatgggccagggagagacaccctctgagcatggtaggacaggaaagcaagattggaacacattgagagcaaccgaggtggctgggcgtggtggcttacgcctgtaatcccaacactttggaaagctgaggtgggtggattgcttgaggccaggagttcaagaccagcctggccaacatggtgagaccccgtctctactaaatatacaaaaattagccaggcgtgatggtgcatacctgtaatcccagctgcttgggaggctgaggcaggagaattgcttaaacctgggaggcggaggttgcagtgagccgagatcccgccactgcactccagcctgggccacagagtgagactccatctcaaaaaaaaaaaaaaaaaagataaaaagaccaaccgaggaattgaagtgggggggcgtcacagtagcagaagggggatcgtggagcaggccaccctgtggtcatgcactggaagctcattacctgacgatttggagctcatcactgggggcctaaggagaatagatactgaaggatgaggagtgatggcgcggggcacgggtgtctttggtggccagaacttggggactgctggggtgcctcactgcaggccttctcagcgccctttatatgcttacacaggctgtttctaagagggggatacattgcataagcgttttcagactacctcatcatgggtccctttctttaccctctgtggccctggtggcgcactctctgggaaggtgcaggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggacccccatctcacatgagggtcttgggcctgcaggctcgttcaggaaacacccgctgagtacgcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaacccaggtgctgaggagcccacaccagccctggacgtgttttgccgctcacctttgctggggagtggtgggagagaggattccgttccacgtggtggtgtgcgcagctgggctgtgtggagctgggcgctaggaggaaggtgctttctgcggggctagccgggctctgcctttgaacacaatcaggctccaggttttcagcatccagtgcatgagaggacttcacgggcagctgtggctgatcccttgatgaattgggagaagaacaaaggtctatgaaatgaggtttcatgtagatggcattagagacgcccacaacagatttacagagtggagcggagacggcggatgggtctgggaggcccctcctgctggccttgactgtgacagctgtcctgggaatcagcttccaggccgccccagcagcctgactgacacacacaggggttttagccccatcctgcgaccagctgttgccatcatcagtgacagctgggagtggcggtggttccagccctgggcaccctccccacctgctggggcccacccagggcagtcctgacacctacaggttgcttggagccgcatccgagtcctgccccaccacgtgtgaagcccgagtggtcgtgggctgaggtcccctgattgcatccccacttcccttctgcttcacatagctgcctcttctcaccgtttttccagcctcctgggctaggaattccagtgttgtgctggctttgccccaggacacctccttagccctcttcctgagtctagagccccgggggttggaagttctggcccctgggacacctgcagccacactcagcttctcctgtgagcctccagcatgtcccctcaggaccaagccctcacgttcttgcctccccgcccacctgggctcagccaggggaaggcctggctgggagcgtctcccctctgccctgcccttctcccctctaccctgcccttctctcctctgccccgccatggcttttatatcctgtgccacaagacatggctgtgtgtgaaagtggcagggtctggcatctctgtgggtctctgaggcccacgctccagtgccactcttcccacccgctggccgtgccctcatgctggagggacagcccagccctctcccgaaccccagccccatgtgcccagctgcccccggccctctcccctggaagccggggtcactccagccgtatgccatggtggggacatcctgcttccttggccttccagggaaggtcctctttccaaatggcgacacctggtccctgcctggaggctggaagctgtggcccttgtatgcccctccagggtctgtgcgctcggttggcccgagttcccatcaccgtcgtcatcatcaccatcatcattgtcatttcgcttgtctgtgagccggcctggtctcccagagcagagaccctctgaggtccagcctgagttggggtctccgtgctgacccctgacggggactcaggacgtaccaggtctgggtcaggagtgacccccaaacctcgtgccctttgacaggcacccctgacttttgctaagtgggtggaggtgacatcacttacagcgggagtgatgggacagggtctgttggctgcactgtgctcccagggatctggggagaggctatatccctgggctttggcactgcagagctgtgtgtgtttgtgtgtgtgtgtgtgtgtgtgtgtgtgtgtgtgtgtgtgtgtgtgtttgcgtgcgcgcacatgtgtataagatctttttttattacatgaagcaagataactgttgctgtttccttttgggttttgtgttcaacagagtggggtacttcttccctcagacaacagaactctcccctttaaacacgtgctgtcagagggtgggtcttgggctcatgtctgtttgcacagccgagtcagaggaaacacagggttcttcataaaaacactgcacagcaggcgactgtccagagtcagcctgcaggacggcagcagccctgcccctcagagcacagctagggtgggctgctttgggatctcccgtcattccctcccagctggcagccggcggccggcccattccttggtgtgctggtcaggggggcgtgcgcctgctctgctcaccctgggaatgggacagaagctggcagctcggagaggacagggctggacccttgggtggcctctggctggaccatctcattgtcctcagacacagcctctcgggtctagtttcatttcctgaaaaacaagtgcacagaactagagcaggagtcgagagctacggcccccgggccagatccagccctgccacctgttttcacaccatgctcaagctgagtgggttttacattttttaattacttgaaaaaaaaaaagccaaaggaggtttcatgacccatgaaaattatatggaattcaaaaaaaaaaaattatatggaattcaaatttcagtgtccataaataatttcttgagacagggtctcgctctgtcacccaggctggagtgcagtgctatggcatggctcgctgtacccttgacctcccaggctcaagcgatcctcctgtctcagcctcctgagtagctgggactacgggtgtgtgccaccaagcccggctaatttttttttaattttagtaaagacagggtctttctatgttgcccaggcttttctggaactccatcttggcctcccaaagtgctgggattacaggctcgagccacggagcccagcctgtttttgttttttcactgataaagttttgccgggtgtggtagtgtgtgcctctagcgatttgggaggctgaggtgggaggatcgcttaagcccaggagtttgaggctgggctcaagtgatcaggaggtgaactatgatcatgtcattgcattccagcctgggtgacagagcaagaacctatctcttaaaaatatatatttaaaaagtattgggtgtggtggctcacgcctgtggtcccagctacttaggcatctgaggtgggaggatggcttgagcccaggagtttgaggttgcagcgagccaagatcgtgtcactacactctagcctgggtgacagagcccagaccctgcctctttaaaaaaaaaaaccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcggcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgggatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccagcacccttgtttgccttgggccctctgtgggctcctttttattgctcttcaatgaagccagggaaatggacttccttgcctcacttcagttcaacatgtctggaagtttggtattaaaattaagaaagtgtggaaatagagcaagaagagaaaaatctctccaagagataatagtgacctctgagctgggcgcggtggctcacgcctgtaaatcccagtactttgggaggctgaggcgggcagatcacctgaggtcgggagtttgtgaccggcctgaccaagatggagaaaccccgtctctactaaaaataaataaataaataaataaataaatacaaaattagccaggcatggtggcgcctgcctataatcccagctaaggcaggagaatcgcttgaacctgggaggcaaaggttgcagtgagccaagatcacgccattgcactctagtctgggcaacaagagtgaaactccgtctcaaaaaaaataaataaataaaaaataaaaatagtgacctctggccaggtgtggcagctcatacccgtaatcccagcactttggaaggaaggccgagatgggcagattgctttagcacaggagtttgagaccagcctggccaacatggtggaaccccatctctacaaaaatagaataaaatttaagaggtaatagtgaccttttggtagatcgaaacctggattgctttctttttctaaatgctgattcttttctttgtggtgtttgtgttctgtgccgatgtccctcccccagccctgttattgtgagtggaagaaggggaaagggttcgcccgctactgtgagcccctcctctcacgctgggtgtccttggagaagcctgcacttcttcattgtacgccagggctgggtccctccctggagtggttctgtgctgctgggatggggccaacccctcagatgttttctgagtgtcacacacaggtgtgtgcattcatggcctttgcgtgtcttcctgttgtggaggcaaaaatgtgaagaaccctagatgattttgggaccagggctccatcacctgctgttcattgcacaccggagcatccaggcatgggtggagagctcagacttccaggcacggtcgcaggggctggtctaaccatgttcccgcccgcctgctcgtcagaaccgcctgttgggagctgttatcatgataccatacctgggccctgggctatccgattctgacttaattgctccaggttggggccaggccgttgtttgctgttttgttgtttcttctgtgacgttagccactgggctaatctgagcccctcagttacaggtggagaaactgagacccatgggggtgcaaggacttgccgaggacccagagccccttgggggcagagctgaggcggggcctggctttgggtcccagagcttccagtccccttcccgctctcctaacagcttttttttttgagacaagatctcaccctgtcacccaggctggagtgcaatggcatgatctcggctcactgcaatcttcgctagctgcgttccagcgattctcctgcctcagcctcccgagcagctgggattacaggtgtgtgccgccatgcccagctcgtttttttttgtacttttagtagagatagggtttcaccatgttggccaggctgatctcgaactcctgacctcaaatgatccgcctgcctcggcctcccaaagtgctaggattacaggctgggatcacactgtgcctggccctagcagctttgtcctgtgccatccaacaacagatgaccgaagtctttgtttcttaacatgcattccatctgccttacagttttgccacctgcaaaacagaggacttgtcgcttttctggtaagctggaaatgtaatctggtagcaggaggcctgtggaagcttgcctttaatggccttgtgtctctttcatcctgtcctgagagccggagaacttggatgttgcacctaactcaaccttcctgttaacatacagttctgcaggctcatggatcatcagaaccacgtcctatctcacgcggctgtatgcttccgttggttcaggtgtttttaccttgacagtattttctcctcggtggcttttgcggtggttgcttttaatcagcattgactcttcaagaaaaatatttagctgctacatctcagaggagacagggtggaaagcatctgagacctgcaggctcagacttagaaccagaagtgccctcagagttcatccggccctgacccagcgggaaatgagttcacagagaagcgggagaactttgccccaggccctgccgttgctcataactgccccaggtccttacatttgctccaggtcctgccccaggccctgcagttgctcataactgccccaggtccttatatttgctccaggtcctgccccaggtcctgcagttgctctgtgtggtgggtgtgatctggagccctccgcccattgctgcacctggggcaggcattgctaattgatcccaggactccttcctgcggagcacgccctggttctccaggcagccgctgcctgtcagcctgcagtggttcgggagaggacacctgcttgcctggtctgttccaaatcttgcttctcatcccagcacaggtagggggtgctatgggaaagggatcctcagttggccctgtcactgctctatcagctggggacgtggcatcctagtgaaaacatcatggccgggcgcggtggctcacgcctggaatcccagcactttgggaggctgaggagggtggatcacttgaggtcagaagttcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactcgagaggctgaggcggagaattgcttgaacccaggaggtagaggttgtagtgagcccgtatcgtaccactgccctccacctgggcaatagagcgagactctgtctcaaaaagaaaaaaaaaaaaagaacatttatgccaggtgtggtggctcatgcctgaaatcccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacctgggggtgagtcctgagctcggcacccctgagctgtgtggctcacggcagcattcattgtgtggcttggccgcacccctttccctgctgggctgttgatgtttagactggagcctctgtgttcgcttccaggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatccaggacaaatacaggaagactttttttttttttttttgagacagagtcttactctgttgcccaggctggagtaccgtagcgtgagctcagctcactgcaacctccgcctcccaggttcaagcgattcttctgcctcagcctcctgagtagctgggactacagacatgcaccaccacacccagctaattttttttatatttttagtagagacagggtttcatcatgttggccaggctggtcttgaactcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggctcacacctgtaatcccagcactttgggaggccgaggtgggcagatcacctgaggtcgggagttcgagaccagcctcaccaacgtggagaaaccccgtctctactaaaaatacaaaaaaaaaattaaccgggcatggcggcgcctgcctgtaatcgcagctactcaggaggctgaagcaggagaattgcttgaacctgggaggcggaggttgtggtgagctgagatggcaccattgcactccagcctgggcaacaaaagtgaaactccgtctcagaaaaaaaaaagtttgattggtgtaaccaaagcgcatttgtttatggattgtctgtggcagcttttgttctgccgagatgagttgtgacagatctgtatgggctctaaagcctaaaacatgtgccatccgcccctttacagaaaaagtgtgctgacctctgttctaaagtattggacaactacaatgtttgctcatttattattctatgatttgttttctgctttttgttgttgttgttgttgttgagatagggtttccctctgtcactcaggctggagtgcagtggtgtaatctcagctcactgcagcctcgacctcctgggctctagtgatcctctcatctcagcctccctagtagctgggactacaggcacacaccaccactcctggctgattttttttttttttttttttttttgtggagacagggtttccgcatgttgcccaggctggtttcaaactcctaggctcaaacacccacctcagcctcccaaagtgctgggattacaggcgtgagccaccatgcccagcctattctactgtttgtattacatagctttaaaagattttttatgactttaagtcacaagggttctttgtagaaaaaaatatatatataggaaagtataaaaagaaagtaaaaattgtccataacctctccagccagagacgaccgttgctgacacctcagcatattgcctttaagtcttttttctctaagatagcatttctcttcatcacagtcatatgctacgcagaattctgtatcctgattttttcacttgacattacaacaggtatttgatggcgctgtgacaaactctttggcacaatcttttaaatgtatgaaatactccactgcacagatgtttgcttttaggcttaactgttcttttattttgcgtgtgctggttacagccgggcacagtggctcatgcctgtaatcacaacactttgagagggtgaggcaggaggatcacttgagcccagaagtttgagaccggcctgggcaacatagtgagaccccatctctacaaaaaacttttttaataagtcgggcgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaatatatatatatatatatatatatatatatacatatatacatacacgcacacacacataatataaaaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaagaatacaaaaaaattagccaggcgtggtggcatgtgcctgtaatcccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctgagccacagcttaggacccacctcgagaggcaaatgtgctttgagctgccaggcgtcctgggggccctgccttgggcacggggttcagacaggccccagatgtgtggggcgtctttctggacttgagttttcttttctgtgtggtggacacagtgctcaccccttaaagcacctgtgatgtgtgcagcagcccaatccctgcctgtcgcctgttctgctagggaaggaaggaagacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcgccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcccgggaccccagggctggtgctctcatctcctttttccagatcatgagaatgaggctcagggaagtttgaaaaaaacctatcccaagtcacacagcaacaggagcaggatttgaacccagaaaaggggaccgcacactctgttctgctagagtagttagctgtcctgggtgatatggcaggtgacaggggcaactgtgcttaacaaaggaacccccatcccccctgccaagttgggagactagaaggtcaggggcagaagctctgaagggccaggtgcagtggctgacacctctaatcccagcactttgtgaggccaaggcgggcagatgatttgagcccaggagttcaagatcagcctgggtaatgtagtgagacgccatctctacaaaaaaattttttaaaaattagctgggcatggtggttcatgcctgtagtccaagctacttgggaggctcaggtgggaggattgcttgagcccaggaggttgaggttgtggtgagctgtgatcatgccactgcactccagcctgggcaatagagtgagaccgtctccaaaaaaaaaaaaagaagaagaaaaagaagctctgaggctccaagtccccaggcaccccttggcttgagggcagacaagggaggagagggtcacctgggcagccctgacttttgtcccctggcaaagggaccttcagtgaccttggccctaggagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcaccccggagtgaggacagactcagatgaaaaccagcaaaagccctggaaactcatgtgaccctgccaatgagggcggccatgtgcattgcagcctggccgtcactcctcggtacgtgttttggacttaaacgctccggatgtttactgagtgcttgattaataacatggaaggcctggtctcattgctgtgggagtgaaggatgcacagccaggcctgacatgatgagaacaagaacctggagtctcgctgcctgggtggtaatcctggccctgccacttagcaactgtgtgactgtagccaggtcacttaattttgctagatcctgcctgcgcttcagtggatcttgctggttttccaaggtggccaaacactttaaggcattcatgtggtcgctaggctgcagggttgaaccctggctcaccccgcagggcgccgtgtgctctgtggcctggctgtgcctttgctgacaccgtgcccgtgtgtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggtcccccgcacctcactccctcgttagatcaggctggttctgggagctgacgctgaaaggagcttctcatctggggttcctgggtgtacatagatggttgggtaggttgtgcactgcacaagctgcatgatgctacctgggggtccaggtccaggctggatggacttgttgcttcatcaggacatagataaatggccaaaactcctcagctggaaggtcctgggcaggatctttgggtgtgaaaaccagtcacaggggaagggtgcttgctcatactgccagcacagtgctgagtgctttccatagcgctcgtttactcctcaagcctggagggtggggagtagcatggtcccatttcacgtacaaggaacccgatgcacagagaggtgtggcaacccatccaaggccatacaactggggtgggttgagccggggttgactgtggcaggctggctcaagagtccctgctcctgaacccttgccaggcagcctggcatcagctcggggaatttttgccctgacccttggaagcaagtgggcctctttgttctcatgtcagtgatgagaagagtgactttcctatggcccctctggagtacaggtgtttcctgttggcgggctcttcccccatgacatcagcagcgagctggttatgattccctacgcagaacttgatagtttataaagctctttgtcatccaggccccgttggagtctcacgcagacctggtcgcaggcggggctggtcttgcctgtcccagctgcatggatggggaacttgaggcttgcaaaggttaaggggctgttcgaggcccaggctggcaggagatgggcctgggccagagtctgggacttcccatgcctgggctgtctttggtcctgttgctcaccatccctccctggggccatgaccttagagagccaaatggaggtgcaggtaacccacggcaaggaggggttgccatgactcagagtccccgtcctgtggccggcagtacctggtgcaacgacttggatttcagaccagccactgtagcccgctgacggtgcgctcgaagtgccacagcttctgaagccaggcaggactcaggccaggagactctgttagctgttgagagggagaggccaacggatgttctggttctgctagagagctggttcttcggatcctggtaccagtgcactgagaggaggcccagcttgattctggggctgccttgtggtggcatgtgctgctcactgacaccctcgaggagtgtcttctctcgggcttgttgactgtgcccggttttccgcagttcactggtgcacacataggcacatagcaaaccgcacacacagtcgtgggtatgagtttcactacattccaccaccagtgttcactaccattacctgccttccgtcttaagtgttcatcatttaaaaataaatttattgggctggacgcggtggctcatgactgttatcccagcactttgggaggctgaggcgggcagatcacctgaggtcaggagttcaagaccagcctggccaatatggtgaaactccatctctactaaaaatacaaaattagctgggcatggtggggcatgcctataatcccagctactcaggaggctgaggcaggagaatggcgtgaacccgagaggcagagcttacagtgagcccagatagcaccactgcagtccagcgtgggcaacagtgcgagactccatctcaaaaaaaaaataaataaataaaagaaaaataaatttatgatctatttcaaaaataacacatgtactttgaaacagcagagacacatatgacacggagaatgaaattccccatagcgcacccccaagagacagccctggtccccccgtctttcccgtggacctccagcggggcagatgctgagccgcctgttgtcgagtggcgtgctatcccgtcctccagctcctctgtggcttacagacacccacctgcagccctgtctttgcctcctctagcgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgggaagggtgcggggtgtgcttcccaaggcgctcctcttgctggtttccaggctgctgcccctgtccttagcagagggaggaaacagaggatggctctgggtgaatgatgacttgggcttcgattatgtagtcacagggtatgaccctgagatgcgtggaaccccgagactgtgattatatgtagaaactgggtttccccgttgtttaagtagtcatggtggggtcagaccccacaggacttttgtcttttcaagaaagaaaatggtcgtgtgtcatgcaggggtagttggtactggttaatccaggtttatcctttattttgtgggaactgtacagtcatttctgctacaatgctgtatatgctcttctgaaagacacctatgcaaaatcgcacagtaaaaatgacacaactcatagggaaagcggggccagggcacagccctcaaaatctccatcaatgacatgtaagaaaagagaggaacctgggaaatagcaaagtgccttttgcacattaaatggttagctatatcccacaatactgtgcattcgtaaacgttaatgctgcaataaatacggcacttcaccttgggaagatctggagttggcttatgagtgtggaagggtgtagcgcatgagtttttgtgaaacactggaaggaggattgtgggaaatcaaatggaaagttctcaccccaggcgtggagaagagtgggtcatggccccagcagtgagcccagggaggtcagagacggaggtgtgtgtgtgggtgtgaccctgcgcagttccctgccggctgtagttttttgcattcgcttaatgtttctcgtggaggaaattgtgcatgagcaaatgtgaaaccgtgctgtgctcaaattgtcctaatacatcattgcattggaacagattggcttttttttttttttttttttttttttttttttgagatggagtctcactctgtcaccagcctggagtgcagtggcatgatcttggctcactgcaacctttgcctcctatgttcaagtgattttcctgcctcagcctcctgagtaactgggattacaggcatgagccaccgcggccggccagatttgcatttttgaaacaactgctaggctgggcgcggtggctcacacctgtaatcccagcactgtgggaggccgaggcaggtggatcacctgaggtcaggggttcgagaccagcctggccaacatggtgaaaccccgtctctactgaatatacaaaaatcagctgggtgtggtggcgggtgcctgtaatcccagctactcaggaggctgaggcaggagaattgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggtggcctcaggcccacctggagtctgcagcatggggcacaacaggttcattagtgtagaattccaggacaggcctggctcctaagcagccttcttttacaaaaactgcagagcccgcctgtatcctagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggaggtggaggttgcagggatctgagaccatgtcattgcactccagcctgggcaacagagcgagacgccatctcaaaaaaaaaaaacctacagagccacacggcctctttctccaccgagtgttggtgtgggagcttgtgttattgtggtgaaatcttggtactttcttgaggcagagagaggctgagcgcctggagagactttcacatgggtcgccatgtccgccgtcggtttcgctgttgtgctccccatctgaaggctggtgccgtccagacaggctggacgcccctttccaccagatccttcctcccgcagcagtttctagttacgttgtactgtgaggtctgtgtccttggttgatggcaaaagtcagccgaattgaaattcagagccatgcctggctccctggagcttctctcctgggcagctgtgatcattgcctctgctgtggtgtgggtggtggaaatggattcctttcatcttgcttgctacaggtgactgtcacgtggagtcctttggagagagggacgtgttaattgatggatgtggctcccatgctgagaaagctcctgggcgtacattgccttagagtttcattggagctgcgttcttttatggtgtctgctaggcagaagtgatgaagacttggaagaaaacccagaaggttttccacttaatttggaaaatgtgcttttcccctcctgtgtcttttgctaaggtccagcctcctgcagcctccccgctctgtggactctggctttgattctttattaggagtccccctgctcccccaaaagatggtgtctaaattatcatccaattggccgaggttttgttttctattaattgtttttattttttattgtggtaaatatatataacataaaatttgccattttaattgttttgttattgttgtttttgagacagggtctcaccccagtgcccaggctggagtgcagtggtgcgatcatggctcactgcagcctcagcctccagggctccagtgatcctctcacctcagcctctctagtagccgggactacaggcatacactaccacatctggctgattttttgtattttttttttattgtagagacccgctatgttgcccaggctggtctcaactcctggactcaagccatcctcccacctcaccctcccaaagtgctgggattacaggcatgagccacaacacccagccattttaatttttttttttttttttgagatggagtctcactctatcgcccaggctggagtgcagtggcgtggtatcaactcactgcaacctctgcctcccaggttcaagcgactctcctgcctcagcctcctcccgagtagctgggattacaggtgcccatcactatgcctggctaatttttgtattttttagcagagacggggtttcaccatgttggccaggctggtcttgaactcctaacctggtgatccgcccgcctcggcctcccaaaatgctgagattacaggtgtgagccaccgtgcccggcctttttttgtttttgagacagggtcttgccctgtcacccagactggagtgcaatggtgggctcttggctcactgcagcctccgcctcccaggctcaagttgtgcacctccacacctggctaactgtattttatgtagagacagatttcaccatgttgcccaggctgggcttgaaatggactcaagcagtccacccacctcagcctcccaaagtgctgagattacaggcgcgagccaccgcacccagcccattttacctattctgcagttgacagttcagtggcattcagtcagttcacgaggtaaccatcactgccattcatctccagactacttcaccttctcggcagatgtccgaaactgtccgcattgaacacactcctcatctccctctgacagccaccattctactttgtatctctctctgccttctctaggtacctcatgtaagtggaattataccaatatttgcccttgtgtgactggcttctttcatgtgacatggtgtcctcaaggttcatctgtgttatagcctgtgtcagaatttccttccttaaagcctgaataataacccgttgtaaaggctgggcgcggtggctcacaccctctaatcccagcattttgggagtccgaggtgggcagatcacttgaggtcaggagtttgagaccagcctggccaacatagtgaaaccctggctctactaaaagtacaaaattagctgggtgtggtggcgcgcacctgtaatcccagttactcaggaggctgaggcaggagaatcgcttgtacccgggaggcagaggttgcagtgaaccaagattgtgcctctgcagtccagcctgggtaacagagtgagacttcctgtctcaaaaaaaaaaaaaatcatcggatggatggacggaccacttcttgttatttatccatccacgggtgctaggtttcttccacctttggttgtcgtgaataaggccactatgaacatttccttccgtggtgaaggttttgtactagtgaggaaaaggcgtgtttgtggtgttgcataggattctggtaagaaagtttgcactaaccataagtatttgtactacattaaaatgaaagctcaggggccgggcgcggtggctcacgcctgtaatcccagcactttgggaggccagggcgggcggatcatgaggtcaggagatcaagaccatcctggccaacatggtgaaaccccgtctctactaaaaataccaaaaaactagccaggtgtggtggcgggcacctgtagtcccagctacttgggaggctgaggcaggagaatggcgtgaacccgggaggcggagcttgcggtgagccgagatcgcttcactgcactcgagcctgggcaacagagcaagactccgtctcacgcaaaactctgtctcacgcaagactccgtctcaaaaaaaaaaagagttcagggtttatgaaactggccagccgcgtaaagtttgctgtgttgtttttgtgcccgggaggagtgtggccagggtgtcacgtcacacagtacacgtttctcagatggtggttctccagactgctgtcccaaagtctgtttttgcatctggttcccacagacccaccctccacggtgagcctgattttggccagggtagctggaatcttgcttgtctttcagcccggcagctgtaccagtccagggtccacagctagtggcttttaggaaggaatttgttcagttggctttgacacatggccccctagggtccacagctctgtagtgatgtggatgttgttatctacaaagacacatgatccttcgtgtccagatgaaagtgatgatgtctttgcagctgcccagcaaggctgtgtgtgtgtgtgtgtgtgtgtgtgtgtgtgtgtgtggtgtgtgtgtggtgtgtgtgtgtgtatgggggagggaggcaccctttccatctgggggtgtgtgtgtgtggggtgtgtgtgtgtgtgtgcgcgtgtgtgtggtgtgtggtgtgtgtgtgtgtatgggggaggcaccctttccatctgggtccaagagactgggcctggggaagacgcttctttttatctacttagagactttgttttatttgtatttttttgagacagggtctcactctgtcacccaggctggggtatggtgatatgagcatagctcactgcagcctcggcctcccaggctgaagcgatcctcccacctcagccttctgaatagctgggactgtaggcgtgcgtcaccatactgagctattgttttttttgtttggttggtttaattttttttgatacagatggagtcttgctatgttgcccagactagtctcaaactcctgaactcaagtgattctcccacctcagtttcccgacattctgggatcacaggtgtgagccactgctgtctccctgttttattaactgctgaaagacctagataaagaaagtctgaaaagacttactatcagagcaccatcctaagatgattccctctgactcaatggagagggaggggagcttttccttcaggcctgggtggcaggagcccaggtgctccaggccccatttgccccaggccaaatcactcgggaacttggatgcagctgtctttcagggtaacccaaaggaaccagatccccgcaggcagtaggcttctgggctgtcctctcctcctacgtcagctcagtaagagcccttcgaagggatgctgtgtcggaggccccaaaagcccaggctcatccctgagatgcacagggtgggctgggcttaggcagcgctcgagcatctcctggacggtgaccccagagagtgtggagacggagagtccttgagagtcactgagagacgtggctgccctgccttcccaagaggggctctgagtcattccccacactcacctgcccctacccaccctcacctggcccccagcctcacctacccccacatctgtaccgatccctttacccgcaccttccctacccaccctcacctcccctgtaccttcacctcccccactcacccgcccctgcaccctcacctgtcccccaccttcacctaacccccaccctcacctgccctcccctcacctggcctccttccgttggggaaggggttgtaaggggcggcccccaaactgtctgtcctggtgccctgcagagaaaacagtacgtgagggccgcagtccaaaagcttgagtcctggaaggtggaggagacagggatgtgttgggaagggccccatggtcttggatcccttctcgactgtcaatggggccttcatgggagcgccagtctagtgatgcacagctgggtgcccggcgggtggctgaggaggcctaaagtccgaggcggcaagagctcttccagaggctgttgtcctaatcgctctggcatactcaggcgggcacgtagttaggagctgattggagaggagagacccccacaccaatactgggatttgactttcaggctaaacttgagaagtgtggcctctgctgtcctgccagagctctccagccagtgcccagggctctccagccagtgcccgggggtctccaccagtgcccgggggtctccgccagtgccaggggtctccgccagtgcccaggggtctccgccagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaacgggtgggtgggggtgctgcccgtccaggcgtgcccgccgtgtcttctgccgaatgccagcctctcacaggctggggagactttccaccctggggatccaatgggtggctttccagggtcccaaaagcaaacacaggctctttcacagcccctccaggaaagcagaaagccccaagggctggaagggaagggggagctctgctgagaggttacaaggcagcgctggccgacgggagttgcagttgataggttttgtatcatccttgttaaacttgaaccctgtgcagaaatcccttccacggcatgggggctgcctgttgactcgctcctgttccaccacagggagctcctgggcttcttcctcccagaggcccccgacgctcccacctgttggtcgtcagagcttctggttggtgggaaggcacccaggaccttgaggtctccagagagaaaagccagggaaagagggagaccgaaacccatgtgacatgaaactcaggctccaaactgagcacgggaacgtttggggacaggagcgcgatggccttcctcagatagctggggggctggcatgaagacgggagctacagccagcacaggtcctgggccgggagcccagagattgagccctgactctgtcacttactggccacgtgaccttgggcgggtggcatagcctcttggagactcagtttcctcattggtaggagtgacggccacagtggtgcggcctctgcagcacacggggggctcggtgggcggaagccccgggtctataaggcggctgtgcaggagccagccgagctggtctcccaacagccagggctccggggtccttagcagctgtggggggcctgcacctgtttcccatggctgctgtcagaaattaccagaagccaggtggctgagagtaatggacacttgttctctcacagttcctgagggctgaagcccgagatcgaggtgtgggcagggccctgcgccctctgaaggctctgagggaacctttgggcttctggtggctccaggcaccccttgacttgtggtcctgtcactccagtctctctgtctggctgcacatggcgtggcctcttctgtaccattgaaggacacttcagttggatttagggcctaccctcacccattgtggtcgtatcttgatccttcatgacatttgtaaagaccctgcttccaaataagctcacattctgaggttctggggtgagcgggaatttggagagcattgttcaactagtatagaatgtgacctgtcagcctcgggcagccctgagaggcaggggctttccacagcccagctgggtgccctgggctccgtgctgtccgaggagacgccatccccacacccgtccttcacccgccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggtacgcgccccggggcctgccctaaccgcagacacccggccttcattgtcagtaatggcagcagctgccacattgtccgagacctgccgtgagcccagtgccgcgccaggggctttgtgtgtagcgtgttttgtcctcacactgacagctgtaggctggggttctgagtgagccccacagggcagaggcagaaaatgagtctcagagagggtgagcgagctgcttggggccccacagcaggagatggagcaggactgcagcctagcctctgcccccagcacctgcgcaagaagctgctctgctctggactgtgttaggctgcgagggctggagagaaatgagagttggtgcttagagagggggcgcaggtccccatggcttttcctcttatgatgaggtagatgggtgaagggaggggccatgcttgcaggggccagtgaccgaggcccgccgttggaactgatggccttcatcccgagcccagcccaggtgggagcagggctttccgagggcttgtcttgggtcggcctgcttccagggactctgctgcagctcccacccctgtccaaagcatggaatcccccaggctccctggcagtcctgtcaacctctgtcctcccaagctgagtgtggggcaagttctggaggtcagcactgctcaggggggcccacgggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggctggcagtggggtgggcagggtggcctctaaacccgacccctggaggaggctggaggccagtgcaagatcctgtgtggcctcagccaggcggtggtctctgccagatgccaactgttgcccgctggggttcagcgacatgtccgaatgtcccgaggcctctgaggttgttttcttttgccgcagaacaaatcaccacgaacagcgttttaagacaacaccaactctttttttttttttttttttgagtcaggatcttgctctgttgcccaggctggggtgccctggtgcaaacacagttcactgcagcctcgacctctgggcttaattaagtgaacaccttgcctcagcctcccaggtagctgggactacaggtgggcaccaccacacctggctaatttttttttgtagagacggggtttccccatgttgcccaggctggtctgcaactcctgggcacaagctatctgcctgctgtggcctcccaaagtgctaggattataggtgtgagccactggcctgacaacacccacggattgtctctcagttctgtaaggcaaagtccaggcacagcgtggctcacctgggttctctgctcagggtctcacggggccagaatcaaggtgtcaggaacgctgggccctcagcggaggctctgtggagaaattagcttccttgctcactcagcaggtagcagttgtgggatcgaggttctgttttctctctggttattggtcggggaccactctcagctcctagaggccaccacaggtccttgccccgtggccctctctgcctcagcagtgggggctccctgcgtcagtccctcccacaccttgagtctctctgatttgcttctaaagggccctgtgattcggctcagccacctttagattaggttagcctcccctttgatagactccaagtcggctgattaataaccttaatcacatctgcagaatcccttctgccacataaggtcatgacgccgtgctggggactggggtgggaaattacggggtcatttaggattctgcctgccactgccttgctgtgtcccagggcttgggggaggggcctccacagctgggaccacagtccttcctcccctccatggtaaccatctgaggattacttgagaccagcctgggcaacatggtgagaacccatccctacaaaaaatacaaacaaaaagggaccaggctgggcttggtggctcatgcctataatcccagcactttgggagaccaaggtgggctgatcacttgaggttgggagttcgagaccagcctgcccaacatagtgaaatcccgtctctactaaaaatacaaaaattagctgggtgtggtggcaggcgcctgtattcccagctactggggaggctgaggtgggagaattacttgaacctgggaggcggaagttgcagtgagccaaaattacgccactgcactccagcctaggcaatagagtgagactccgtctcaaaaaaaaaaaagggccaggggtggtagtgacaaagagaccctatcccaaaaaaaccgaacactgaatccttgagactgagtaaggacactgtgaaatttttctgggtggggcagggaacagagcgtcttctgtcatttcttccacctgggtgtggtcagctctccctccaagctgcctcctcttcttctcattgtccgggtgttggacacatttggttaactggatagaataacgcgagttcccagggacttggtccatttgctattttattttattttattttattttattttatttatttatttatttatttatttatttattgagatggagtttcgtttttgtcgcccaggctggagtgcagtggcgcgatctcggttcactgcaacctctgcctcccaggttcaagtgattctcctacctcagccttccaagtaactgggattacaggcacccaccaccataccaggctaatttttttgtatttttagtagagacgggttttcgccattttgcccaggctggtcttcaactcctagcctcaggtgatccacgcacctcggcctcccaaagtgctgggattacaggcatgagccaccacgcctggcaccatttgctattttaattcccatgtgtattagtgtcccacggctgctgtaacaaatgaccacaaactggatggcttaaagcaacagaaatggattcccccaatgtgctggagaccagaagcctgcgaccaaactgttgggagggctgtgcttcctctgggggctccagggaggatctatttgttggcccttccagtgctgtgggtgccagcgttccacacttgtggatgcgccgcctcaacctctgcccatcttcatgtgtccatctcctttgtgtctgcgtctttacctcttcttcttgtctgtgttgcctcttataaggacgtttgtcattgggtttagggcccacccaaatcatccgagatgacctcgtcttgagatccttaacctgcaaagaccctttttccaaaaaaaggttatgctcacagattctaggccttaagacatgggtgtatctttctggggggcactatccaaccccttatacaatgaaagacgggaagagggccaggtgtggtagttcacgcctgtaatctcagcactttaggaagctgaagcgggaggatcacttgagcccaggagtttacaagtagctaggcaacatgatgagaccccatttctacaaaaagtgaaaaaaaaaaaaaaaaaaaaaaagccaggtgtggtggctcacacctgtaatcccagcactttgggaggctgaggcaggcagatcacgaggtcaggagattgagaccatcctggctaacacggtgaaaccccgtctctactaaaaatacaaaaaattatggccgggcgcagtggctcccgcctgtaatcccagcactttgggaggccgaggtgggtgaattacaaggtcaagagatcgagaccatcttggctaacacggtgaaaccccatcaagatcacaaggtcaagagatggagaccatcctggctaacacggtgaaaccccgtctctactaaaaatacaaaaaattagccgggcatggtagcgggcgcctgtagtcccagctgctcgggaggctgaggcaggagaatggcgtgaacccgggaggcggagcttgcggtgagccgagatcgctccatgccactgcactccagcctgggtgacagagtgagactccgtctcaaaaaaaaaaaaaaaaaaaaaaaaaaaagaaaattagccaggcacagtggcaggtgcctattgtcccagctacttgggaggctaaggcaggagaatggcatgaacccgggaggtggagtttgcagtgagccgagatcatgccactgcgctccagcctgggcgatagagcaagactctgtctcaaaaaaaaaagccaggcatggtggtgcatgcctgtagtcccagctactcaagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaattgtttccggcatccatttgtgtgtcaatttccgtgtcagtaggaagactctgtaggctgccaagaggaataagtgggaggatcctcccagagaggccgggcctgcaggagggccagttctcatgagttctcatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacagtccctgtggcatccagtttccaaagctgattgtgtcttcctttgccctcctttcttttctactatgtgcattcggtgctatgaattttcctctaagtactgcgtttcctgcatctcacaaattttgttacattttcattttcaggtagtttgaatatttttacacttctcctgagatgacatctttggctcatgtgttatttagaagtgttgcttagtttctaaagagttggggcttttccagctgtctctctgcaactgatttctaatttaattctactgtagtctgagagcttattttatatgatttctgttattttaaatgtgttgggtgtggtgtttttgttgttattgtttttgtgtctttttgttttgttttgcttcgtttgttttgtttttgagacagtgtcttgctctgtcactcaggctggagtgcaatggcgcgatctcagctcaccgcaacctctgcctcccgggttcaagtgatcctcttgcctcagcctcctgagtagctgggattacaggtgcacgccaccatacccagctaatttttgtatttttagtagagacggggtttcaccatgttggtcaggctggtctcgaactcctgacctcgtgatccgcccacctcggcctcccaaagtgctgggattataggcgtgagccactgtgcctggccattaggtgtgttttatcacccagcatcatgcagtttatcttggtgaatgttctgtgtactcttgaaaagaatgtggattctgctgttgttgggtggagtgttccagaaacatcaattagatccagttggttaatagtgctcatcaggttgtctctatccttccttcctgactgcctgcttgagctgtcagttattgacaggggtgtggagtctccaactctaatggtggatttgtttatttctcctagtagttctatctttttctctccttctacccttgatcctcttctccccctagggcttcctggtgttagtggtgggagagtggggtagtgaagaacctggactttagggccaaagaggccagggttcaaatcctggctctgtcacttcccagttgagtgaccctggctggtgcctgaatctctgtgagcctccacttcctcctctgtgaaattgagagcacttacctggcaggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcaccctttttttttttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagtgccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgccagaggccatgcccttccatccaccaccccctggcctgggccctggccctcctggctcgggaactccaggccccttcctcacggctcgagagacgtgtatttaccgcacaggtgcttgtcattctcttgtggcctcttctccagggagatcacagaaggacagggcctcactgaggtctcggacatggaccctttgatagtggcaggagccaggctgggcaagaggcggccacagtcacctcagcagtgccatcaccaccgccattcagcccttccctgagccgggcgcgcccctggctctggccccagtgtcccagttacagctcacaggagcttgtggtgcccagcggctgcttctgattgagagtcgaggtcggaggctttgggaggctgagaggctgctcggtttcacaactgctgagggagacttgggctccatctcaggtctgccccatgtcgccctcaacctccagccaccggtcctccgtgtcccccatggccaggcacggcttgcagacatctgtcgttggctcctctcagccgtcgtgggctgaccctggcacgtcctcctgtggctgagcccagtggggacagctgcttccttttattaccctagaactctcgtctttgatcaggccccctcccctatgccacacagtccctgtcactcgggtgagcccagtagtcatggggaaggcctgcgggttccaaacatccaaaggcttgcgtgcagcatgacagcttgaaaccgatgttttttaccttgatcagatttcagcttggcgggggctttgctcagctttcagtgaggcctgggccgatttcccagcatcccctcctgaggccagcctctgtttcctgtgattttctgcacaaagtgggagggaggagtcctaggaaatggggggccacctcgaagcctaggcctcctctggcttctctgtgccagtgcccccacgctttgtgtctgtgtccccagcccatgggactctgctattccctgagtgctgccgcatgcccagcccgcactgaggacgtggagccccgaggggcaggatggcctccatggtcacacgtaggaagtggcctccaccctccgatgatcctctccctcctccctttcagcgccctccccgggggtgtcctcagccctcctgcctgtgctttgtcccgtcttctgcaggcgcctgggacgtgctgacaggtcctctgccggctcctgccttgctatgcgcacgctggtcaccacagaggcctggcccttcttctgtagcagtcccacacccgcaacaggtgtggctgctgaccacctgctttctgcccctctggtcctgaggagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcacgccattgcctgggttttgctgggcggggctgcgtgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacggtgaggccctccccgtcaaggctctgccaagaccctggccctgccctccgggatacgagcttggggctgcctccggcctcacaggagtaggggctctgaaaacctttgcttgcagggagattgccaagtctgtcttttaggcccaacaaggaaaactctgcagttccacccatcctgtcccaccaggtagtgtggcttgaaggcagactgtgagggtctatctcaccttcctgcattaggtcaggagtttcacagaaacctgaggcacattcaggggtgggctgcagaggtccatggctcacaccctggaaaatccgcccccaaaagacagtgctgtctccactgaccagtctgtgggatagtgcttaagcctgagtggtttctatcaacatgtagaatcaggaggtataaagagatttgctcaggcatcctgggccctctctgaccagcaggatcttcctttagatcttgacagtgaaacacatctcttctgtgccccctgtgagttttctttcattcattcattcattcattcattcattcattcattcattcgagacagagtcttgctctgtcacccaggctggagtgccctggtgtaatctcggctcactgcaacctctgcctccagggttcaatcgattctcctgcctcagcctcccgagtagctgggatgacaggtgcgcaccaccatgcctggctaatttttgtatttttagtagagacagggtttcaccatgttggccaggctggtctcgaactcctgacctcaggtgatccgcccgcctcagcctcccaaagtgctgggattacaggcatgagccaccgcgcccggcctgagttttccttttatgaaggacctgcttggttggttgcctgccacatgttgtcagcaccatgggcccaggactgctgaggagctgttgatgccctcgctctcccagagccaccggctctgttagataattcacatgcagtctggccactgtcctacgtcctcattcacaaagagcagacatttcgtagaagatgagggcctgggagtaacctccctgcatgtttttctataaaggcatagtggttaagtccttccagctcattgaccattggagaattttatggaggctgtagactaggggctggtaaactaagggcccaggggccaaatccagcctgccacctacttttgtaaataaagttttcttggtgcacagccatgcccattcattcatttgcacaatgtctgtggctgctttcatgccaaaagcaagagaactgagtggttatgctggagacctacggccttcaaagccccagacctcacgtctggcccttgacagacagagcttccccagccctgctgcgcatcctggcccagcatgtgctgtgtgtgtgatttcagcttgcaggagccgtggttaggaattgtccctgtgttggtccattttgcattgctatgaaggagcacctgaggccgggtagattatgaaggaaagaggtctgtctggctcatggttctgtaggcagcaccagtatggcacccgcatctgctcagcttctagtgaggtctcaggaagctttgactcatggtgaaagtcgaagcgggagcaggtgcatcacatggtgagagagggagcaacggagagagagagagagcgcctctccctcttgccctcaccttgagaggagatgccaggctcctttaagtaaccagctcccatgtgaactcacagtgagagcccatttgctactgcggagagggcaccaggcatctgctcccatgacccaaacactgcccaccaggccctacctccaaccttggggtcatattttattctgttctatgctatgctatgctatgccatgccatgccatgccatgctattcctattctattatttgagacagaatctcgctctgttgcccaggctggagtgcagtggcatgatcttggctcactgcaacctccacctcccaggttcaagcgattctcctgtatcagcctcccgagtagctgggattacaggcacacaccaccacacccggctaatttttgtattttcaatagagatggggtttcaccatgttggccaggctggtctcaaactcctggcctcaagtgatccacctacctcggcctcccaaagtgccatgattacagatgtgagtcactgcgcccagtgagggtcacatttccgttgagatttggaggggcagacgttggagccatctgagccccctcgtcccgctctagcttctcctcccgtgtgccccgcggtgctggtggcaggcccttacgccggttctggctgcatgctctgttccagaagctttcttccctgcttggttaccagaaaatcatcccatccattacaaggacagggtccccttatctcccattcccagggcaggacaccgggggcagggcaggtggggaactgagcaagttctctgggggcaggcgtggctatggctccctctgggtgggcgtctggggaggggtggaggcagccgtcagcgccctggcttgctcttcctccctggccagagactgtggccttgtgctgctcccgtgtgggctgcctgcacctccagtgggttgtgctccctcccctcccctcccctcaagctctgctgagcaccactgccttccacagcccccactctcgggaggcgaggctcctcgtggccattcctgtccttggcacccacccccccaccaacctggtagagccttgggcggggtctgttactccttgcatggcgtagacctccccacagtaggcacctgacacatacctcctggggggcaggcaggaggtgcgttgaggtctcagccctggcagtccctcccctgcgtggcataggcctcgccacagggtcatcgagggtgggtggagactgtactagaccactccccgctggtcctagaaagggtcccatctgtctgctctctgtttggagtccagaccttggttgctgtgccctgcatggtgggctggggggcaccctccagcctctctgagtgcatggcctctccttgcagccatctgcctgcccaaccagttccggtgtgcgagcggccagtgtgtcctcatcaaacagcagtgcgactccttccccgactgtatcgacggctccgacgagctcatgtgtggtgagccagcttctggcacggggaaggggcgtccgggctgggttcccccaggaacgtggagtttaggggaggagacgtgcctttccagcggggctgggggctgtgtgggagactcaggcggctgggaggctccttgcgggaggcagggaagcctttcccagggcagcggccaggaggacagactgtgagctgtgggctcggcggctacagagtctgcctcagtgggcggggctgatggtgtccaggtgcctgcagcacgcacccacccacgggaccttgctgagcagcgtctgtcaggcagcaagattacccgagggctgcagtggtcctgttccctggcagcttactgtctggctgaggaggagtgatgttcacatatgcacacatgtcatgtgcacacacatgtacatgacaacatcccacatgctcctcaaatagcatgacctgtacagtcacggatatagggcctaggggataggaggccaagacagtcagggaagactttccagaggcagtggctcctgaaaggctgtctgattcaggcaggaagggagctgagttcagataggaagtagcaatgagtcattgtgtctggggacatggccactccttcgctgcagagggacctgggctgagagctcctctcttatggctgcagtcgggagagaagtctgttggggggagaagggggcttcctcaagggactccctgtgccctttggcaccttcgtgccaggtcaggcttgaggcctgaaggcagtggtgggggccaccaagggtcgcctcctctgctgggcaagttcccagtctgacgggcctgtgccgtgggccccagctgtgggggcgctgttgatgcgcagccaggcctcgccgccagagcccgcacgcttccattccgctgacttcatcgacgccctcaggatcgctgggccggccctgtgggagagtgaatgtggcttttgccaaagttgagtctggagcctggaaacttccctatgggcagccttgatagtggagtggcccaaggagcccacccagccgaccctgcccctcccgtggctggtgggcggcaccaggggctgcctggctttgctcgttcaccaacatcacctgggctggccagggcgcgctcacttctgccaccaccgagggccctgggcgaaggagtgaataccaggctgccttggcagggatgtgttgagggctgtggggagtcggacagcggcgggggtcagaggaggaggagggtgcaccgtgcaggctgaagggccacgttaccctgaggttggccaggctccccaggcctagcctcccagctcccccactttctccccaccctccaccagtggcaaagccagccccttcagggcgcacggtgtctgcccccaaggagggcccattccgttggggttaatgttggccacctctttctgtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaatgatctggaggaggcaggagagtagtctgggcagctttggggagtggagcagggatgtgctaccccaggccctcttgcacatgtggcagacattgctaatcgatcacagcattcagcctttcccactgagcctgtgcttggcatcagaatccttcaacacagaggcctgcatggctgtagcaacccaccctttggcactgtaggtgtggagaaagctccttggacttgaccttcatattctagtaggacatgtgctgtgttgtccacaaatcctcatgtaccctagaaatgaatgtgggggcggctgggctctctccagagctgaaggaatcactctgtaccatacagcagctttgtcttgagtgcagctgggatttgtggctgagcagttacaattcctacgtggcccaggcaccaggaacgcaggctgtgtttgtagatggctgggcagccgcaccgcagagctgcaccatgctggtttgtatcacatgggtgaccatggtatgtctaagaaggtggagtccctgtgaggtctgcaggtgcccccacagctccaggccaccttgaggattgcctctgcctgcccagccctgagttccctctcccctgtcctgtcccactgtcaccccaagccggcctcattgggagcctgttggatggcagggtatagatgtaacctgattctctctggggagcggggttatctggcttctcaagagctcctaggagcccacagtggtggcaccatcacagtcgcagcagcccccagagaacgcggccctgtctgttcctggcgtgctctgtgctgccccgcctgggttccctgccccagtcgcaggccccttggaggaggtaccatgtgtctcccgtttcacagatgagccccggggagctcactctagtagtggccagagaggcctgcggctcagggagcggggcacatttccaacaggacacaccgccctggtctgagtctcgtgggtagtgggagcagaggagagcgccctatgtctgtggggcggcttggctgagcctggaagccacctgacctcccccgtcccttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatggggctgtgggcccctcccaccgtcagtgctggccaccggaggcttcccgggttcctgggggctgtgccaccgcctctgaggcatgcttgctttcttcccttttcaaacccttctgcttccttctttaatgacattgttgattgtggataatctgaaaactacacaaaaatataaagagccaaaatctcacccaaatccacctcctagagtggctgttgggctccgtcagcatccaggcggccgtctgtgttccgcacggcccagcccatcgatagccgcctgcaccaggcctgtctgccctctgtgagcctccccacagggttccctccacaaacaccctgttctcccacccagggctggctgcttcctggaaaacagctggatggttttgtgcatgacagacaaacacagggtgattttcgtggctaaaatactccctggagcttttggcagggtgaggggctggctccagctgagccacgccttgagtgaaatgactgtgaggagaataaactgccgctgccctccaggatcactggggctggctggggagaacccccgtttctgggagcacagtcccaggatgccaaggcgagcttggtgccgagatgtgaactcctgagtgtaaacagcgggggctgacttgacatgctttgtatgcttttcatttgttcctgcagctgtatgcccctaaggtgagtccagcccccttctgcttcctctggggcctcgccagtgagccccaccttgctggggctggttcctcctgcccttctgggtatccctcacatctggggtcttgtcttcttgttttctttttcttttttttttgagacggagtttcacttttgttgcccaggcttcagtgcaatggtgtgatctctaggctcaccgcaacctctgcctcccaggttcaagcagttcccctgcctcagcctccctagtagctgggattacaggcatgtgccaccacgcccagctaattttgtatttttagtagagatggggtttctccatgttggtcaggctgatcttgaactccctacctcaggtgatccgcccaccttggcctcccaaagtgctgggattacaggcgtgagccaccgcacctggcctttttcttttcttttcttttcttttttctgagacagggtctcgctctgtcacccaggctggagtgcaatggtgtcatcatggctaactgcagcctctaccttctaggctcaagcaatcctcccatctcagcccctaagtagctaggactgcacgcatgcatccccatgcccagctaatatttacattttttgtagagatgaagtttcactatattgcccaggctggtctccaactcctggactcgagcgatcctcctgcctcggcctccccaggtgctgggattacaggcgtgagccaccgtgcctggcctggggtattgtcttcttatggcacctgactgtggtgggccctgggaaggaagtagcagaagagggttcttcttggtttcctggacagtaactgagtgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgcaaccctcaccacagttaattttagaacattttcctgcccctaaaagaaactctgcatgaagccagctgtttttaaattagcaaagttattttgcatcctttaaatatatgttcatggtacaaaattcaaaagatacagaagagtctgcagtccaaagagactccgcccccatgacgccaagcaggcatccctgggaggcatggcctcctgcagtgtgtttcttctatgtccccccaggggtcatctgtacatatgcaagcatacaagagcgtggactttgttttccaagccagaagataattgtagatttatgtgcagttgtgagaaagagcacagacccatttatcctctgcctggtttcccccagtgctgcctgccatcttgcatgacttccattcctatcataagcaagacactgataacgattctttcaccttattcagattgacataagtgttttttgtttgttcttgagacaaacttcctctgtcacccagtgggagtgcagtggcacaatcacagctcactgcagcctcaaactcctgggctcaagcgattctcctgcctcagtcccctcaagtagctcagatggcaggtgtgcaccatcatgccaggctaatttttaaattttttgtggaggtgaggcctcactaaatttcctgggctagtcttgaactcctgagctaaagtgatcctcctgcctcagcctcccaaagtggtaggattacaggcatgagccactgcgcctgggctgacatatgtgttttcgtaagcccgaaagatagcatctgaagagtcaacattgagccttgccttttgctgctaacgatgtataaaagctgctgttctgagcatttcggaggctcccagctgccgtgtgcaccctgcctagagctctaccgtaacccatctccgggaggaggtgctattgttttcctcattttgcaacaaggaggctgaagaactgagcatgaaccactggcctgggtcgttcggttggtaggcagtggggccaggccatccaactcacaaccaccttctactctgcttcccccgcaccctgaagtttgttctgttttgaggacacagccgtcacattcttggtggctgaacagcactccttgtcaggcgtggctgggcccccactggagggcatcatggtcctctctcctgctgcggttgaaccttggctgtttcaaccactcctgccaagtggccctctgaaagggacagtccatcttttctcagcagagggccacactggcaaaacggtccctggcaccctttctctccacctgtctaatatagagtaaaaatggtatcatgttaagatcttcatttatatttattttatcatgaatgatgtaagcatcattttgtgtgtttaagaacctttgggcccagcgtgatggcttgcagctgtaatctcagcactttaggaggctgagatgagcggatcacttgaggccgggagtttgagaccagcctggccaacatggagaaaccccgtctctagtaaaaatttaaaaattagccgggtatggtgatcccagctacttgggagtctgaagcatgagaattgcttgaacatgggaggcggaggttgcagtgagccgagatcgcgccattgcactccagcctgggcgacagagcgagactctgtctcaaaaaaaaaaaaaaaaaagaaaagaaaagaaattatcaatctcctcttttatggcatatatatatatatatatatatatatatatatatatattttttttttggttatgttcagaaaggccttccctgctctgatcataaaaaacaacttattttcacactctctctcttttttttttgagacagagttttgctcctgttgcccaggctggagtgcagtggcgcaatctcagctcactgtaacctccgcctcccgggttggagtgattctcctgccttaccttcccgagtagctgggattataggcatgcaccaccatgcctggctaattttgtacttttagtagagacgggggtttctccatgttggtcaggctggtctcgaactcgcgacctcaggtgatccacccacctcggcctcccaaagtgctgggattacagacgtgagccaccatgcccagcccacactctctttcttaacgtcctcctcctttcgttttacgttcacatctttaattcttctgggatgtaattagatttgatgagcaaggtgggcatccagcttgtttcttggctgatggcttatgggtggcgtgaattagtcggggtctatcaggaggcagaaactctatgagaatttgaacagagaaagttccgtctacaggcttattaccagggactggaatagcagaaattgaacagtgagatgtacagagaactctaagaatgcaggaataggccaggcatggtggctcacacctgtcatcccagcactttgggagaccaaggcgggtggatcacctgaggtcaggagttcgagaccagcctggccaacatagtgaaaccccatctctactaaaaatacaaaaaaattagctgggtgtggtggcgcatgcctgtaatcccagcttctcgggagtctgaggctggagaatcacttgaacctgggaggcagaggttgtagtgagccgagatcatgccattgtactccagcctgggcaacaagagcgagactcagtcaaaacaacaacaacgcaggaatagcagatgagccgaggtggggcctccccagcccccaccccccaccccccaccctgggccgagatccagtcctctttgaatagggcctggccgtggttcacgggacatctgagacattgccgaggcgctgcactggtggatcttgccagaagtctgcccagtgcagatttgggcagaatctcaaactgccttgggatgtaggagagaaaccaggcctggtcaagttcatgggaagaggtggaaacagaccccataggctggggcttgggcagctgtaggaagccctctctgctgcctccctgcctgctctctgctttgaagcatcttccccagtgcccccagtctcatgccctctcaacgttggggtcaaatcctgaggaatacccagactggctctctgggccaaagaggaccctctccagaaagagcagggcccagtgcggcttcctaaagggcaggggaagggcctggccactccccagaggctactcaccagccatcaggatagccccaggaagcaggccttctcgagcccattttattactttattttattattttatttaattttaaatttattttttgagacagagtctcactctgttgcccaggctggagtgcagtggtgcgatctcaacccactgcagcctctgcctccagggttcaagggattctcccacctcagcctcccaagtagctgggattacaggtgcccgccaccacacccggctaattttcatatttttagtagagatgaggtttcaccatgttggccaggctggtctcgaactcctgacctcaagtgatccgcccgcctcggcctcccaaagtgctaggtcaagcccattttaaagttgaagaaactgaggctgaggtaaattccctccccagggatcctgctgcagccagaaggtggtaaaacaggacttcacccgggtctgtctggcgtgaaaggcagtgttcttgtaccaccctagggggcctgagagaactgagtccctcgggcataactgacagttctgttcccattattccgcaggggctcggatctggctgtatgctttccaggatggccttggagacccacataagccctacaccctttgggaagctgcatgttgggttggggtgccgtcagtggcacttgtggaaggtgcagacctgtgtgggtgtgtgggcccagggcccctggtcccttcctccctttgtagggctggttgtgtgctgcctggacctggggggcacgttcacgtggtgaatttgtctatttactatccccgctttggggctggtgccagcacaggcccttgtgaagggggtgcctttgtctggagtgggactgtggcccctccctcagcgtggtgacttctgtgtcagggcttcagcagggacgcagagcccctgagtgttcggaacaagggcgtcattgcaggagttagactgtgtgtgatggagggaggaggggcaggaggaaaggtcagaaggagagttcctgggaaggtccctgaggagcctggtgaggtgctaactggtgtggaggacactcagggcctgtggggacatctcctactgctgggggccagccacaaagggaactggccgaagtcctgtccccgccttcacagcccagcatctggtcacaaggcaggtacttggaagggcgcgggcacctgggccaaaagtgcctgggttccctttgcctttcactgagatgaccttcggggcaggtggctgctgcctcccctcctgtccccaggttttgccaactggccagaggaaggggtcctgggaagcaggggggccagaagccctctctgcaaggaaagcccgaggggtgtgggaggaaggaaggaatgcccaggctggcgaggctctaagtcacctggcttggctctcctcagatcctgaacccgccgccctccccggccacggacccctccctgtacaacatggacatgttctactcttcaaacattccggccactgcgagaccgtacaggtaggacatcccctgcagccctccatggccattgggttcccgccagcccgtggtggaggggcctaatccccatgccactgatgaggggaggtattctgggtgctagtgggcaggtgccgggcccagccctgcctccctctgctctgccaaccacactaggctgcctccccagacaagctcagcgggcactgcatgttgggttcagaaatcagcagaactccacgttctgagctgctcttcaagttgctcctatgggggttacttttaagctgggaaatggctgtggcgtcgaggggccgggggcttgggctccagagtctgactgtgtgtttgagtccggctgtggaaacctagccattgagatgccccctcttggtggctctgtcctcttaggatgggacaagtctgtgaaggctgctgcagcacccaccgtagacccctaatcgtgtgacgtcaccaggatggtccgggctgctcacttgccacagtggcctgtttgagcccgggaagccaacggggctgctcagctggacaccagccccccgagctgcccatgttggggtcacaggccccacctccctggttggggaggggcaactgagagtgtggagaggtgggacccaggtgtgctggtctccgcaggggctggatcagagcctgggatgggcagggtgagcctcctgacctttaacccagtggtgtcaggcaacgtggcccacccgccagccgcaccaggccccacccccgcaggtgaaggggtgggataggctgggcctgggccaggacacctctggaccacgcattcctcattgcttgggtccctggagcagcagggcctcccgagtgtggtgccgcctgccacctagtggccatttccacgaactcccaggcctggctggggagccggaactgcagcctccatttccaccccactccgggtcgggccacctccctgatgcctcagtattatatcaaactgtcacagtctgtcccacagccttacagaccactgtctccagaatggtcacatccacactgggcagcccagtctcgctagttcctcgtcccacctcctgcctttgctcatgcccgtcctgctctgggcccaccgcggacacatcttccccccgcccgccgtctgacctcacagcagctgggccccaagaggagtatcctgtcctgctgcacttttctcaacacccggtgttggctgcaccttcccacccattgcaggcccctctgtgacaggacgggggctcctaaacacaccacagttccgagtctgaactcacacagtgggatgcggcgtttctgggccacagttgggtgcaggtagcctctgggaggatgggaggtcaggagccatcttgcgagtcaggttgcttgaactcaggatggaagtgttccgggcccattggttgctgtattagcctgttctcacgctgctaataaagacatacccaagactgggtaattgtaaaggaaagaggtttaacggactcacagttccacctgcctggggtggcctcacaatcatggtagaagacaaggaggagcaagtcacatcttacatggcttcagggaacagacagcatgagaaccaagcgaaaggggtttccccttgtaaaaccatcaagtctagtgagatttattcactaccacgagaacagtatggggggaaccacccccatgattcaatcatctcccactgggtccctcccacagcacgtgggaattatgggagtacaattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattctttcgtgccctgtgtgcatttgagttgtgtgtccccgtggagggaatgccgacccccggaccaccatgagagtcctcctgcacccgggcgtccctctgtccggctcctgcagggaagggctggggccttgggcagaggtggatatctcccctgggatgcatccctgagctgcaggccgggccggctttatgtgcgtgtggcctgtgccgtcagaaagggccctgggcttcatcacgctgttgctgttcgtcttcctcagattcttagtctttttttttttttttttttttttgagacggagtctttctctgtcatccaggctggagtgcagtggtacaatctcagctcactgcaagctccgactcccaggttcaagtgagtctcctgcctcagcctcccgagtagctgggactacaggtgcgcgccaccacacccgcccagctaatttttgtatttttagtagagatggggtttcaccatgttggccaggatgatctcgatctcttgacctcgtgatccgcccacctcggcctcccaaagtgctgggattataggcatgagccactgtacccagctgactcttagtcacttttaagaaggggactgtgccttcatttttcactgggccctgcagaatatatgcctgggctctgggctcttctgaacctgtgttggcttccatctgacctctctgtgccagcccaaggctgctgctcttcctgagggcaaggagccccatgactgcgtgttgactcgctggatggggctgctgagcccactctgccacaccacgtgcccctggcagggagggaatccctgggtcctcacaggaacagtcagcaagccacacctgacgcctgctgtgggcccatccctgcggtgctggagaagacagacaaggcctggtcactgcctctgcagggtccccagtccgtggaaggagacagtaatctaggcattttcggtggggaagctgagctgttctcgtgtcctgaaggccaggcgggaacagccgtcttcagagggaagggagaaaatgcacatcgcatcagtggagaagggcctgacttccctcagcatggtggagggaggtcagaaaacagtcaagcttgttgctgggtgacagtgcatttaataatcaaaatataggctgggtacggtggctcatgcctgtaatcccagcactttgggaggctgaggcaggtggatcacttgaggccaggagtttgagaccggcctggccaacatggcaaaacctcaactactaaaatacaaaaactagccgggcgtggtggtgcacgcctgtaatcccagctacttgggaggctgaggcaggagaattgcttgaacctgggaggcggaggctgcagtgagccgagattgtgccactgcactccagcctgggcaacagagcaagactctgtctcaaaaaaaaaaaaaaaaaaagcaatacaaaatacaaatatcactttcactaaaagaagggatggaagacccaaaacaaacagaaaacaacaaaatggcaggagtaagtccccacttatcaataataacattgactgtaaataggctaagctctgcaatcaaaagagtgggccaggagcggtggctcacgcctgtaattccaacgctttgggaggctgaggcggatggatcatttgatgtcacgagttttaagaccagcctggccaacaaggtgaaaccccatctgtactaaaaatacaaaaattagccaggcggtagtggcacgcacctgtaatcccagctacttgtgaggctgaggcaggagaatcactggaggctgggaagcggaggttgctgtgagccaagatggagccactgcactcccacctgggcgacagagtgagatcctgtcttaagaaaaaaaagagtggatgaatggatcaaaaaacaagacccaaccatctcttgcatacaagaaacacactttacctataaaaacacactaggccaggtgtggtggctcacacctgtaatcccagccctttgggaggcctgactggcagatcacctgaggccaggagtttcagaccagcttgaccgacatggcaaaaccccatctctcctaaaaatacaaaaaaacaaaaaaaagaaaaaggctggaagtagtgatgtgtgcctgtagccccagctacttgggaggctgaggcaggagaattgcttgaatccgggaagtggaggttgcagtgagccaggatggtgccactgcactccagcctgggtgacagagcgagaccctgtcataaaaaaaaaaagaaaagaaaagaaaaacgagaaaaacaaacacaaaattagtagaagaaaagaaataataaagatcagaacaggccaggctcatgggcacagtggctcaactcctacctgctcaggagtttgagaccagtctggccaacatggcaaaaccccatctctcctaaaaatatgaaaaaaaaaaaataggctggatgtggtgatgtgtgtgtgcctgtagccccagctacttgggaggctgaggtgggagaatcacttgagcccaggaagtggaggctgcagcgagtcatgaatgcaccctgcactctagctgggtaactggagtgagattctgtctcaaaaaagcaaagaccagagcagaaataaatgaaatggaaatgaaggaaacaatgcaaaatgatacaaaaagttttttcgaaaagataaacaaaatcaacaaacctttagccagattaagaaaaaaagagagaagacccaaataaataaaatccgagattaaaaaggagacattaccactgataccacagaaattcaaaggatcattagaggcaactatgtgcaactatatgctaatgaactggaaaacctagaagaactgggtaaatttctagacacatacaacctatcaagattgaaccatgaagaaatccaaaacctgaacaggccgggcacggtggcttacgcctgtaatcccagcactttggaaggcctgagatcaggagttcgagaccagcctggccaacatggtgaaaccccatctctactgaaaaaatataaaaattagccgggcgtggtggcgggtgcctctaatgtcagccactcgggaggctgaggcaggaaaatcacttgaacctgggaggcataggttgcagcgagccgaggttgcaccactgcactccagccttggcgacagagccagactccatctcaaaaaaattaaaataacaaaaacctgaacagaccaataacaagtaatgcgatgaaaactgtaataaaatgtttcccaacaaagaaagcccaggaacaaatggcttcactgctgaattttaccaaacatttttttttttttgagacggagtctcgctctgtcgcccaggctggagtgcagtggcgcaatctcagttcactgcaagctcctcctcccgggttcatgtcattctcctgcctcagcctcctgagtagctgggactacaggtgcccaccaccacgcccggctaatttcttgtatttttagtagagacggggtttcactgtgttagccaggatggtctcgatctcttgacctcatgatcagtccacctcagcctcccaaagtgctgggattacaggcatgagccactgcgcctgaccaagatcctgtcatttataacaaagcaacaacgtggatggaactggaggtcattatgttaagtgaaacaagcgaggcacagaaagagaaacttcacgtgttctcacttatttgtgggagctaaactttttttttttcgggatggaatcttactctgtcacccagactggagtgcagtggcgcaatcttggctcactgcaacctctgcctcccagtttcaagcgattctcctgcctcagcctcccaagtagctgggactacaagcgcccaccaccacgcccagctaatttttgtgtttttagtagagatggggttccaccatgttggccaggctggtctcaaactcctgacctcgtgatccacctgcctcagcctcctgaagtgctgggattacaggcgtgagccaccgtgcccggccggggagctaaaaattaatacaattgaactcatagagatagagagtagaaggatggttaccagaggctgagaagggtagtgggtttggggggtgaggtggaggagagatggttaacaggtacagaaatacagttagatagaatgaagaagatccgtatttggtagcacagcagggtgactggagtcaacaataatttattgtacatttaagaataaataggctgggggcggtggctcatgcctgtaatcccagcactttgggaggccgagacgggcggattatgaggtcaggagatcgagaccatcctggctaacacggtgaaaccctgtctctaccaaaaatacaaaaaaaaaaattagccgggcacggtggcaggcgcctgtagtcccagctactcgcgaggctgagacaggagaatggcatgaacccaggaggcagagctaggaggcagagcttgcagtgaactgagatcatgccactgcactccagcctgggcgactgagggagactccgtctcaaaaaaaaaaaaaaaaaagaataagtaggaaagtataattagatttttttttgtaacacaaaggataaatgcttgatgtgatggttacatcatttaccctgatgtgattattatacgttatatgcctgtatcaaaacatcatggctgggcacggtggctcaggcctgtaatcccagcactttcggaggctgaggcgggcggatcacgaggtcaggagatcgagaccatcctgtcccacatggtgaaagcccgtctctactaaaaatacaaaaattagctgggtgtggtggcgcgtgcctgcaatcccagctactcgggaggctgaggcaggagaatcgcttgaaccgggaggcggagattgcagtacgccgagatcacgccactgcactccagcctgaggacagagtgaaactctgtctcaaaaaaaaaaaaaaaaaagtttcatgtacccctaggctgggcgggcacggtggctcacgcctgtaatcccagcactttgggaggctgaggcgggcggatcgcttgaggccagggattcaagaccagcctgggcaacgtggcgaaaccctgtctctactaaaaaaacaaaataattagccaggcatggtgcgtgcgcctgtaatccggctactcaggaagactgaggcaggagaatggcgtgaacccgggaggcggagcttgcagtgagccgagatcatgccaccaccctccagcctgggcaacagagcgagactgcgtctcaaaataaataaataaataaataaataaataaataaataaaataaaacacacacacacacacacacacacacacacaccctaacacaaagacctggaagaagtgcctggagagagtctcctggcctcccaacaggaccccaaaaattgaacccttgatcaatggggctggatgtgcagaggtggtgacagcccagggaggctgggtctcctgaacccgcctttcccgcccacgcagtcagctggggagagtgaggggctcatccgccggctgcctaccctctgccaagtacatccttcagtaagtgcctgaagcgggcacagccctgcccttatgccacttatgtgctgggagacccagagattagtcaggtgtggctcctcccctgcatttgctcccaatccaggagacagcggggttccaaagccataaggaagcattgttctaagataccctagagcccagagggccgtcatattcacacaggaagccagagggggcttcttggaggaggcagtgtctgagctgtgtcttaaaggaggaggtgaagttaacctggcttatttaaacttcacaacagtccagccaggtagggggtgttcccagaatctacttgagggaactgaggtttgggtaaaaagaagcaaagccaacatttttttttgcatccgtttaatcttttgtttatccaatacacgttactaactggctaccaggtgctactcaatgtggccaaaaaggcatgtaccttctctccaaaccctctcacctctgcagtgacagccactactccccaagtctctgtcacccctcactgagccctgaggggtctcttgtataatgggctccctccccaccaaccagagcagagatgggtcctttgctcagctcagccttcctccaacccctcattccagaatgggtgtgggagcttcctgcctgccctggggcactgaggcagcatcgcccgggcagttgaagaaagtccatgttgccagtttggctatttccactgccggggaggccactgtgggaggtcttgttcccgagaaatgtgggtggttaggacggtggctagggcttgggtcccactcagcccctgtgaggttccctctcctgggccactcggctggcagcctctggacctcctggttgggccacaccttcagatgccaccggggaaccccctcactggcctcttttctgtggtcctctcccagggtgccacagcttgatctctctccttccaaatgtcctcttctctctttccccataggcttgacggcagccctagttgttagtaactcagcggctacactttctcccaacactcaggctcccaaccatcctttataggaagggaaatacctgcttcccaagcggtattgaatcttaatgcagtgaagaagaaagagaagcagaagagctcagtttccacgttgaaatgggccgacccctcatatcctacatgagcccctagctggcctctcccgtccagcctcaacacctcttgacctgacctggcctgggctcctgaacaccagccaagcccttcctggcatgtcctcttctggggcagcccctctccagcccgtggatcagcgccagcctgggatggactgtgccctggtgacataacaaagggaaagacaatacggcatttttcccttcaagttgaacttcttgttttttttttttttttcagacagagttccgctcttccacccaggctggagtacagtggcagaatctcggctcactgcaacctccgcccccaggttcaagtgattgtcctgcctcagcctcccgagtagctgggattacaggcgcccgccaccacgcccagctaatatttgtatttttagtagagatggggtttctccatgttggcctcaaactccagacctcaggtgatccgcccaccttggcctcccaaagtgcaggaattacaggtgtgagccacacacccggcctgaacttcttcaatttaagctcttctttattcagagctagtttttcctgtgttagtgtatgtgtgtgttagcatgtcctttcttttatgaaattatgataatagtaaatacttaaaaaaaatcattacagaattaaaattgggggccgggtgtggtggctcattcctgtaatcctagcactttgggaggccaaggcaagcggatcactggaggtcaggagttcaagaccagcctggccaacgtggtgaaaccctgtctctacttaaaacacaaaattagctgggcgtggtggtgtgtgcctgtaatcccagctactcagaaggcagaggaaggagagtcgctggaacctgggaggcagaggttgcagtgagccaagattgtgccaatgcactccagcctgggcaacaaagcaagactccatctcaaaaaaaaaaaaaaaaaaattaaaatttggcagctctgagtctgttcccaaaatttaagtcatgatagccaggtgatgggtgcttgagcatgcagcctgctcttctctctgcttttgaatatgtttgaaactattcagttacatgtgtgtttttttaataatttgttattaatttttgcgggtacatagcaggtacatatatttatggggttttttttaaagtctagatggattgaaaagtttaatattaatatgaaacattaaactacaaaaggatcaggaggaaagacagaaggtggtgatccctgaaatctagaagttttagggtagagacgtcaatctgtgtagaatgcaaagcttctaagtcattcctctgcttaaagcctgtcagtagctccccatggctctcaggacccaggctgagctcagatacctcctcctccaggaagtcctccctgacttcaaccttctggttaggttagaagcaaaccataagtggagaccttaggggcccacttacgttgggcaaggtactatatgatttcattataatgtatatggccctgtgacccacctcagagtcagggatggaggagcctggtgcagatactggcaaatcctttgatgatgagtgagtatagggatgcaagggtcggtgggggtgttgggtcctccctgggctccccagcagggaaggacggacgggagcccagccctggctgccccctcctgcccatggcccagcctccctctcaggcaccagccagtcccaggactctctgaaacctttcctgggctccttagtccagctccaagctgcccctctggccctgtgctacacctggtgctccctgctctcgcttccagccatcttctctagagtatggccagcccttcttctgcccggaagctttccttggctcccatggtctgagcataaacccaggttcctccgcctggcttccaaagcctccatggtcccttctgcacctgcttctcgagctgttgccccagacctgagatcagccccaccctgccttccacggggtgtgctccttccaccttgctgcctcggcctctttccctggcatggccgctcccgccctgcccaggtgatcagcctgtgaatcccctccctaacccccacacagagcacacctcccaggctggcttccggcttgactatgttcctccatgcctctctgagtagcaggatcaatgtgagaaaggtctgccctgtctgcagcctccccagaagcacagtacttttcgtggcgcgtacacgggctggtagatacagttgtccctctgtatccgtgggagattgcttctgggacccccaaggattctcaagtcccatatataaaatggcttagtacagttaacaacagagacgtgttctgagaaatgcatcgttaggcaattttgtcctttgcaaacatcacaggtatacttagcacaaacccagatggtctagcctactacacacctgggctatatgggatagcctatcgctcctagactacacatccatacagcatgttactgtgctgaatactgaaagcagctgtaacacaatggtaaatatttgtgtatctaaacatagaaaagatccagtacagctgggcgcggtggcttacgcctgtaatcccagcactttgggaggctaaggtgggtggatcacctgaggtcaggagttcaagaccagcctggtcaacatggtgaaacccccatctctactaaaaatacaaaaattagtgggacatggtggcatgcacctgtaattacagctactggggaggctgaggcagggagaattgcttgaacccaggagtcagaggttgcagtgagctgagatcgccccattgtactccagcctgggcgacagagcaagactccatctcaaaaaaaaaaaaaaaaaaagtccagtacaactacaatatcataatcttatgagaccagtcttttttgtttttatttatttatttattttttgagacagagtttcgctctgtcgtcgagtctagagttcagtggtgcaatctcggctcactgcaagctccgccttccgggttcacgccattctcctgcctcagcctcctgagtagctgggactacaggcgcccgccactgcgcccggctattttttttttctttttgtatttttagtagagacggggtttcaccgtgttagccaggatggtctcgatctcctgacctcgtgatccacccgcctccgcctcccaaagtgctgggattacaggcgtgaccgcgccgtgacctcctgtggattttcatg

SEQ ID NO: 1409 - DNA, 5135 bp, Homo sapiens
atggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacag

SEQ ID NO: 1410 - protein, 1627 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQAVLRSLGFFVLQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 1411 - DNA, 87464 bp, Mus musculus
  misc_feature (1)...(87464): n = A,T,C or G
cagtgtacttacatataataaataaataaataagtaaataaatctttaaaaaaaaaaagtctgggtgagggtctgctgtagggtctcctcacggcctctggggtctgaccctgaaaatatctcctgccctgtaacctcttggtggtggtggtgtgtgagccctgtaagccaactcaccttgactgctcagccccttaccagttagcgtcttcgaatgcttagcgtgttgtatggacattaacactaccctttgagcctcggggtgaaataaatctgccaccaggacgggtgatattgtggcacatgaagttctaccatgattcccaacgacactgtagctttggggcctgggagaggcattgagaagtggccttaactgttggagaagcagacgaaacctttaagtgacagggaaccgtgctgctgctgctgcccacatgtcaggcactgcaacagcaaagggtgacagagggtgacagggatgggggatgcactgtttctgccatgatccctgcccccgctgccctgcagccctgggccgtgggccctcatgttttacacatgaaccctttagctacttgggaccacagctttcgccttagggctcaggcctggcagaatgctgcaggccatgggcatgcggcagctgtgctgtgatcagcttagtgtgtctggagcctaaggcaggcgattgccagctaggtgcacattccagagcagcacagcatgcttcaagggacagggtccaggaggctctggtgggactgtaggatagggtgttagtatatgttctcctccaggctccatgtgtagctcctccagcctggcctttggtggaatgccacattggccgtccataggctttggatatgtcatcagctccagggcctaagctgctcaggatggaagctctctcattcttaatgctgcaccatctgtcttagaactctgtatctatcaggcaaatgggttggataggggtcttccacaagagaagggcccaggagctcaccctgcctctccagcctaggtccgagatcaatgggctcctgagtttggccattgtcctctgctgggcctcagagggtggtggccccatggttgccctttctaggttggcaaacaggcacacttgtttgacacaggaaagaggccctggttttccttctctccacctgcaggatgttgaggatcgggggttgctggaggtggaagggagcaggacctgagcccagtgctgactgagtggtcagtggagatcagctactgcagaactagccgctgctacggcatgctgggatcaccttctagctcccacagatcacaaacgcccatagatacaacactaggacaagccctctgtcctcacttcctgtgtgttggaggcagatcaaattgcctgtgggatgctggaacccacaaaatgaccccaagcttgctctggttccaggatgatcccaagggagacaagcatgtacctaagaccacccagaacaagtgaccctgtatggacaaggtggccgacccctacagaaattcccattgtgggggacgttcctcttgggtagaatagtcaagagagaaacaacagagaagatcaacaaaaccaaaagtgtctgccttaaaaaacaaaaacaaaacaaaaaacccaacagctagaaaatacaggtttatgcagagaagaaagtttgaaataccaatggctccttcactctacaaaacccactttcttggtctttttgtctgtaagatgaaagctgtaaagtttctaagtacaagactcggtcattcctcaaatgcctggctaacatgcaatacctgatctctagcaccacacaggcacataaaatcaaagtgccgtgatttcattttaaaacattttatggaggctagagagtttgctactcaacgaagagcacttgttgctggtgcagaggacctgggttctatttggagaacacacaaagacgctcacaactatctgttaactccagtctctctcacagggcttgatgcccacacacaaaaaataataaaataaataacccacaaaatgttaaaaattattatttccattttacttcttcttcctgccccacatacttctggggatagatcccagaaccttgcataccctggggaaacactctaccactatgatgcaccccaaatattcttttctccttttattttgagacaggatctcactatgttgcctgtattgttcttgagccccatggagctcctgaactttctttctttttttttttttaaagatttatttatttatttcatgtatgtgagtatactgttgctatcttcagaagagtgcattggattcctgctacagatggctgtgagccaccatgtgattgctgggattgaactcaggacctccggaagagcagccagtgagcgctcttatcctctgagccatctctccagcccccgactcctgaactttcaattctcctgtctctacttcccaagtagctaggactcaaccagcctccagcttcattgtttagcaaatgacgtcttcacagtacattttgtgttttgtcttgctccaaactaaaatggttcttttatgtgggaatgtaagctcattttccttcttaaatttttttagtttgcttgtttgtttttattaagttgtatttatttattttatatgtgcgtatgtgcacgtgtatatgtgcgtatgtgcacgtgcatatgtgcaggaggtcagaggacaacttttggtaattggcactttttccaccatgtgagtctcagcgcttgctctctctctctctctgtgtgtgtgtgtgtgtgtgtgtgtgtgtgtgtgtgtgtctccctgtctctgtttttctccctcgccctctctctccccttcccctttttgtttttttttttttccagacagggtttctctgtgtaacagagcactgctgtcctggctgtttgtagatttggctggcctcagactaacagagatccgcctgcctctgcctcccaagtgcaggattaaagatgtgtgctacttgcccggcaagtgtccagtttaaactcaggtcatcagccttggcagcaagtacctttagcctctgagccatcgcactgtatatttgtagcttaaggttaggattcttctttaattattttttatttccttttaatttaatgtttttatctttaatttttggctttttgatacaaagtctcatgtagctggcctcaaacttcgggtccttccaaatacttgtgttacaaaggaatagtattacaccaacattattattattattatttattttttgttttttttgagacagggtttctctgtgtagccctggctgtcctggaactcactctgtagaccaggctggcctcgaactcagaaatccacctgcctctgcctcccgagggctgggattaaaggcgtgcactaccacgcccagctttttttctttctttctttttttttttttttcctattttttttttaaagagagagtctcactgtgtagtagactggtgttgaactcacagaggtctgcccacctttgactcctgaataggattaaaggaattcaccacattcatcctgttttattcttgctagtattggggattggacccctggcttcgcacatgataggcaagcactcttccattgaactatatctccagtccgtttatctaatttttatcaatgaaatacagatacatagaaggacaaaaaaaaaaaaatgtcaatgagatggctcactgggtaaaggtgcttgctgccaaacctgatgacccgagtttgacctctgagactcacatggtggaaaccgactcctgagagtgatctctgacctccacgtgtgagccttggcatgtgcacacaataagattgaaataaactcttatatatatctgaaagccccaaagttaggatagttacaagatgtagtgtaaacctcttttagacctttcccctgcatcttccagtttccttaatcagtttccttcaatcttttcaagcatttttgtctgactaccctctgtatttctaaattatgagtctctttctgtcccgcgtctagctgctaaggcgtggtaagatataactgaagatgagggtctgtttgtttgtgtatgtgttttgttttgtttctgagatggttttcctgtgtagcctcggctgtcctggaacttccttggtagaccagacctcacctgcctcctgagtgctgggattaaagtgtgagccactatagttacccaatactctccgcctaccttgctttctcttttctcttcccaaaggaggaatttcataatttcttgttaagtcatttataccactataactatgtaaatattattcacaactgagccaagtagtaaactctgcttgtatttttctctttgttttttcctgaagttagtattctctttgctttctttttttaatcccctgagttttctccggatccaaggtaatttctcttatatcttccaacaagctctccacccagtttgagacaactagatgcatcctgtttggttccatattttcttggttccttctatcctctcgattggtccgagctgattgtcctcagactggacagccctttcttagctcttgtcttgacagaagtccaatccctgctactctctcagaacagaagacacttgaccttgctctgtcccactctgggcttaatccctatccttcactggatggaatctcccccaggactcaatctggtcttcattcttacaactgtggcttgagtaggtcccgtgcttatctctacctctccttgtccattttcgttgaatgtttaaacagcacattttcctcctggtgtatttatttttgtatttgtgcttagactgagaagggaaccttgtactgtcttggctaagttgtagcacgtgctctggtgccctctctgttcccacaggatccataggaggaccttctctagcctctctagactgttctgttgttcatacgcactcggcagagatgaagaactcagcctgcctcacacaataaggtttgtactctgacaccatctcagacttacacatatgctgggagagtaacccacgagtccatctctctgacactcagcggctaacatggcacttctccatacctcaaggacgattttttttttttttgtaataccctaacagggccatcctaagcgggtcatgttgggactgagatatgatccaggttgtcccagtagtgccttttgttgtgacaagataggtcaacctgtctggagcacatggttgactgaaatgtcattgtctctttgtcctggtgagccttcagcgagccaggtctttccctgtctgcagtggctctgatggctataaaggctctttctgaggcttccagggagagtgcccaggtctgtgtttgatgtctcattactgacgacctgtcatagttagaagtaggttgtgagtcttggagatagtgacagaggtgggtgcagggtctgctcacactgagaggtggggcagcgatttattatcactcatggtatccactctggtggctctgttaaaatggtagcttccggaatctctactgggaaattactactcttttccctgtgtaacaaataagcgggttgtggggggagtggggggagaatgcttttaaataggcaaatggttctcatttaccctttaactattacattttagtaaatattaaatgtgtatgaacttgtgatttcttatcttactctgtgattactacccatccctgttatccatttcaccttctgacctggctaaggggagctctcacaaatcctctctgtgtcccctgtgcatgccttcattctcgcctgtcccaggcttacctgcttctccctgtttctccccagggtcttttctgggagactggaatgcagaaacccgaggtctgtgccttgcattgtctctgatgctcagagacaggtgctcagagtccctcctccagtgggtaaagccaggagggatgggcatgtttgtgcaaacacatgtttacagggatgatgggaagtcacacggtatcacctcataacacatggttcctttccttctttctctttatattctttaatttctaagttagcatatagtttcactctagcattttcatacacaggcaattctcctttctcaccagtcccaggccccagctgacacttgtccagggagatcagcaagtgtgcacatatggaagggagaccagcatttgaccagctgtctaagcacaccagtatggcaaggtccaggcggtgagcttggtgggcctggtagttgggtccctgctactgcccgcatgctggaggttctctaggcaggcaccaagcctccaattcttcagccgacatgactgtgcctaaggcttagatgctccatttaccctcatggaggcctggcccatagcatgattgtgtcacgggccaggacagctgtgggaggggttgaaggaagaaagccagcaggtggaaaaacctccactgagctcggggaacccatggagccttgctagctctgtctgtcacagctgccctgaccctgtggatccggctgcttgaatggaacccagtcctcttgaatggaggggaaacctctgagttcgttgagttcgtaagccagagaagccagcctgagacccttcttgttttctagggctctttactccttcctatatgccctttagggacaagtacctttatgttgtacctggccatggctgcttcgctgggttctgtacctaggagtcaatgctagtctctgcttgggtcttaagatagctacaggacgcattttagcatctttgaaagcactggacacccagactggtgcccagggccccactaagataaagatcataacttccttgtttgtttgttttgagatgggcctcactgtgtaggctaggctaggctggaacccagagatctgtttgattctgttcccaagtgcttgagtaaaaataaaaagtgtgttttagcttgcatagatcattcaagggctgtctaagtcaccttctttggattacaatttgcctgatttgggtggaatataaccccatgcaaggaagtcactctctcaaacgtcacattaatttgtatggagtctgcacgtgtgcagacaaagctatctacagggatacaactaagtctcttttgttttgtaaatattcccttcatgaaataattagctgtctttaaaaaaaaataaaaaaacccaactgcttattttgctacactgaaaaaaagatctttaagttgtggggaggctcatggcatagtgcacgtacggaagtcagcagacaagtcatgggagcatttttctctttctacccccgactgtcaggcttgagggcaaccatttacctgatgagctatcctgccaatcccttaccagttgtcgcatgtattgacagaagagagagctaagagtgggaactcctcattatgaatgaagtcagaagagtaaactgggagcccgagttgtgctaacacggaaggatgatcccctgggcacggtgggaacacaggagcggacttttgtcttcatacagggaactatctagcttccagactttgaatatcaaggcctgccttgaggtaggagcagctgaggcttgcacagagatgcctggccagctccaaggtaggcactgtgtctgggagtgttggcttgtgtctgttctggtcttacccaggaggtcagaaacttgtcaaaagctgaagataactcaggccgccctgggtatggccctcttacttcaccaatcaggaaaggcctgtgcccaggccagtttgaggccctgggtctttgagggggaaatttctcacttcttcacttaaactgtccttcagggtctggttttgaatccttgtgtcagcccttttgttatatgttagctactttgggtgacactctgcaagattgccttactttgatcccaatgtatagccaatatatggagggccagtgtagtcctactcaggccgtaacctagatacctgctatgcacatggatacttggttcccagtcctggaggatgcagggtaaggatcatagcagctgccagcctgagaatcacagagatctgctgtccaagctattggctaatggctggctcaagaagggccaaaagctactagacgcagcttcttcaatataggattacgttcctaagttcccacctcacagaacagggtccagtagacagatgttgctggtacctatatcactgatgagaggctgggtcacagttcatggggtagtcggtgttacctgccagtgagtgacacagggactctccatagctgtacctcctctgcatccctaggtcatgctgtgagctctgcaatcctgtgttgttcttgagtgtggagttctgtatatcactacacatggaaacccagaagtactttgggcagtcctgctctgaagaccttgagtggttctttgtgcaggcacatgggtttttgagctatcttctcaacataagagtaacctggcatgagtgttctgtggtgtcctttatgtcacctggaatgcgtgtttgtgttgcccctatcatatgggggtaggaacttcggttgtgtggcgaccctagggtgctttgagacgttcttgtatcagaacccgaatgttttgtggcatccttgctatgaggaagggaacctgggttttgttttgtggtgtccttgttatgagtgtctcgtggagcacgacgtccagcagtgtggggagtgaaggttacttcacagtgtctacctagaacgggaaccccgggatgtagggcggcagcggcgcagatctactgcggaccgccgctcagctggcctgtggttgtggcaggggccttgtgggtttcgggggccccaagaccgtggtggcagcaggaccggagtcttcccagccgcgcaggaagcggcctcggccggaaggggggccccaggcgcctccgctgtggccgcctccagtggcctccacaaggcggggccgagcgagaccgagtagggccgagcagggccgagccggtaccgagtagggccgagcggggccgagcactgccgagaggggccgagctccggtacgggggagccgagcggagtcgagctgtgggcggacaaagccgagcttggccgagtccggtccgggcgtagccgagcgccactgagcccgggagggggagcgcgcgttcttggaagagcccgcccggagctggtcacattcctggcccgcactccggctgaggcggacgcacggcaacaaacaacgcgggaggcggggctggcgcgggcggggcggggcggtacggggcggggcggcgcgcggcggcgtgagctcagctcccggcgctcagtccgagccggagcgagccgccggaaagatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccggcggggtgcgcgggagcggcggcggaggccgtgggggcccgggcgcacgggagcgggagcggccgggggagcccgatcgcaccatggaagctgcagcggccggccggggcggcttccagccgcacccggggctgcagaagacgctggagcagttccacctgagctccatgagctcgctgggcggcccggccgctttctcggcgcgctgggcgcaggaggcctacaagaaggagagcgccaaggaggcgggtgcggccacagtgccggcgccggtgcccactgccgcggagccgccgcccgtgctgcacctgcctgccatccagccgccgccgcccgtgcttcccgggcccttcttcatgccgtcggaccgctccaccgagcgctgtgagaccgtgctggaaggggagaccatctcttgtttcgtggtgggaggtgagaagcgtctgtgcctgccgcagatcctcaactcggtgctgcgcgacttctcactgcagcagatcaactccgtgtgcgatgagctgcacatctactgctcgcgctgcaccgccgaccagctggagatcctcaaagtcatgggcatcctgcccttctccgcgccctcctgcgggctcatcaccaagacggacgccgagcgcctgtgcaacgcgctgctctacggcggcgcctacccgccgccttgcaagaaggagttggcggccagcctggcgctgggcctggagctcagcgaacgcagcgtccgcgtgtaccacgagtgcttcggcaagtgcaaagggctgctggtgcccgagctgtacagcagtcccagcgctgcctgcatccagtgcctcgactgccgcctcatgtacccgccgcacaagttcgttgtacactcgcacaaggccctggagaaccggacctgccactggggcttcgactcagccaactggcgggcctacatcctgctgagccaggactacacgggcaaggaggagcaggcccgccttggccgctgcctggacgacgtgaaggagaagttcgactatgccaacaagtacaagcggagggtgccccgggtaagtgtccccgggtcttgggggttggcaaactatgctcaaggtgggtgggtggggtccttctgctctgggtcctctgggttcaaaaggttggggctcgtggttcgaccttatcaggccttgggttgatttgattttagaaaagtagggggcttgtcggtctcttgtgggtaaggccatcttcgtgttgtctgagcgctgctcttatggagtagagtaaacgggagagccctctcggggctcatagcccttgaccattcaggctaagctctgaaggtctgagaaagtggcaacttcaagctctgggaggttagagtgcctggacctaggctgtgactttctggcccatatcaccatgggaccttgacagagttgtccatatgagaatgaagcttgccccctttctctcttgtggctgggatgctttcttgcctgtggtcctcagctgagtatccatgcatgtttactgcctctcctgtttttcctttaaatactggggcacagacagctaaagtgaagctagctagctgtcttggcagagacttggcacttgcagcccctggtgtctcctgtttgtgcacgtcgaaggccactttggcgtggtcagcggcctgccggagttgctgatggtctgcagtttctttggtctcacccatttccttatgttgctcttgtgcttggttgtggaggcccgtcagcccaggctgtgttgtatgtgagtcaaagaaagctttgtgagatctgcttgggcatttcctgggccacttggtacctaaatcattcactggagtccacaggaagtttctttgcatatgcatcctaagtatgtttaacttttaaatatccaggcttattaaattgcacacacagaatgctgcattggctcagctattcttgggagacctaattaattcaagctattgcatcaaactttttttttttttttctaaatctgtgaatagatgctgcagcccggttttctctgggcgcccctccagcagcgtgtcagagttgtggggggaggggctctgaagaaggatggtcgcctcattctctgggggctgtggagtgtacatatgctgtgtgttctttggcactttcgccacagccggggcagtgcactgggtgggagatgttgcaggcaggtcttctcagatagacctggctgtagggtcccaccagcggagacctgtctgtctggggtggttgcacccttgtgtggctactgtagagatgtggtactggagaggctgtgcctctgggacactttcacgcctcttatcttgggagcaggcagagagtcttgtctgagttgggtgtgtctgtgtttgtgtttgtctggtcctgagtgtttgtggtctttctgtctaggcttagaggaccagcatggtccctttgtcccagccactgctgagtagaagactcctgtcttctcttacaagtcctgtggtgctgggtatgagattcttgggctcaggggatttggttcagatgcccgtgccagtactgtgaggttagaaggcaggacggtgtgctgagccatggtcatgtgcttgggtcatttcctccatggtttgtgtctagctgctcttctctgttggccaccctgggagtgctctgacacctcatttgttgagtgaagagaagtttctcaggtgctctgtatctccagctcctctcaggcaagtggtggcttcagcttgggctctagagtttgaccagcttccgattgtttactgacaaggcactggtagactcctctttcatctttgtaaggtgctcccagctctgccatccgtgttgctgctcccttgactctgtgggtctgaagttgggggttcaggctggacccgtcctcttcaggacagccatatgtttatctctgtgaaccataggtaacacccaggaaggggaggtcagtctgggtgcagacccatggctgcccagacttctcttgtcctgaggagtggcctgagtgcccgctcttgttcactgaacgttgtcaggatccccttacttcctgcatagcttatgttaacatttgtgatctactgaggagagcacagagtatgctgggactgcaggccatgcagctcttggcgggcccgtgggctgtcttgaactaggggtgagctgagtgcttcgtggagaggggtgggttcttgaactggtggtaggaaggtgcggagggcagtgggtttcctgagtccttgatgctctcatgacacttggctgctctgctctgtggcagcctgcctggggcggcttctctttgactgaggtagggtctgttgggatcgggtggggttggcctggtggaggtggaattgtggttcctgtggtcagttgagtgtgtacaggggtgtgggctgctgtctcccaggcttcggcatgggctatgataggtggtcttctgcaataccctcctgatgtcacggggaaacaggaaatgtccacttctgctggtaaagctttgaagaaaatgccggctacttgggtgctcagtgagccggtccagtcccgctgtgggatcaaacattctcactctcttcctcactcaccggctatgtgagcttgagcaagttgcttaaccccctcctctgtgcctcgattttctgaagcaggttaggactaatgctttcttgaccctgtcttgatactgtttttcgttgggtggtggggcagggcacagatggaagggggcgcctcagaaccttcccttccatccagtagcttcctggacagttctctcttactcttggcttgcttggtagctgttgggcttcccacagagtcagggtatctgcataaaaaggaaaatgggcagtggccctttgagctgcctgccactctgtgtacctgtgggacttggctgatgtcccacaggaagattggtagttactagcagctgtcttttcaggccagccaccgaagtctccttccggtctcctcctggctagaacaggatcctccctgtgggtctgagaagtgggctttggtgtggagtgacttgggttgttgtaggttacggcatctctgttctgaagcctggattctcgggactttgttctggcacccgacaccacttaatgtagacttgtcggggttcctcagagtgggacagcaggactgacggcacggttcttagttccacacctagtcagatggtcagcttttagggagcactgagccctgggtgtgtttaggacatggctgtggctgtagggtgcagagctggtgtggtgtgctaggttcaggagtcttctgagtggactgtgatttgctcttttggttttcttgggatagggccttgtctcccgagaggtgggatcacagtcgtgtatcactgcccagttggggtttttccttccaggaagatcgccttaggagaggacagtgccagtaagctgggaccctgtctcctggacacctgcaggtcttggtggttcttcaaaaggtcaactgcacttagttcactgggttctttttgaagagtgttcaactttcttagagttggtattgatttttccccttcagatgcgtgggccaagaatatgacccggaggtcaggccctggtccaggaaagaagggtgctctctgggtctaggatggctgccaggtggtggttccagtccaaggccagtaggtcttccgagagtgggacggcagtttgggagtggtctctaggacaccatagccagctgtgcgtggaggggttaatgagtattggtggaagcccacctctgagagggccacgttcttacagcatagcctttcaggctgtttgtccatcaatcttgataccttctggggctcctctgggagccatttgggtccctcaccatctggaggaagcagggtcattgagtagccctcacctttgtccccggatgcccactgaaggccccgtcatcaagaagcttccaagagtaaggtcattgactctctgccgtttctcaacctcccctgcagctggtttgtgtaatgtctgtctgaagtgtttaagggcagacaggatgtagagggtgaggaagtctgggccaagtgtgaacccagccctgccctagagcagagcctctccatcccccccccacacccccccccaggtcggagcttctgtctttgcagccccagaaaggaggctgcggttgaggggtttgcctgccctgctgtctggcaggaggcgaggtggccatggctggggctggattctgcaacagtgtctctttctaaggattgcgaaagttgaggcaaggtttctccttcagaagaattatgcaagtttcaactgaaatgttttttaaaagtttctttgttttgaatcaaagctaagttacttctgtgagatctagaagagctgagcagtgaggggagcctctcttgtcttctccctggcgccagggaagagaaaggaagcgtggagctgggtgtcaggtagatggcggctgagaggtgctttgcccctggtgctctgtgtggtcagtagccactgtagccactgatggatcctgtcatgctgacttgtctacactactccatcaagagtgtctcccaccttctcctgtgaccccgtggagttctggtcccttttctagatcaaggattatgctccgacgatcttgctgccttttgaggtactttgagaggttatcctgggtcaccctctggaagcacccctgtcaccagggccaccacgtagtaagctcacagattgcttactacatgtacagattgctcacagagctgctctctctgcacataaggccctgtccccaagcttctgtgctactgcctagagatccctgggttctagactcacagctgccagtatcctcttattcctgaaacaggaccaagatttggaagtggaatgatagtaaagtcagggcagaagcctgtggccctcaagggacatgtgcacctggttacagtacttggtactgaccaagtgtcctgtgagtagatttggctatgcttgtctgcattcttttgagtcactgacctgtttgtgtggaaacagataaagggatcttggcaagagcccagagtcacccaagatctgttgcgctgtttggcgtctctgattttacttttttggcttctgatgcctgaaagaatgccaggacttcagtaacaggggatgaggtgccacaccatagccacccaggctcttgtgtgcactgtgggagctgtctgtggtggcatggtgtgttttgtttctggcttctgggaatgagtgggggctgatcacagctgggtctctgggcagtgggcgtggaaggctgattcactggaagtgagcagtcactgcgggcaggccccagtgcccagatctccatggttgcagaagggaaggttggattgtccttagtacagttctttgcttatccatctcgtcgagggctctgaagaaggctgctcttgcgcatatgtcgtgggggatacctggaccccgtttccagttggagtgcttggaaagccctagaatgtttcccttggctggagctgtgagcattgatgttcttcccagccctctctctgctggctgtggcttcctctggaatgtccgctggtcactgtgaaagaggtggctcttgttggaaacggcttcctgcagctcccactgtgctagcatttcagggaaaggcagtggcctggcatgagtgttgggacctggtggaggcgatggtgtgcagtgaagacttgtgggctggcaagtggggctgacccaagggccagggtgataattgggctctgatgtgacccttccccttcctgacttcccatgagtttaggtgtgaggaaggcccatctataccacatgacacgtgatagtatgggggtggggtggggaggcgggactgaagtttcccagagtgggtttaaccagttaggtgaggagttggggctatacctcaagaataactggtgtcatgtggtgctgccctgatgctgttgttacacgtgattttatggtccctgtacactgtctgctgatggtccctgcccattgtcagtgggcacgctgtttttaagtatagcgttgtctgtccacaagtaacacttgtaagtctataagtagccagagtgagaagtggctgttgccctcgcagacccctcagcctatagtaggcgttgctggccttgctgctgggaaggccagtcagtgggcggctgccagcagcgtcccttggctctgcactcaaagtaacatggggatgtttttgttttgactatggaatgtggccctttgcttgtagacagaggttcttggtgcctgctagttttatttttacttttgtgtgtgcatggtgtgtgtgtgtgtgtgtgtgtgtgtgtgtgtgtgtgtgtgtgtgtgtatgcacgcatgctctgtttgtgaagccagaaattggtgttggtgcccctctgtccttccccacctcattttgagactaagtgtctctggctctgctgttttggctagccgagctggctagtgagcacgggattgcttctctcttccatcaggtgctgaggttgccggtgctcgcgcacgggtcctggggatctgcgctcacagctcatgtttgtgcggcaggcacctagcctgcctagccaggtccctggaccttgatgtctgtttttaaagatgaggctgaggaagtctctcttgccttgctggggtgcccttccttgaggtaaggtgagccaggtctccgggaagtatgaggccctaattcatgagtgtcttcagccctagaaggggtgtgacctgcaggagttggggcacttagggaaactgatttgcttgcgcgacaatactactgtccccatttgtgctggcacaagggacttctctgtgtcggttgctgtgcaagggccagtttgatggtccccgcctggtgtagcctgtgggtgtcgtatctgggtcccctctgtgagaaattgtgggtagacaatgcagacctttctcagaggcccctcccctcccctcccctttcagtttatttagtagcccaaagtaatgtacactccagggaaacactggagtaggtggacttgaaaggggagaactggacaattagtttgtgctttccttctgtgtctcctgcgccctcagcacgacagagatgtccttgccactggcctgcagtccctctggcaccttgtggcacttgggcctgtgtctgggatgtgctgctacgccctgccaccccgaaggattggcaactctggacctctcctctcatgcaacacaagccaatctaggcttcagcatcctgtgttgttgtgtttgggctgtcagggcagggtgctcgtctttctccatctcgtccatccctggcacctgaggggcaaatatcagggcacctttctctggaagaggagaggggcttgctttgggaggaggggccaggatcttgctgtgtagcctaggctgtggttgacttgtgatcccctacctcagtcctttgagtggagattacaggtatgtaccaccatactggctgatgggtttgtttgttgaaggtgaatgcagggcctggactttgacctcttattctagcaggaggtggaccaggctggcaggtaggggacagctgggccacaccataagaacccgtgcataggctccacatgggatgttaggggtttaaagtgaggtgcgtgtaggaacctgtgcatccctgggcagggctgcagcgcagcctcttgtgcgtccctgggcagagggggttgcagtgcagcctcaggatgtctgctattccctcccccgctcgacatcactgtgggtgtcctgtgttctggggtgtgttgcttgggaacctatcttggctcttttggctcttttggggtgaggcccttggttggagatgccagatccccagggctgccatagtgctctgagatggagtctttcctgggcgcttgtggagaccttccctgtcgtactgctggggctgccacctggtgtttgatggcgttggctgcctttttctgcttcacctgctgcctcccccttcctggtgttacaacggtgttgcccaaaccattaaaagaattatactcccaagttgaatgatatgcaaatgtagtcaattaagcgaggggattttaattagcagtttaagttcatgtgtgaagtgccttgctttaattacttgacagttttgttgtaaatttgctaagtttttttttgcagaactatcaaaactgtgatttttttttttttaacatccttctatgcaataagtgtcgcccagcttgcctgaccctagtgggtttgtctccatttatgaagctctttaaactgaaaacaaggtgggccttgtaggttgcctgtgcacggctcagtcagttaggccatactccttgttttcctggcacaggctggcagggtgactccctgggcttccctggtggatgctggggagaagcctccttccagcttgggtctggtgctgatggagcccatgtctccctcctacccaggaacagctgggcgcctggaatgggagtcaggagctatgtgggtgggcatatgtccttgacatcagttggacatccctagacattgttctcagagcctcgccggttactcttccatttaagagagataaagagacccgattttgaagttctttgccttggctacctgagaggccaggcaggaacattggttctgattctcctgagctgggtccagatacagcctggtcacatctagatttcctttgtgactactggttctgaatccctcctgtgcaccctaccaggacatgccggtgtgcagtgggacatgccagtgtgcaatgggacatgccggtgtgcaatgggacatgccggtgtgcaatgggcagttgtcataaatggttcttttggttggatttaggcttaactctaatttgcctgttgttgctattaaattcatcttctgttacagggaagagagggtttcctctctggtttataacatctttcagattaatcctcagatttcctatgttgcctgagggtcacagtgttatgtgagaagtgtgcttacgtagattcaagtggtatggctgaccatgtacttggactcagtcatagcccaatgtgtctgctccaggactgtgcagggttcacttggactgaatcgagcaggcaggcagagagtggtgggtaagttcccatgcatctcagagtatctgcgtatgcatctaagggagggaggaatactaggtggtataagtgtgagctccattagtaccttgtgggactgcttttgtgcatgtgagctgttattacagcattggcttgaagactaggactgcacctgcccgggcttgaggtctcttttctcttttgaatacttaatttggattgggttttggggacagggtagtttaactgactctatgtggagacagtcatcttcctcctgtagagagcatctgtgggctgaggatgtcggccaggactcatcagggtggccctgcaatgcgacaaccgctgtcgtccgtcctcagattcttctctgtcctggttatgccagccttctggctgtggcgtgtctgcagtagtttccaaaagtcagtgtcagtgagcgaggaggagctggagaacctgagaagatgctgctgctgctgctgtgggacggaagggagggaggacacgtgcagagctgggcccatgggcaggccttccagctccactactgagacccatggtgcgcagttggtggattttaagacaggagtgtctttagctcggagagactgcctggtgcagaaagaaaagtaggtgttgtatagaagtgaagttctctttctttgttagcaggacgatagaccaccgtagtaacatagcaaggacatatcaagggcacgttatcttgttggggcctggctggccactcatgttcccgctgcagaccatgttagaggcatgtcaggaagaaatgcaggatcctgtccttcatactgaaaggttgaggacgtcgggtaaagggcgggggtccttcggcatgtcctgggtcctgtcttctcccctgggagagatgatgtccctttggcctctgcagagcttcagcctctgcttgagacaaagccctgtacacgtctgctgagagcaggagttctgcagccgtgaacgttcttgcctggacctggaccctgcagcaccttgtttgccccgatggccatcagcacgggtcctccttcgggtagcgatcaagtctcccaaggttagccctctcctccacctccggtgctgtcagcttcagcctacaaagatttggagaccccaaagggcttcttgctgggttcctccctctcccaccagagtgtgagcaacccagagcctctgtgcacgccagtgggacaggggtactcgtcctccactgattacgagcctggccggccccagatttacttgtagctcatgcccaaggtacatcaagacacatccagctaaattctgtacccttgtgtcaagaccccaaacgtacatcaacacaagagcatggacgcggcagaagcccacagcagtgacttgagcttaccagtgatacaggagaaccctgagaacagcattgctggcactttagtgaccagccaccctctactctcgggaacttgaggtgggaacaaagtggtacaccaatgggaagcaccagcatatgatacctcattccttccttgtcctggagaccggacaccggctcatcctaccacggagctatgacacaggatcacacactgaacttcttgacagtgcccaggcatcggtggtattccatgctgccacaatgaatcttctgcagtacatgtaagacaaggcctaaagtatcatgtgcaatttaaaaaaaaaaaaaaaaaaagtgaggccatgggatgcccattgggaaaagtttctcgatgacaaacctggtggcctgaatctggcccctggccttgaaacttgttctgtggctgtggccatttcattcctgatcctcctgctcttgcgtctccgtgctgtggttctaggtgtgtgctgccacgcctggcacatctgttttgttttgtggttggttggttggttggttggtttggttggttttggttttctgagacaggatttctctgtgtagccctggctgtcctggaactcactctgtagcccaggctggcctcagatttagagatgtgcctgcctttgcctgccacagtgctgggattaaaggtgtgtgccaggcatcttaccttggtgggtgttcagttgtgggtgtcaagcatgttggagtccctgttaaatagtgacctctccttcctttagccctaacccgcttcttattgaaagtctgcttctgtcagcctagactctaggaacttaagtacagcaagttaggatttgccctctggtttgttcactaaatgcagtgtcttcagggtttattcataggtatcaaccaatcttcctacctaccctccttccttcctatctacctacctgcctgcctgcctttctctcctttctctgagcgtgttttgagtgtgtaaggtggtttgatctgcatctctgtggtagctggtgatgttcagcaccctgtcatgtgtccattcagtccctttgtccacgagactgaggtaacttcttgttgttttattgaatattactttgtgtatgtgcgtgtgtgagtgccacacatgtgggtgcccatggagactagaagaggctcttggcttggatgccccggagttagtttccgacagttggttgtgggccacctgatgtgggtccttcctccacaagagcagcagtaggtgctcttcatcactaggcaacccccacttgtctgttttgttcactttcagttttcacctattttgtattacttgctattgttttgcctactggcatggaccctggtttgtctagtggccagcagggtgcccccagttgtcctttgtgtatcagcagacaggaccatctctgaatgttattcttctgtgttaaggagatccccagtgcctgtgagggtgtgtgagtacagggtctgtgcctggatgttggcagggatgacagaaaggattcctgttgtatgtggagctggtagcagcctattgtgtgacaggttgggagcatggccttgaataatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgaggaaaaagactttctgaagcacacttatccccacacaccgttcattccttcttggtagggaccaccctggctcaacctctgttttctaggaaatgaaagaagttcagggcctccccactggactgggatgtgtcctctcatcttcccatccatctgtccagtttggctttaggaaagccctggcctgagcttgcccctccctgccgagtctcctgtctccaggcaccatttcctgtgcctctgtatacttgcattatggctgcttcttgagccatgctagactggcttggtgttattagggagcctgtgggtgacggtgacggttggccctgctgggttgtgtctactgttgggcttcagtgcctcacagtgcgtcgagtctgtgtgtgctgtgaaccacagtagctcatgtacacatcccatcagagcccctttgtttctttcctggagcctggagccgcacatcagaacctgggagtatcctctagggccctcggtgtcctgactctgattcctcagccaggccagatgccgttctcagcgttggtttgtaaacgtctctcttggcccggtagcctggcagcatggctgagatgatgacctggacagttttgtcaggcttgggtataataattgttgaatgttaatgggggctgggccagggtggctcccttgccttttgttttgcccctgctagtagtgggggtggtggtccttgtggaattccaaaggcaaccctgatgcctagagctgggcctagtaagtagcctttgacctgtagctgcagggaaggtggctctttctgtttggctttaagaaaagggagggttggtagactttcaagccagcactttttctctggccctgccggtgattggcccatggtgaagtgaaagtcatttcttgctgttgtgggccgaggttctcaccttctactttcctgtgagtagtagctcagctgagttttgtgcctttggcttaagtgtcattttcttggagtttagagcgaggcagatctgtgtagtggttagaggtgtgaagtccaaaggcatgactggcttgggtcactctgtgaccttgggtcatgcatttctgaatggaggcactagaataccctgtgaacagacatcgaggcagcattcattgtttcatgcagcaccttgaagacttgtagtgcttttggccctcctttgggagagccagctgtattctgtgagcagtctcagaagccacagcggcctgcccaagtgttacagcctgagtctaagggacatgagccattgtcagtgacgattctgaggcactaggagacaggtcacccggcctccctgaaagctaccaggccacaatccctgccgtctgtccgtttgtgcctgctccgactacgtttggtattgccagggccctcccaagggttagccttttattaggctcatctgattgggatcttggtgtgatcttggctgatttgggaaacacagattgaagatactgtgaacgctgaggcctaggtgaccatagttggagctgtctgctaggtctggtaaaggaagtcacttctccggtgagttcacatggtacctatcagatttagagcatagactgtccaggcgtttccagattgactgttgaggcagtaggatggagatgacctcacaaagaacgataacttgcttgatcttggagaattttctgaaaaagcttttttttttccttcttttcaaaaagcaagcaaggcagtgtggacagcacttgagagatgtctgtttctctctgctgcactgggctgagagctgagagagaggatccagcaggaagaagagcccaggtcaagttctcaagtggactccagagtcccagcctcctgccctggctgtgcaggttacagtacagtgtgcactcatctggtgctgggcaggaatttagtttgttagagttgagaagtgttgggatttttgcagttggattttattcggttttggatctgatgcttctgcctgattcagagaagccactgagtatggctttgtgagtgtggctcatgtacgaagggtcgtgtgagggttcctcccagccctgatgttcctgcatcctgtgttctatgcctgctgcctctgaggcctgaagggggaggggatgggactgacctgtcagtaagcttgcctgtcgcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgttgtggtgacccccccccccaaccataaaattatttttgtttctatttcataactgtaattttgctactgttattaatcgtaatgtaagtacttttggaaataaaggtttgctaaagcgtcacagctcacaggttgagagctactgtcctaacaggatcattttctagttgccttgaaagacagagcttcactgtgtaggccaggctggccttgaactcatagaaatctacctgtctttgcctcctgagcagtgagatcaaaggtgtgtgctaccattctttgctttttttttttttaagttttttaagtttttgagtcactgtgatgaggaacagtgatgtcctccctccaaggcaaaggcacatggccgagcagccttactgtggcaaccacttttcccctgagccttgctaagccaggtatttagggacttgatagcacttgaggtgttatgggtatttgtactcgactttgggagcctttcccatctgtggttactaagtaaccaaggagaagactttcagcccttggtctcctgtcctcgtgaactttgctccagtgggtgtggggcccctggaatcttgcctggcctggttacacagcctgtgaggcatggttctgcggcgttggtcaccctgtctttttgttgctatattgtggccatcttgctgtctgtgtcgtctctgatcacccattgttttattgatgatttcaagagaactaactagcacacacacagcccccaatgccccataccctgtcctgacccatgctgtgtgtttgctttcttctcactgggtgactgcctgattccactgttttagactcaagcccactgagttcccagtggagcccatgctgttgccgctggcgctgccgtccatggtggccattgctttactggtgaagccagattcccaagtcttctcactaagtttgggttgtaccaaatggctgcctccttgcaaaatcttctgccaaatatcttgtctgcatgagttggttgtcttcctagtctttcttgtcggtaagaatcctgggcttcctctctctctcccctgtacttcctgtcccttggaaggaagggataggaagttggtatggccaagctgtgacatgctcctgatactgtctccaaagctgtccatcccaccaggccgagccacgctgtaccctgactcgtaaacaggacccctcctcttctcgagtacgctttctgcgcattacacagcgtgccctgggggcttcaggaaggtgtatgtggatggctggtgagcggaggtgagaagggtgtgtaggtgctgggaatttcaaaactcctccttttctcagatcgtattttttaatttatgtgtgattttgattgtgtctctgtatatatatgcattagtgctgtgtgaccaaggagatcagaggaggtgtcaggtcccctggagctggagttacaggtgtttgtaagccgtctgatgtgggtgttgagagttgaaatctggtcctgtgccagagcagcaaacactcctaactactgagccatctctccagcccaggatgaccatagacaaccacccacagttctttctatcaactttactattcacgacaattctacctagtttttaaaataaaatttatcttacttggaaccgttgtgacggctcatcaggtaatgaatggtgaaggtgcttgctaccaagctgacaacctagttcaattcctggaccccacatggagcagaaagagatgattcctgcagggtgtcacctgactgccacagcatgtgtgctctgcttctcgacattgtcacagtagcaacaaaattaaatttctttatcttgccttaaaagtttgaaagtgttctaagattcggttcattcttagttctttcaggaaagctgagaaagttctaaggggttttctgcttcctaagtcagcagcatgattgagggtccactggtctctgtaggacttgagcagaaaacttgggggccctgagtcgcgttggccaccacccgcagaagccctgaccagtcatttttttgcctgttgagggtgttcatcattttgagctgctgtcccctgcacaatccaacacaagacaaaatgagacaacccagtgataagtgctctctataaagaggagagagtacagtccggggcccggctggtgctcagtccctctgtcttagagcatttggtgactcgagctctcagaagagatgagaattagaagggagaagagaggctgaagttgtgagttgtttatgatgtgatttggttaaatttgctttagctgccgttgaggaccacactgaccacagtgtcccagacctcagtccccaacgcccagatgcaggctgcgactgctggctccaacactgactgccacactgaagaaagtgggcattactggagtctaactcagtctgtcctgagaccaggctggcctggaactcccagacacctgcctgcttctgcctctgagcaacagaattaaaggcaagcaccattgtgtaagatctgagccctcttttaaaaggaagtttgcttaaagtaactctgcattttattactttttaaaaacttatttattctatgtatatgagtagactgttgtacactgtagctgtctttagacacaccagaagagagcattggatcccattacagatggttgtgagccaccacgtggttgctgggaattgaacttaggacctctggaagagcagtcagtgctctaaacagctgagctatctctccagccctatttaaaagaaaaaaaatcatagttttctgaggggggtgccagggagggagagggagaaggaaaagaaagttactagatggggcatgataatagcacacacctgcagtccctaggtcccttgggaaggagttggaggttagcatgttctgcatggtaagctacaggccagccaggtacacaaggagatttctgtctcagaaaaagtgttattgtgtgtctgtgcgggctgtttatgtctaagtgatagcttgtgcgtgttacagtgtgtggaggtcaggatggttcagggagttggttcttccaccaggtgggtcccagggaccaaactcagtttgctgggatacagacagatgcctttgcctgctgagccatctttccaacgccctgtggttcttgttgcttttgtttggtcttaattctttttagttgtttgtgacagggtgtctctctgtagctcaggctgaccttggactcacagtggtcttcccacttcagcctttggagagctggaattacaggcctgaactatcacgcttggctcaattttaagttttgtttccaaaagtttattgaggccaggcaggtatggcgagtggcacatgcgtttgatcccagcacttcggagtcagaggcaggtggatctgtataaattcaaggccagcctgatccacagagtgagttctaggacagctagggggctacacagagaaacctatgtctagaaaaattgaataaactaagtttattatggagacagtggcctgagcaatagctagagtactgccgtgtagcctcaatttaacttttcatatgtttcttgttattcctcagacagaagcctagaggggtcttctgtgagggaagaggagggtgcaccacatagcagccctctcttgagtttctggactctcccaaactttccctgcacaagcagccataactctctaagaggctgctggcctatcagggtgtttgctgttactcccagggatccggtcccaacatgtgtgtgctcaataattagccacaagctctgtagatttgatggttagaaatgctgtgaagcagaggaagaggtagaccttggggagaggtgggccggtgagaactgcagctgtggtccagctctgtgtctttgtctggcagggttaccgtctctagagcccagtgaggatgaggtaccctgtgttgacctgcccctgatgagacctttgtttgtgctttcttgtgcaccacacaaaagagggcatgagactcctttgttgatggatggcagtgcagaggtcttatttgtgactgtgcaaatcctgtaccagagcaccaccacaaagcagagacggctcatagaggacaagtcagagctgtaggcctggtaccttcttgggcctaaccctctctcatctttggtctgctttggtagaactgtcccggtatgggtagccatcttacaacgactgtggtcttgccctaatagcaggaggtgactacactggcccaggcggtaggaatgggagtggatttgggtgtgtgaacgtgtgttgtggcttagttagccgtgattattaccatgtgttaccgtgtgggctcttggcgttaagggagtcggcacggcgctgacccttgcaggttttgacacttatcttcagacattgatgctgaagagggttgaaggccgctgtgcagaggggctgcggcctggctgcgtgggatggggtcctagcccgcgattctcctgtttgttggtggtagtagataggcaggaatgtggagacctcagcccagcagtggcctccagtttgttactggagcaagcaaccctgcagtgaagccacctcattccaggactcttcaaactctaaggttcaaggtctcatccgggcgttgactaggctgcttttcctttcagttgagtctgttcaggatgagcacagcacatggccaccacttgccccgtgccccatgtgtactcagtgctgctctgcgtctatctacctctgggtctgagtgaaatggattgcagggtggtggtggtagccaagttaagtgtttcctcttccatctctgcagtgatcagccttgcctgggtcacttgggatttgctggcagaatagcaaagcccgtaggaactcctgtcgcatgtgactgtggttcctttgctgtgtgcccgtgggttctggagccaggtttcaaagcgctgtatgtaggactcagagtgtcctagacaggaagtgaagtcaggacagaatgacatcaaacgtaaatgactgacggaccttgataggaaggtcctaggaaacacctagataggatggaaaagggcaagggtagatcaacttgcctgtgaccaagtagagttaaacaaaatggggtcgtgaatgtcataacctgaccatcgacactcaggaactagggcatgtaagattccgtggctaatggtaaaataaaaatagaagacctgtacttggcacagcaaattcaaaagcaggaagtgacctaagaggcatatagtgtgtaggggctagttcattactagcaatcttagttacagggcagtcccaggcagtcaccataaagccacagctttccagtgaggcgacaaaaacagtttacaggtttatttccgcttgtggtttcagagtttttaataagcctgaaacaaagcagaaaaagcgtgacagaggaatgctgctgaccatgtggcagacagaaggaaggaccagaaatgagtaggtagtccttcaagagcccatctccagtgacccacttcctccaactaagtttctcctcctagtcagtctttaccacctgaataaaccactggtggctcagaggagtacttccccaaaaccttggtttaagggtagcactctgtccttacctcacttcctgtctgggccattcttctacttgacctcacttcctgtctggacaaatttctgccctgaagttgcatgtctgacctcatttcctctcttctttgtgtggtgtgttcctgaagtcagcggtctctactttttgcataaactaggttttcttagaagtttggttacctggttaccaccttgttgtagctgtccctgcttttgagcacagttctctctgtggtattgtagctgtatggatggccctcatcctcctgtctgctgctagttgctgttctcatgtcttttctgagtgtatctgtatctcttctgatgtggagctcctggagtctgagtgaccacagcatgctgtgtgagtgggagcctgggaggccaggcttttggtattgtatggctaggtttttttttttttcccctggctggccttgaattcacagaaatctacctgcctccgcctcatgaacactggtgatcatgcctggtgcacagctggatatttaattttgcatccagggttggttggcctgggagttgtttgcttgtctgacacgcctgccagcatttagcctccagtgtcttgtgtgaagaagatcagtgccatctgacgtgggctgtgacctgcctcttttctttgggacgctttcaagaccccttgacctgggctctggagactatgtcatgagcccaggactgggagctttgtctcaatgtacagtttgtcatttcctggctagtggccttctcttgcttcttgagctactttttgtttttgtttttattttttggaacaccttctgattgggtaatggccatcccatgtgactggctctttctttttctttacctctctcttggtattgctttctggagatttcctctgccttatatctaatattttgttttcagctttggaattatgtttcaatttctgaagggaggaatatcattttctctctctaaaagctactaccagttttgtgtcatggatgccatattgttttctgttgttgaaatttttaaagaggtttcgttttctggcttcctgcattagatctcctttgggtgcatctctctccatgttgacagttcttgacctgctggtcttctcagggttgaagtagccagggcctgcagggtacagggcctttggcaggcagcatgttggctgctttcgctatagacttcccacttcctgtcctactgggattcccggctctttccccctgaagctctgccctggcctgggtctcactcatttaggcagagcaacgcctgcttctttttcagagcacaggggttgtagtgattaacttttcttgtttttgtttttgtgttccagagtgattttgaattctgctctcctaccttggtcctctcagttgtagctttatagtggtgcaccaccaatccaggttacttgtggtgattgcagagacaggagagttggaacgtacttcctcttctgttttgaagctattttcctttctttttaaaattatgtatgtggaccactggtggtagcacacacctttagttgcagcactcaggaggcagaggcagaggcgcagaggcgcgcagagagaggcgcagagagagaaggcgcagagaagcagaggcggtggacctctgtgttcagtaaaggtcagactgtctacagagccagttctaggaaagccagggctacgcagaaaaacctgtctcaaaaaactaaacaaaacaaaaatttatttacttacttagttgtgtgtatgtgtgtgtgtgtgtgtatctatgcacatgtgcacacatgcatgcttgtgtgtacttattccagggcacatagagggcaatatgcgggcattggtccgctccaccatacatgcaggtcactcctatcatcagacttagtggtgagcacctgtacctgagccacctcgccagcctgtgaagctcactgtttgtggtgttgctgtgtcttcttagatcatagtcagctgaactggcaagtttttaagtaggtatcagtgttaaacattttaatttattttgtgcctagatgagcgtaccatagcacacacgtggaggacttgtaggccttgactctctgcttccaccatgtcaatcccagggatcaagctcaggttgtcaggcatggtggcaggtacccatacccgccgaaccatctcactggccaagggttaagtattggaggaggagatggtactgtaaaatggaaaacacattaatactgtttatttgtgacttgaagcagaagtgttcagatgatccggacttgggttttcaggatgttactacttctgtgtgtgtgtgccggcctctgtgtaccctgacccctgcctgtagcgggcacagttttgatggtgttttgaggggtgactgcagtggccccgcccgagaactcctgatgtgcaggccccagcatctaaaccatagatgttgtttatgcttcaggattaagaaaaatagcaacagccaggcattcaggcttcagaagggtcaaacactcaccacaggctaggatccagcgcaggcagagggcttctccagtgtgcacagatcccatccccagcacagtccgtgataagagccaggagcgtgggtcacagggaatcttgggtcccttttcatttttccctgtttttggtgctctccactccttgagtgttcttggttggcttcacccctcgacgatctccctgtgcttgatggaacccccagtcttgtacgcagcaggcacgtgcttacctctgaatgcttggatgcagaactgagtaccggtggccctgtgaagcctctagcgggcagctggttctggggttgtcccttctgagtctggatcagtttattctgatggtccagagcctcaagtgtgagctttggcatcacaaggtaacttcttaggtgagatgtttcagatttttgttgttgttcttattggaggtggggcctgggaaatgtgtatttctggcaagttcccaggaaatgtggtgatggtgactgctgctgcgggccgcagtagtccttcctgcttaggtaaacagatttcagaggcccaggctctgcctgctcccgcctgtgctgtctgtagctgtttttgtgatgccacagccgactcggagctgtgagtcagagctgtgtccccagagttacacactgatgtgcccttcacagtgtcacagaatgatttgactgcagcgctgtgctgccttgttgtcctgaaatgttttggggtggaaaaggatatatttagaattactgttcatagaagaaatgatggccttctgttgctatggtcttgacctgtggagagtgcttaaagctgcagaacaaataaaaatctgtccatgaagggtccagcttgagggatggctgcataattatttcaaatggcttttttttttgaagtgtaattaccatgtaaaaatctgcacttcattcatttattaattcatggtgtcttttatactcaggctgttcttgaattctgaacatagaccatgacctagaactcctgattgtattgctggcattacaggcccatctcagtgtacctggttaatatgaagttggggcccaactcagggtctcatgcatgccaggcaaacactacaccaactgagctacatctccagctcctgtaacatgtatccactgtgcctcacacagtggaaatgtgtatccactgtgtccactgtgcctcacacagtggaaatgtgtatccactgtgtcacacactgaaatgaatgaagcagtgaatggcatgggccagccatctggtacctggactcctcctgcccccacgactcctgaattcacgaagaccttgtgcctttaccattgcaggagtttgcctccccccagctctgtgcacaatgcatccatatagtaatgaagctttggtgtgcttgttttagtgtaacaattctattttttgagacattttgaaatactgtgggatatatcagtggttccttgttactgctaggtagtggtagtattctatttgtggatatgtgtgtccatttttaattcattcagttgtttatacagttagattccacttacttcttgttcattttctctctttttttagaggacaaggtcttgcatatgcagcccaggctagctttgtatttgcagttctctccctctgtgctgagactgcaggtatggaccactacacccagctggtttgacaggcagctcttcccctcgcagtagatacgcagctgtggggtggccgtgcccccacagcccagcctctgcagctccactgttgcagtcactctgagttcatactgtacccgatgatccatttccttggtaactagtgacgctggtgttactttgaatgtctgactgttcttactgcagcacctttgatgaggtgtttgttaccttggtcgttgccttgacctgggctccgttctctgctgatttccctggtggactcctagccacacgtacattgtgctccacaaacaccctccctgccatgatacactttcttccccccccactcgccctgattttcatttgaccttgtggctagcttcccagctgggcatcttttctgtttccggttgcaggcaccgtccgtcttctgtgtttctttaggatgtttaaagcagagtgtgagcctccagctccctgcgtaggcccgcagctacgctgagcttatttgtgtgtgcgcagaaaacgtggcccaggttcttgattttgcatctggatgtggccactgttgtgaggacactccgtcacctgatggggtctgtggctctggacatggttggtgtgtggtgtgtgttcccactgtccgctgcatgcgtttatcagtactacccgggccttccgaagcttgtcagcacccaaagtcaggggcctttagctccctaaccccttttcatacttatttgttcttgggactctgcatcttagtttgatttgccagaaatacacatttcccaggccccacctccaataagaacaacaaaaatctgaaacatatcacctaagaagttaccttgtaatgccaaagctttgaggctctggaccatcagaataaactgatccagactcagaagggacaaccccagaaccagctgcccgctagaggcttcacagggccaccggtactcagttctgcatccaagcattcagcaagccacagtatatgtatggaagtcagaggacagcttgggagttggttttctccttttaccccatagtgaactcaggtcattgaacatcagggtaaccctcccagccatcctgctggctcagggctttaaagtaattttcgtgaaggttatggttagctggtctgtagcaggattgtccccctacccctgaaatatctttggttttgatttattggtgagaagtgtcctttcttcataaatgtcaagaagtaatttttgtttcttctgagtatttggtgaaagtgagcaggaagctgtgtcagcctggtgtgcgttaggctggtttacagcttccgcagcctgtaggttgtctgctctcacgagagcgttaagtatagtagatgggactttgccacacctggacctgacacacacgtgcacacgcacgcgttgttttttgagatagtctctctgacctggagctcacagagtagactaggccacctgtccaggagtcagtcctaggtctgcacctgtccgcacctcacccaactggttctgggtcttcatgtttgtgtggtgagcactgttgtctagagggctgtgctctcagcctgattcccttctgactactatggagtggatacagccttccactcttgcgcctgtcttgccagcctgtcctaaattctattgccatcaaggttctcaaagatctttgctttcgttgactgtctttaacttttcctgcttctttggttcacatttttaactttgttatcatttctttgactgcctttgggttgaatttttgacccttttttattttttaagttgaactctgagttgtgttgttttcccaatgcagcatttggagcgctgtctcctcagtcttgttttggggcactacacaagagctcttctggttgcctctttcatgtgtgggctacttaagagcgtgtggtttagtttccagatatttgagatttccagtgatacctgttgctaattgctaactggattccctgtggtcagataacatattttgtctgatccagacccctttgaatgtgttccaggccttcgtcttgtgcctttagcgtgtggactgtgtggacaggagaacctgcagagtcgtctgccttggtctttttgcttatctgttttccagagacagctctcctcctctggccccgtgtacctaccacctccttcagccctctctgagccggcagaggagcaccgagtatgactcgctccaccgtgacttctctccaggctgtgtgtttgggatttataagataggttaagtctggaaagttttttggatcctttttttaaaaaacataaaacacaaaaaaaactaaaaaaaaaaacaaacaaacaaaccaaaaaacagattttattttctgtgtactagcacttggctgtccttttagtggctcagttacttgtgctttgggctgtatgggagcaatccttgtcttcttggagcctcctctgttggttgagtgttctgctgctatatgtacagaatctcaggtctccttttctgccattctctactgctaatttcatctccagaagtttgattttttggggatttactcgtagtcactcactggcatttaaacagacgggattcagctggaagcacgtttcagtactgtctgcctatcagtcactctgctgactttggtctttttcagacaatggaccattttcctcattaaatattagaatctcctgcttcttagatgctagtattttgaaatttacctatttgcatgaagaatatctctttcttctatacatcattttgggatgcagttccttgaaggtattggggtctttctggtttgggtttcaaaaattttattttaggtggatctgagtgtgggtttagtagtgctcctcccattaccacggagaccctccagaggaacaagaccttgtgaacttgagcagtttcctgttttctgggtagggatggacaacttttggacactgtaagccctgggcctattgaccattcctgacctccatgatgcctttacacacttagctgggttttgttgaattcaagaggacactgcaggcctgggaccccggtggctcagtgtcccatggtgccgcagatctctgggaccttcagctccagcgtgcctggtgtcctctgagccttgccagttgaatttcgtgttctagtttgtccgtccccgctgctgcccggtcgtcctgcagaccgttgaggtgagagggtgacaggccttagccctgtgctagccgccgccgccgccattcatcccagtgttgccacatccacctgtgcctttcggctctctaatcagcattctgacatcatgttgcttgacatcacgcctggtttggacatctgcagccaccaggcctctctctctgggctcatccttacaatgttttgagaaagttgccctgttactcaaggactgaagactacaaaacccagaaataaccttagagtttggagagagaggcccttggggacgttgacttgatgtggcaaaggtaggcaggccgtgctctgcggcagcaggttttggggggtgggggagcctggattgtgctgactggcacatccattctgcgtggatgttttccttttgcaataattttggctgcatcaaattcgttttgttaacatcttcattactgccttttcagtcttagtggggatgattatgaacaaagtgccgtgattttgactattcagcctaacaactgcattgagacagcactctgctgttttttaaacaagcatggggtccagtaacatctgcaaaaccgggcgatgccagcggtggggctggtgatcaggaaggggggtcaccgagggccattcgacattcagctcgagcagagatgaaatagatttcttttcccaatctgtttgcagaaaattccaggcagccccagtccctttcagggtgaagcaggggtaggtacatctgtgctgtatcggctgaggtggggtggtaggaaggcccgccccgcccgtggtgtgtcgctggggatggacctcagtattcacatgctacattcattgtagaggctttttcagagtgagaggagggtaggtggctttaggatttgtcaaggcctgagggtcgtgatgaacacaggtgagttgtgaggcgtttggaggcagcaagagctttaggagcggcagccctagtgccagggtggtcatgttctaatgaggtgctgattactcggttctacttttaaactgcctttggggcccagggctcgtggttgactgtcagggaacactagagcattcagaagtgaagggttgatttgtggtcttcctgcttccagaatgttctagaacactgtgtacagtgttaatgagcttgttctccaagcacacacacacatcctaagtagcctgcaagaccttccagaggcacagtttggtgccattgcctagttgagtctggggccttctgcggtggtgggggctggggctctttgaggctctaagtcaggttctgtcaccttgggctgttagggacccttgggctacttggaccccagttgaaggccatgcagctgggtcactccatgcttctgtagtctacagtgaatgcctctcactcttaggatgtgtattgcaagaagaaggtagagacgtgtagttgacataacaaaagtgatattttcctatgcaaggcggcggggggtggggtggtggtggtggtggtggtcatcacacacagttttgacagtctaaaacccctctctccatgctgctcatctgtgtctgtgtgacatactttagctaatggctgggcccagtctctcacagaaggtagttcaagggtcaggatcctagaggagcttctagctgcagggcagatcaagatagtatcttgtccagcagtctcctgcagcggtagcagcagtcctgaagatgtgcagagcagagcactgctcttggtctctgcctgtgtcctgttcagtgggtgttgtgaggttctagtctacgtaggcctggctatgcttggatgagtgatggtctaggttttgttgattatcaagtgcagtcttgcctgtagtgtggttcctgactaacctatttttacatgtctaaaaggcatttttctttttttttctctttttttttttactgtgttttctctctattttttgagggggcgggacggggtagggttgagacaggtattaggtatttttttaccctagcttttctggaattcactcactatgtagaccaggcttgccctctaaattcgccatactctgccttcagagtactaggattaaagtcgtgtaccaccaggccccgctactctctcttaggatctctttcctggagctcatctgaacttgctctctgactctgcctaactcttatcttgatctgtgccatccttggagtcttcaggatggtctgtctagccaggtgtggcccacagaacacaccctggtgtagagtaaggtgctgagtatgtggctgcccactccttggtgaacaagaggtgtgcactcttctgaataggtgaccagaagacaaataacccccaaggagactttgcagcctaagttcaggcttctgtaggctcaagggatgcacgggagatgcagccctggtgtccaggggtttctgtgcctcactttccaaacaacacagcttactacagggcagacaaggttgctttttagtttggggcttgtggtaggtcttgtctggtttgtagattgtactcctttctccagcagtatggtgagttttacgtaatttttcagcttcccttgggctcctgagggctgcagggtaatgaatgggcctggaatggacgagggagagaccacaacagaggagaggatgaggactggctgtgtggccctactgtgttctgatttctttcttcaattagatacagaagggaaaggtttgatttttttagctggttagacaagataagccaaaaggagagtctgtttgggagaatagcaagtttttcagcagtgaatggctgaatggtttatagggggtccagcaggcccctgacaccagccagggttcaagccagctaactcttctgaagcaattgcctgtattatcccttgaagtagagttgactcatgagctggggttggggtgttgttgttaaagtcttaggggcatgtgtttcttgcatcatgatcaggtttgttggccactgagagaggcatggaagaagggaggcgttgccgaagagctgtaacatggtagcgctatgttactgtcagtcctgtcagtccgaaagagaaacagaaggtggggggtgggagggcattttgcagactgcagtacacgctcactgagtctctccagcaggctcagagagagagaaagagagggagaggttcctgcagacttctgggaagcaaggcaggcaggcaaggagggcgggctgcttggcgatgaggtgagtctctgaaggacccacaaatggtggtatgtgctcaacccaacagaccctgcacaacctcactacagcccaaggaggcctaaggtctggatcacttgagtccagaggagggcatgggtatgaattcatgtgtcccacgcactcccaagtactggctaaagcttgacccaccctggcctccaggaaacaggagggaaaatggaggactagctggccagattctctgcaagactgggccaccttcatcccctctggggactggacagcctgaacttttcaccttgggcacagacactggaagaaaggccacagaggtgtctgcctgggaggcacaggggtggagggccctcctgacccgtctgcaatttgttccctaccatcccccctccaaaaaatgtggattgccccctttacaattgccagatggcagcccccaggggccacaggcctccctccctcccccatgtggccgcctgacctcccataaacagaacaaagcctgtggccacacctcccaccctccagggaccagcagaggacgctcaggttactagggctgcatctgagacaacaccatcccagggctattccagccccacggtgtaaccagcatctcccagaacccccatgggagacccaaagagggtgggagagccctgggcagactcacagatggtggtgactccaaatcttaacgcggacagcctgccttttgggcatgtgctctcaagtcaatgtagagaaacctctagccgtgaggagacaacaagaccgcactgtctggccagagcacataaccttaactgcaggattacccccacgaggatatgcagggacacagacaagtcagcagaggagtaggcatgtggatccacacagctcttggtcggtgcctgtgggagctgagtcaccctgagccaggggtctcccctggggtctgtctccagaggttctgccttttattcttctttaaactacacttactacttagggagtgttggttttggtggggatcttattattatatgtgcatgttatgtgtgtgagggtgcctggagaccagaggaaggtgctggatagttacccagtaagggtactgagaactgaattctggaagaacaggaggctctcttaaaagcccaaccatttctttatctccagaggttatttcattgtcatctctttttctcctcctcctccatctcttctcctcctcctcctcctattttttttttttaaagacaaacatttgctaagtagccttgggtgacttggaattcactatgtagactaggttagcctttaactcagattcctaaaggctgggattaaaggcttacactatactgcctggcctaggctcaaactcctgatcttcagctgccaggcactggtctagtgcctagcttgcttttaggttgatctactctgtccctacagaaacctttgtcctttggaaccccatcccttgtgcctgggggctttggggataccaactgctcccttccctgctacccaggccagttactgagggacatggaggtttctggaaacatctgtcctgatggctctagaggctggcaccctggggagaactggcagtgtttccagagagtggtttttaagacacacctggtccacaaaacaacaagcagcgtccccgggactaggagggcagcgtttgtttgctttggtccttctctggggagaggactggcctccttgcactaccctttgccccctctgggcaggtgcagaggcagccaaactctgggaagaggttgaggcccagtgtgccgctggccactgttttctgcaggccttcaccctgtagagagtcgggttcaaaaggtcactgccctgagttttattgtgcatcttcagttctcacgaccctttgccctttgcacagaccacggggaatggacctctgacagggtcgagccttctgagggttacaaatccactgaatggtctaaatctccagccaccaaggttaagtgtttcagaagcccagaaatgatgttaaaaatcaagcaaatgggccagtaaaactgcagtgggcaaaggtgcgtctggctgagcctgatgcctgcaggtactcaccaccattctgggaagactgactttcatgtgagtgtgagtgtgtgtatgcctgagaataaaaactggagcaaactactggatactgactacagaggtggggtgctggacttctgcctcagagtgcagaaccctcggtctcagcaggactgcctttgtgcatcctatccagtggcctgggctcttgttggagcagctgtgtctccatctcctggacctgttgtaacttctgtaacgtagagtgacttgtcccaagctccttaagtgtggcctcacaaatattgcccctaagggaaatgcatgttttatcatgacgagagccttttcctgtagttattgtgccatcttggaggtattctgtctgggtcttctttgtgcactcctgccctgaggcgccttggggactgttaaatgttgagggtactttttcccagtctgagatcagggaaacagccttagtggtagtaaaagtaatcaaatagccaggagacacctgaaagcacagacatttgttaggctgccaccaattcagagtgcaaatgtcgtagtcactcttcctgaggtgacccctgaaaccatttggccttttgtcctggtgacagatgatgaggggttcttcagctggccccaggggtgcactggagtgtctgacttcagctctgcccattttagcagcaggaacttgctggggcctctaggccctgcccacactcctcaggtcagtggattgctcagagagatgggtggtgagaggggaagggaagagtgtaaggggggaagaggaagggaaggagacagggggagagagggggaaggagaaggggggagagttttttagaggagagagagagagaataatttctgtgatcgctgtcctgctagctctagttctttagtgggtgggacctcataggaagtggatcacttccccaaggccttcctcagtgctcagtctggggaaggcttgctcaggcagagaaggcagtgaaaggccgaagtggctattagctcattctttcgcctgcctggaaatggaaagtgccagccctgcccctttggtgggtataagttatggtagcctctaataaatggccatgccctgaacccagggcaggagatgaactgggtccctaagctgagtcatggacggtagcattattttaagaaccagcaagtcctctgcgatcaggtgatcctagagataggatcttgacccctgacctttccttggctttctgaaggcacctatactgggcctgcaagggggtgggaagggggttgtggatttttagtaacttttctgtaaagaacctgaggttgccaggtgtggtgcttgcacgcctttaatccgagcactggggaggcagaaacagatgggtctcttttagtttgaggccagcctagtctacaaagtgagttccaggatagccaggactacacagagaaaccctatcttggggagggggaaaaaaaggcctgaggtatttcacattatggaaagtctcggggtcctggtgttgcagtctgagccctatggagggaagggctaacattttgtagtgtggtagctttgggacatgacccctggcacagtgctcccgctcagcagtcatggccacagtgagcacctgcacattagtgggtccagttagctccctgctctgacccagtctggaagtcggtaaaacatatgcagtgggtgggggtatccagcctacataggcagggtgacttctatcccttcaaataccagaggctgataggttaacccacggccatccacctataagtacacactaccagggagctgttcggctgaaaaagaaaaaagtttctattcttcttttcccctctctcattctgctgccctgttttgttttgtttgtttgtttgtttgtcccccttatcccacccccagcgttcaacccagtagcccaggctgacctagaactcagtaactgaggatggccttgagttcctgaccctcttctcactgcgccgctgtgcccaccgatgtttgcggagtctagcagttttgtgaggaggcctgattgttctttgagttctgtttcaccattgcccattttcctctttgcacattcttattgagtaaataaaaacacataaaagtctttgtgaatttttaaccttttcaggccctggagatactgttgactccaaatcatgtgactctgacaacccccacggggtcctgtaagaggaactgggggagggatggccacaggtccactgacggcatcatggccgcttttccctttcatgcggagcctttcctgctcttcagttctgctggatcttgacccagggctgggagcccattcttagttgtgaaaaggacaatattaaagccccccgggaaatgaggcgatggctccggttagggaagctgctgcagtgggcaccatgataggtcacgcctgtgtcccaccacggactctgcatttctcttgtgttcatggtgtgtaccacggtcttgctgccagaccctgtactacaactgagcggtcttctgacttcactcacttccttgccagggttagggagacccagttgcttgtaggcttgggagctgaggactgtctctgcacgctcggaatttactcaagtgacagtgtccctcagcattctgaggtccggtttctcagatcacagccaagcctgtagatgatggccagtcctcctggaggctctcgggttcattcctgccacagttgaccatcttggtggtgactagttgtggatcttcctgtagcacaggggttctcaacctggggattgtgacctctctggggactgaatgaccctttcaaggagttgccactgggaacatacagattttacattgtgtgtgtgtgtagccaaattatagttataaagtaacaacaaaaaatctatggttgaggggtcaccacaacataaggaactgtattgagggattgccgtgttaggaaaagtgagaactactttcctaacatggtgtagaaatgagattccaggttgggctctcaagacatgatgggtcattgtgccagctggtctcattcatgtctgtcaaacttgaaggggactcaggattgccgagccccaggagaacagagccccagagaagagatgggtgatactggggtgagaagctgtgaggatccttttagacatggggcggtcagctctctacctgagtgatcaggctcaccactacgtgtgactggtgtttgataatgtctgtccggttcctgacagaggagatgcgttcatcgtgcgatgagcataggatcctagttgtctgagatcctggctttcctctgacttctgtagtaatctcccttagtacctctgcagtctgcacatcgtcctgcttgcgtcatggcttgtggtccctgcctcctttctctacactcggcccgctgccttgtgagaagggcctcgagtgatcattcctgacttggaagtgatggcatgtcctggcttctggtctgttctgaaaggagctttgagccccctgaagattcagagcagtgtcctgggacagacagcctgctttttatctcggtgccccagcaaggttgtgtagtctgcttccttgagtttgatgcagtcctgcgcaacgataacagggtcaagctgtctccctttacctgggggggtatctcagctaagccttttgccctagtgcccagtctggtgtagaagagaaaacgtgatttggtttgtccactggtcttgaattagccccctttgcaggcccccaagaacaccctggctgtcagccatgtcctcctccagtataggaatttgacaggtcctggagtttgcagggaagctagggctgagcctaggggaactcttcagggctcctgttgtttttcagtactgtaggcctgcgttgcttccttctgctctttcagggtatccccccccccccaagggcccccccaggagggctgggctgtgaacctgaagaacctatggagatctcgggcaaaccctttgcccgtagtctgacaggcacatgttctgtccggtttactgaggaagaaattactctgtacaaccaggccaccccagaagcaccccactcccagagttcagtagtcagagcttatttcggagatgtgaaatattagaaggaccaagtgcttaagacagcggggccaccccaggcaacctgcagcccctgttgtcctaggcccacagaaccctgtttctgagtcctggggtggatctctgtactttgaaagtttttcctggactacctcgctggagcattttcagactctgcagaaatgcttgtctgaaccttgtagtttataaggagaagactgacgtgctcatgggcatgccttacccagatgggtccatttgtcctcctgagagaggcttggtgaggtgtttgcctgccaggacacctgagtgtggctgctctctgaagctacctcctttccttttgtgatttaaaatttattctaacttacgttggagagatgcatcagtggttaggaacaatttttgctcttacaaaggacctggatttagttcccagcaccacacgtaggctcaaccctaactccagtgccaggagatccagtgctgccttccggcctcagagagcagtgtgtgtgtgtgtgtgtgtgtgtgtgtgtgtgtgtgtgtgtgtgtgtgtgtgtgtgtaaaactttcaaagtacaggtcagcagaggtcaaggacagcctgtggggagtcagttctctgtcacctaggttctggtattgaatgtaggttgttaggcttgccagcaaatgcctttaaccactaactcatccaacagtccacctttgtaagttttagcagctcgtgagttggagccatagctcagtggtaaagtgcttacctgtcacgcttgagggcttggattgaggataacgtgcctcttaatcaaaacagaacttttgttcatgtccctgctttcccctgaagacgtgaggtgtacattatgtcttaatggcccaggcagtccccggatggcttccttgtggttcttgagtcccagtagcccttgctgtatttgttgtgagtctcccagccataagatgtcttctgtgacgactgggtgtgttgataggagtcctgtcccagggttgtgtgtttttcgagaaggactaccaaataagtctaaatttgatctgtttgtgacttgggatctctgtcgtcactatcaggtgtcctgtgcctccaagatggtttctaggaagcggtgattggctgcacctggcgggattatgctattcaaccacttgtgtgtgtgcttgtggctttcctgggccaaatgtgtgcttgcttctcagttgggtaaagtctagaggaaggtgctttgggtagagctggcagcagtcttgtcatcaggagccccaggaagacctaaagtggccactccagcagtctctctttctaggctggaggaggtctttatagcggaggctatattgcatgactgtgttgtgagggaagtaattaggcatcactaatgtgagcaaggtgtgctgctgggtcagccgttcctcctgtccttggtaatggggtggggcttagcactgaagtaggccttggggacagaccagtagcctttatgggacataggatcaaatctgtggttccagacccaactgagggtgatgtcgtctaaggacagaaaagcatcctgcatccttctgccattctttttttttttttttggggggggggcgttcgagacagggtttctctgtataaccctggctatcctggaactcactttgtagaccaggctggccttgaactcagaaatccgcctgcctccgcctcccgagtgctgggattaaaggcatgcgccaccatgcccggcacccatctgccattcttgagcagctcacagactcttctcttggtaatgggctcatctgaggtggtggaggtctgggtgtctcggccccacctcccttgcagtagagcatgttccgtccccctgagtacattggaaggcacgtgacctaaggggagggatcttaggtaaaggcctcagataaacttgagttgtcctgctttgtccagaaggccagtctgttgcctgccattttggaaaagcctggtgttaggacccctgagaactctgagccttcattcagatcagtgcactttaccgcaggtcccataggacagcctcctattctgctggcatctgccctttaacctgtgtatccagggtgaccacatgtagattgctgcctttagtctgcactggctttggagtgagaacttaaaacctcttactgtttgtattagtcagggttctctagagtcacagaacttatggatagtttctagatagtaaaggaatttattgatgacttacagtcggcagcccaattcccaacaattgttcagtcgcagctgtgaatggaagtccaaggatctagcagttactcagtctcacacagcaagcaggcgaaggagcaagagctagagctagactcccttcttccaatgtccttatattggtaccagcagagtggggtattcctgtgacaacctgaccatgttttggggaggactgtggaaggactttggaactttgggcttgaagatccatccattgttaagagctctgtcggatgtcgtgtaggagcttggaagataatgttgagaacagtgcagaagatggaggtctggtttgtgaaatttcagagggaaaattaaagactcttttcagggccattgctgttttgattgtgaagattctgtagttctggttagctggggctgaagaatcagctgtgattaacaagataccagaactactaaagcaaaaactttgcattactgggactattgatgctggttagctggagctaagaaattagcggtgattaagaagagaccagcatcattgaggtgacatcttctgggaagtgttttctgaaagcacaaagaggctgtgttccagagatggccaaggttgtactcctgctgcagcgggacttggtaatatgtaagggtcacccaggtggtactggttttgaaggcatgaaggggtcacacagagcagctgaggctcggtactgtgagaggccatggaaggccattggtgaaggtgcagcctcagttgcagttgaaggcccaggactgaaggggtcatgcagtgttttagagatgccagtaccatgagatgaccaccaagagcagcagcagcagtggagtacaggcatctggagcctagaggatgatgcgtgtgctacaaagggcatggctggagaagtgacccaagcccttggaggagcccagaagatcgtgagttggatcccagacattggacagttggagattgacttttgcttttgattgtgactgtgccctgatattttccctcttgaaggaagaaactgttttagtggagcccacagttaagagacttttaattgtaaaaagactttggattttaaaaaagatggatattttaaagaaattgaaattttaagaatatgtaaaggctgtgggacttttaaagttatttagatcttggggatgaataagaatgtaagggttgaggcttactagtgatgtgtttgtgtgtcaagttgacaaggggtcaattgtactggctagttttgtgtcaacttgacacagctggagttatcacagagaaaggagcttcagttgaggaaatgcctccatgagatacaactgtaaggcattttctcaattagtgatcaagggggaaaggccccttgtgggtgggaccatctctgggctggtagtcttgggttttataagagagcaggctgagccagccagtaaagaacatccctccatggcctctgcgtcagctcctgctttctgacctacttgagttccagtcctgcatcctttggtgatcaacagcagtatggaaatgtaagccgaataaaccccttcctccccaaacttgctcttggtcatgatgcttgtgcaggaatagaaaccctgactaagacagtgttctacagctgggtttgtctctgaggcttacaggtgtgtgtcggccatggtcagtacacaagagacattcccaggcctttcttgggaaacagggcaggggtcaggggctaggtatcctctgaagttgctttgtaaggtgtctttaacacagcatcaagaaaagtcttgatacagtagccaaatcctcatgatgcacagttctttgtttgtttgtttcgagacagggtttctctgtgtagccctggctgtcctggaactcactttgtagaccaggctggcctcgaactcagaaatccacctgcgtctgcctcccaggtgctgggattaaaggcgtgcgccaccaggccaggctatgatgcacagttctgttggcgggagcacattcgttttgagccagaatgacccctgcctatcaaccttccagaaaatgccccccaccctcacccccactcccatgcacaccaccacgagagctggactaactctcagttcatggtgtggaagggggaagacggaacattgcctctggctttgctgaacccccgagccaccctgcagaccagcatgctgtggagtcatgtgtcttgcccatttgaacccactcctgactccagatgagggcaagctctgttagagggaagcggcttaattggagaatgggtgacttgggaaaagcagaactttatttctgttcgttttggaggcttgagcttgatgaaaaggagcctgtgcacacgccatgtgtgtaatgcagagtggtgggccaggggcacactctctgctccaccagttcgaagccctggttcttcctcccaccacagactctgtatgggcaggatgtggctggtctttggtcagatactgggcagtgagtagccagtgactagccaactcctgcaggcatcctgttttgtgcacatctttgccttgactacagtgatcactctggaaacctgttggcctccggtgtgccttagtgaagggagagaaaccagaatggaagaagcagtgggagagggctctgcctctctgctgggtagaggccaccttctctccatgatgtgtgtcccttctgtctgtctctggccatctcatcctcccttagtaaccacttccttcccagcccagctctgcaagtcccacccactcgtgtgtggctgcctggcttcccttcctgctcctgatggttctctccttgatttttgatttgcctctctttggggttgccaagaatgccggggggggggggggggagctagggggtggggtggagtggggggcacagggaaaggtctcctttcccatgactccactccagctttggggaagggacaaacagaagaaagcaggaaaggggaggcatggaggtggctagggcacttcttgggcaggtgtttttctctctctatctcatactgggcacaagacagcttagcttccagtttctctgctcagatgtgctttaaggcagtccaggggtccctatgcttagacatctccagcttcaggactggagtttggatattcatgggtttagatattctactcagtgtgctcgggtcctgaccatgaagaagttgagtaggagaagaaatgtctcggtggttaagagcgctggctgctcttccagtggaacctgggttggtatcccaacacccgtgtggtggctgacgcagtttataactccaatctaaggacatctgactctgccacaggcactgcatgcccgcagttcacagacacatgcaggcaaaacacccgtgcatattttaaaaaagaagttgaacagctgccacaacagttctgagctgcttgcagtcctgagggccattgccctgtattgtgtctgtttctatggagaaaaaaacaacgtgggcgtcagttgggggaagggggggaggaggcggaggaagcaaagcagactgctgggtgtgggtggtactagctgttcctcctcttcctggtgaggcaggaaaggggcttcagaactgctgtccacaaggcctgttactcaggtccaggctaaatgccatgtggggaggtgctgtgcccgtggcacttcctgtgtcaccttccactgaaataggggcttggatctgcctgctctctattcccatcccccattttgggaatgcaactccttcaaaagaaggctctggcagctttgggttctataaatgcaggtccagacacagcagcctcactaaccttggctatgggttctcaggggactctggaagtttaccctcccccttgggcctaggtagcctgtgacagtggttttatgcttgtcttgttttgacagaaatttagggctttgcttctctttgtcgagtaaagatcatctgaaagagatgtgtgcatatgaccttgatttggcagatgctggtgtgcagggatcctatacctcaggcttactcactgtcctcattgacctaatgagacttgggagcggtgagtggacacagccttcagctttggactgatcacgtgtatccttggccacaggcccacactaagaccctggtgaaggatcagtatgtataatggttctaataacttgtttcttaggcaccagtgtagagagacttggggccattttcataataagtcaaaaactgttgttgtttgtaacttaaatgagcagaggaaaggacctccttgtacccccagataaagttctctgatcttgggcccattgggtatccttgggccccgtaggcattgtttaggttggcatggagctgttcactgagggcagtttgtatggcccagatatccgtctgctaaatgaatttccatctctcttagcattggataacctgacatgcatgtgaaggtgtgagcaaaccagccgaagacttttcctttgactagaaatttgtttccaggttcctgtaggcagttagtgtctgcgagcccagccttccggctgagattctcctgctttgtctcccgagagccccgggtccagcggtgctgcctgctgcgctgcaggccaacacatttctgacgcctttggtttgagagaaagttctgacctagtcctttagagatctcgcctcttgttcagtaaaccctaaccctggcaagttactggtgagggggtcgaggcatccatgctgtgtgggtgcctcctgctgcactggggtcctggcaccacggagtggccgagtcagaaagctcatgtctccctgctggtcacagttgtatctagttagtagcgaatggtaatcaggaatgttctaccatttgtccttgtatggagcgagtgtgaggtacaggtgtcagaacagtcatttcctttggggccaccaggaccttgaacacgtgtaattgttttgttcttgaacaccgtggagagctaacaccatggttccttcattgcttggtcctcacactgtgcagtctactctctggctcactgatggagcaaggaacagcggggtaggatgtgtctgtcttgtatcatatcccatggcaggtttatagctgggacactgagtggatctggaaagtcacctcgtgtggatgttgtgggccttcatgctttgcatatcctacagtctgtctgaaaagtctggccttgaggatgtcgaaaatgcttggaaggactcaccccaacccaccctggctctcgccgggctcccatgtcatggatgctcagcacacaatggcttgggatggcaggcaatatgagtatgtgtagcagctcttctagcgttgaacccagtggtgaggtgcttaccactgactaaaagtaattgcagaagcctgttttcttctcagtcccaggcaccaagcttggaagcttgtgtgtgcctggggcaggtgttagaacagccccctgtttgtcctcatctgcttcaggaggctctgtagatccccagggctgtggtaattggcattcactcagggccgcagagctccttgcatggctgtgcaggctctagccctaccctgctcctcttccagagcagacggaggcaaagccacatgggggtgtttttatttagtctttgaagacaggaaggtgttggccctggacaggaaatgtggccatgtgttttctctgggcaagaagatttccaatttagagggaaatgaaaacggccaaacattttactctgggatggagcatcaataacaatggggcagtgtctttgtacacggtgctgggttctggacaagggtccacctcatctgcatattcgttgtcaaaggtctgggtctggccctacacaaaagtcttttggctgacatccccccacaccccccagctatctctttccacaggagcaccttgccagggagtctcatgggaccaccagtgcagaggtcaggccacgtctttttgagagcttctctggtacttgcagatatatgctcagctatggataactgttcccgcaggttcccttcttacagggtctttagctatatccttaataaatgactttcctggatagctggacctcccctgagtcgggcacatcagtcctcagccctagtgcatcgtcacactgcctcgagtgccatttctgtaaagggctagagacatgattcagtggctaagagcatttactgctcttggagaggaccttggttcagttcccagctccaacaaccatccctaaatccagtgtcaggtgacccaaagcatgttctgacctctgcagcaggcatgcacatggtacacatgttctgaccactgcagcaggcacgcacatggtacacacataacatgaagtgagtaaatcaaacttggggtgggagtttagtaggatttattttatgtgcctggaccttttaaaggaccctgtgcccttcagtgttagttgcctcttggagttctgggactaggagagaatataaaagccagcagaagctgagagctggggagtagaattcaggagtggcattgaagtagttccaggagacagaagagtggggggtgggcgggcagttggtgacaggagaagctgagctgagctgggccagagaacatattgttaggagacgtgagaagagagtatggagaatataaagggaagatctacaggaatgggatttgagacaggctttctctgtgtggccctggatgttatggaactcactttgtaaaccaacctaggcctgagcttagagatccacctgcctctgcctcctgagtgttgggattaagggaaaattggaaaatttcccagctcttggaaggcagaggcaggtagagctttgtgtgttccaggatagccaaggctatatagtgaggccgacgccaaacctaccccgacctagacagacagacagacagacagatacgtgcaaggtagagtgtccctaagctgtgaacgtaacctatcaccagcatctacctaggccttgttattagaacgataggaaagttgagcatttgactgtactttgtatggatacctggtaggctgcagttgcccttcccttgaggagtaaggaaccttaggaggccgaggaacagaaccaagtgtcctctgaggtgaagtgttgtcctgaagagtccctgccttcactcgccactggcacgaagaccaggatcccttctgaaccctgagatgctgtggctttgctccctcttctgttccttggctcacatgagttctagttcctggaaggtggcaggaaagccagaagccctgggtcctagggggcctgcatgtggtcctcagcaagctctttctccagcatacccgtaattcctgtggctttgggatcaaccgagctagccgtcttttctttccaccagctgctgtctcgctctcctgtctgcagcatttactggctggccagcctgggctatgcattgttgcccattccacagnnnnnnnnnnnnnnnnnnnnaacatttcccagctcagcagtgtcccccacgtctcaggagaactagggactttgcaaagtcttacgtgtgactaaccttgtctgttagtgtctgttaggatgagagtgcatgctgggacagagcctgtgagcttagagggcagagagaatgacctagggctggcaagtaagtggcaggagacagctggtttcaagatgtagctgacagaacccggggcagctcatcgaggctcgggctgggtattgagtgagctgggtttagtgtcgacacttaaaagttctaaggacttgggtcagtctggtcctttctcaagccacggctcctcggtgatgcatgttgtatatgtttctggttacatgagatgggtcaaaaccagcctgccacttccagatgttagagaggaagccggaatgtgctgttagggaccaagttggtcaggccttgaggcccatttgccctgctctgtgctattgagggcttgttgtcgatgtgtggggagcacaggaggtgggaaggcgagccctcctgctggcctgtggagactctgtgattctggtgagtccaccttccgagaagagcgaactgcgcctgcagtggcattcgcctccctcacttcgtgtcctcctcactgcagcctgcagcctttcctccagccctagatgggaaggcctgtttatcttgatcaatctctggtgaaggggtggcagctggccaagcagccattacaggctgccccgcccttagcgagagtcatcttgatggaatgtctgctgggagcagctgagggacgctgggaaagaataggcccttttgccctgcccccacccagaccagagctcccaggcaggggcacgcccacatcgcagactgctgttgtaccagtggctggctgtctttggggctctggcccttgcattttaagtcttttaacagttacttcccatgtatcatctagggaacatcctatctgcttgggagctagcttcatgactctctccttctgaaacaggtttgtgaggaggcatcaatgcagttccagagggagccctggagttgtgtccctacaaaaccaggatgtatgttccagtagtggcttacttgggccctcgctcttctctgcaggcttggctggcacgctagagacttggcctttcccatcccatctccccaaccaacccatgaaagaaatcccgtcccaagggtgggctcttgccgctttttgacaggtccaggtccatgaaaggagcttattgtcagacccaactctcggggctccttttagagagccgaggcactcgcagatctcagcgggagcccgggaggggaaggattgctcagtgggtcctccccggagggagaaagaaggcaggctcttgctgactccgtttctttggaacagtattgggagaactagagaatgacctacttaagggaatcaaagtcagcccccgtaactgtgcttgtgccccactgggggctggggctgccttaggaacccagtctgccgcctcggtagcacagtaaggagccagaaagtaggttaatttgagcatgatgagagtgtgacttcggatgtgtaaaatattaacggcgatggcaaaaatagaaacttctagagctgtggactctccagaaaagacccgtagctcaagcagagccggttccagagtgaggcaatgtagggttcacctgtagaagacagaaacccgctgtggagaccctagctctgtgtcacctgtgggaagcgtttgcttcaactgtagtgttcggttcagggttgcccatgtcttggtagttttgcctaaaggagcccaagtcctcactccctcactgtaagtcgagtgactacattattctggctctggtctgccctatgaagggggaatgggacatgatgattctccactgacttattgcttattagtaggacctgctgtggctagactggggtctgtgggttggctgtgagaatttgggactctgggctgcccctggctgcaatctggcctcttaacactaaggctactccagtcagccctagatcatatggatgtactccacaacacatgacttttttttttttttttttaacctagggctcaccattctcgctagactagctgtccaatgagcttccaggatccacctgtctccaccccacagctttgggtttacagatgcgcggcaccatgcccagcttttatgtgggtgtcaggcatccaaacgcaggtccttgttcttgaatagcaagcactctactcactgagccatctccacagcccccgttggctgtctgacaggagccttgtgtgaagtgtaaagaaaagagctctggaccaggcagtggccagagtcaggcaggtcctggccatgggggagcctgcaagatgcaacagtaaccttgaacctagttggagtaggctcagggctcagtgtggagttagacctcttgactcagtggaacaaggattatggaccgtttgcgtctgtgtctgacactgatcggattctcctcgttacattaaagaaagcttgtggcagggcccagtagagggtagtcagagccgttgagctacaggctggcagtggcaagtcttgtaatgctgacttgggagggccgtggaagacccactgacctactttgaaagagagaagccaggagacagcacgtcgtaagcccagggcttgccccattttcctctgacattatggatcctctgcacatggataccggccgctcagctctctgctgttgtgtctgtggccgactccatattctcatttggtttcttctattctacatctgaacacttcctgggggaactagttttttctgttggcatacctggtctttctggaaatgtcctttttgttcctttcctgtgtttccgtttagtgctcctctgttgacctgctcagtgatgagggcttcctctttcgtgtgcgcatcttgagtctgtcctgtactctaggcatggcgaggccttgcgtttcctctgagactggtgtgacagaaatttccaagtgaacatttaaaaaattctcacaacctctgagtgagtaaatgcctcctactggaaggtgttgctgatttgacggccgtagcaggtcgtgctttacgggagtagagggggaggctggagagacagacagacagaccgggggttaggaatgcgtgccgctctatggactgggtcactgtgggcctgctagtgttgtgggtgtggagcaagcactgtgagcagagggtgctgcatccccatgatgtcctgttgttaccgtggagcgatctctggactaaaggacaccgtctgacattctgggctgtgatgcatgttaaggatcttaggagatcccagcatgttgagttgctttgcagctttactccccgccccccataacccccagtgcagcttccagacagccaggatatgatacgttattgggacagttaataacaggatgtagaattttaagaagggactattttgaaagtccagtatcttccttgttcaaagtagtatactatgaatagtttccatctgttttaccctctagatgagagaaactcacaaggtagacgacagttgcactgattttatgaagggcccccagcaagtgacagaggatgaggttgtcacaagatatgcagctgtccccagaaaccgcacacccctgatagtagtcctgaccctgtatgcctttctgctcagtagtcattacatacatttggaaaccatggtggctacgtatgtaaatgacagttctggacctttattgtgagatttagaaatctgagaatgatgggaaaaatttttccaatgaaaatttcttttaatagaacctttgggtgaataagtgcttctaatttgaagaaattactggtttgaagtctattgtgaatttgaccttatgggggaaaaggagggctggagacatggcatagaggttaaaatgcttgctgctttcacagaggacccaggtttggttcccaacaataagacattagacacttctggcttctttgggcacgtgtgcatactcacatacagatatatacataattaaaaattaatactttaaaaacaagggtttttttttgttttgttttgtttttttcaagacagggtttctctgtatagccccggctgtcctggaactcactttgtagaccaggttggcctcggactcagaaatccgcctcccaagtgctgggattaaaggcgtgtgccaccatgcccagctacaagaacaaattttaaattgagccattaccaggaaatatatgtgttttactaaggtttttcattgagtcagatatggtggtatacatgaatccctggccagcctgggctgcttcagagtactaaataatccttaggcccatgtttgcccgtgtgtcaagaatgtctataactttctaagacctcccagtgctggtgcccaggttagagttttcttcttgtggttcattatatgtggtgggtcacagaggttccaggggtggtacagtgtggggcgggtccctgtggtattggcctggtattcaagtggggcagagtggagaaagggctgccctgggagaaagctgattggggagattgggtacttggaacactggggcatggagttcaagtttgagtgaagggcaaggcagtggcataggcttgtcctgacatcaggacgtgagcaatagtagtctctattaatggtgcctgtccttgcctgtgagtgctgagagcaagtttgccacccaggatggtgggatttagggactaggtgctgtgagagttgggtgttgagacacccccctacaagagggacactgcggcaaacttggagcccctggatggccattttaggagacctgtgaatatagctctgtcctaagggttttgtctatagaaggcagatgcctgtggtaggacgagaatccaccctgagtcccagtcttggcttgcctcactcacatcagtgccagaatatcctattactttatgtcatggcgtctagtaccccgtggtgtgtatatgcctctcatgacaaggactagaatgctcaggagaagtcagccacctgctctgagggttctctcttccttgtgagattgtgttttaaagaccttgcaaagagagctcctgttgttcgctcgcctacatgtcctagtctgtgatgcagccttggtggatggcggcagcgcagacctacgcactcctgcggtgccttcttgtgcagcagcatcatggcacctgggttgtttctctggtgccacacctgtgctgaactctgaagacggcagctctgtaaacctcagccttaggctttggctttccaccaaaaagtcatggtcacatttttgggtcttttttagcactttttttttttttaatgatagcatcatctaactcttttataaagttgtggcttttaccatgtgccaccatcaccactatctccattttcatcactccagtatgaacgctggtatcattagctgtcattctctagttgctccaccccagccaccagccacctctgatctaagttgttcctgtatgttgctgttagagacgttttgcacaaagaaaaccatagaatatgaagaggggtttttttttttttttttggttttgttttcttctataactggcttttatcgtttaacaagatgttttcagaggtcatgtgcattgtgactgttgatgcctccttgtgagggcggagtggggtcccaggctgcggatacaccactgttcatccatgttttagttcctatttcttggctgttgtgtgtacgcatccattctgtttcccgtggttctgggagacggagcaggactgggattgctgggccattcttgctaataccagtattgtccgggtctttaaaaccatgcatgtaggcacatgtaccacctcactgtgctttttaatcagaaatatctatcctgagacagttgtgggtggaggcagttgtgagaaacagtgcagagatttcctgcgtggacctgggactctctcagtggcagcaccttgcagcagcgcaggacgtgctgctcaagcaagagattactggtcatttggcccccctggtttctttgttggttggcttttaaatggttttggagtttggtgctggggaacaaacacggggctttctatcgacacatcctgcctcctgcctaccattaactgtggttttcatcctggttgtcctagtgggcatgagatggtatctcattgtgcctgccttattacttactaccaggatgtgtttggttgtagaggtcacagacaccagccttgggtcaggatgtggggagagggtgcaggacagccatgggcagtgtccacctctggtagggtaattgagggcttggtgcatactgggtgaatgaaacttgttctttgtggatcttacatgggggtcctgctgtgagcctggaactgaattgatgcggacagtgaggatactacctggggctagccctccccagaatctgcatgagactgacaagacccagggctaggactgatgccatccatagaagccgttggcaggctgtgatttggtaggaaaagtacttgtccagtttgctaagttcttggctagagggtctattgtgttctctccttgagaacaggtatcatccctgtgtgctaagctggcccttctcactcaggggtggttaggctgtggctacagctgcccagacttccttagcagccttactgtagccacctggaatggtatgaaaatagacatagctacctaggctgtgtttgccatagtgtnnnnnnnnnnnnnnnnnnnnagagtcactgctctacatgggacccttatttcaatacctgtgagaggtctggagatagacattagtgtttgaccatttgcaggcacaaaaagaagattataagaagcagtcacctgccctgttggccacttgtagtttccttggtacacagatcccattctggctctgtctgtaggctgcacctcaggtgcatgtgaactgtgcccagcgtctcaaaactctgggtaagacgttgcatcttactgcgtcggggtcctttgtggggctgatacccctggtgtgtcaccccaggtgctgcccaccatcttcctctccaagtgcttcagacacatccatcacgggattaatgtatttctacacttaccgtaaccttcccagtggctctctgctgagtcttgccagacacaactggcgtttcccaccccagagctgttttctggtggtgctgttggatactgtcctttgggatccatgtcagggtcaaaagtagagtttcccaaggctcggcccaccagaccttgcaaagcattcaagctcaggagaggtgtgtttgaagcatgcctggctcagcctcactgctttctgttaggaagctactgtcaacgagcaactcccctggaatatgcaggagctgcttgttcttggacacaagcataggttagccctgtccaccatcgctgagttacttccaaccctggtgtaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatctcagtgtatctatgtgtaggcatccaggccctgacaccctcaggcagagactacctgcctgtgccatgatacttagttgggtcttggcatctagtgaatcttctatatgtgtggcaactcctaccagggcagacaaggtgaaacctcctttttttttgctctagggtgttggcatctccttgtatctggctctagaatctggaagagaacagccagcactttgtccacagtgagccagagtcttaagagagatgcaacttcactttccctccctccctccctccctctctccctccctcatttccttcctcctttccaatttgggaagggacctggagagattgcttggtgattaggaattcatcgtttgctcttgcagacgacctgaattctatctctaatgcccacatgtggttcacaactgcccataactgcagtgccagaggctccagtagacacacacataataaacacatgcaagtagagtgcttagccaaggggtggtggagcacgactttaatcccagcaagctgcaggcagaggcaggcacatcttttagtttaaggccggtgagttccaggatacacagagaaatcctgttttgaaaacaacaacaacaacaacaacaaaataattattcatataaaatgaaataacttcccaaagtatagttttagagacttacttgttttaatttgtgatgtgtttaaatgctttgcctgcacatacatctacatacccaccatgtgcattcctggggctggaaaaagtcagaagaggacgtttgatcctgtggaacctgagttccagatgactgtgaacccctctgtgggtgctgtgaataaaacccaagtcttcagcaacagcagcaaatgctcttaaccaccgagacatttttttatgtttgtatgtttacatgtatatatgtttgtgggccatgccatgtgtgtgactagtacccatgaaggccagaagagggcatcagttccctaaaactggcattggagatggttgtgagtcaccttgtgagtgctgggaaccaaatccaagtcctctgaaagaacagccagggcttttacccactgagccatctctttagctcaagggatgtatagacagcatttctgagggcttctaaataggtgggtattaattacatgatgtccccacagcagagctggctcatacctgggaaggctgttcctgtcacaagccaattccgagtcccttcctgtcattgccctttagtcctcaaggctggcacacgctgcacagggaatgcttagagtgaggcaacgagacctcacagacttctcccggatgactgtggccctttccatgcacagagagcggggcctagcctgccttattgctgttggcagctgttgagtttgggtgttccctcataatccatcctgttgtatttgtgtgtttaagggcgtaagtgacaagagaccctggcactagataggctgagagcctggctggaatcaggccagcctcatttcctgacacttgttccttctgttggcctttcctgcctctgtcatttggaagcttgcctgggttccgccctgtggtgtgggtactgtctgcattgtcagggacatacagcagagtccctgtgttctcccatgaccatttggtggtcacttaaagatggttggcgtctggggcagtgaccagagcactataggaagttaagctgcatgctctgatcacaacccacccacctacacacacctacacacacacacacacacacacacacactcaaaatcaaggataagaaactggatgcagctggaaggatggctgcgcaggccttggggacaggttctgaggcagactctttttgtttgttttattttcgggacaggatctccttattatgtagctctggctgtccaggaacttgctgtgtagaccaggctggccttggactcccagtgtgcatgcgtgccccatcaccttggctctgataatgaagtttcttcaatagtcggggggggggggggctatcttggggtgaaccatggcagtgagcttgttctttcaggacaggccagagtggagactgtcgggattctgtagcgtgtgaggtgagcagatgctgtgtagggcccctgtggttctcagtttcttgtgtggggatctagttaccacggtcaccttagcacagtgtgcaggcctcttttagaaccccgaatctactcactcccttcgcagtgccggccatagtgactactgcctgtgacaagttgccgtgccttgggacgatttctccagctacctgctgtctatgcttgttgggcatccacagggtgcacggtctgtgctgattggctcctgctggccacaaatccctgaggccctgcctgccagttctctgtccgtctgaggctagagacaagtgctagacacagcagccacattggccacagctcatctgaatgccaggccccactgtgacccacaggcccatagtgtcctgtcctgtttctttccttgatcagtaagagtgtctcaagtattctttctgaggtagaaggtgaaggattgttaagttctctgtaggtcagagtgcatggactccgcggtgcagggtggggtggggaggggaggggtggggtgggccagattcagctggctcttcccctgctttgggatggatggatctgcatatccacagccctgcctggccctgcccttcctgcacaggtgcagaggtcaccctcagtgacacctgttctcaatgcctttgcccttgggatgtgggggaaacaaacaccactgtctgaagccccagagaggaagtggccacagggcaccgctgtggccagctcagctggctcctccccgatacagcctgataatagctcttggtattggacttttgggggcagggctgcctcttgccagcctgtttaggtcctggctttagcttgtggggccagagctcccctcctggcttgtaggcactgtggactgtttttgaggccccaagaaaggtcagattggtcctaactggttctcgtagaggggacacacgctatggtacagttttgttaaccattggatgactccaaggactcctagtgtccatgctgtggacactgatatcccaaacctgacgaagctctttctctgttcctttgaagagtaggacaccttcatcagggccctcttgcttaactgcccttcagctcatgtatgcagctagcttggtactaaaggggaaattcctggcactgtctagttttaacacttccttgttctgtaagagttctacttgcctttggactttctatgaacatctcaggggagttgttccagctaccttaagactcttccactagctccaggggcttccccgtcccatgtgtgaaacatctgggttgccttaggagactttgaccccagtatagtagtctagcaaccccccctcccgccccatggcccttctgaacaggaagtagcctcacccagtggtcctattccccagcattttctgctgggtcacagttttgaggctgcctgagaggtgtcccagactagacttgtggctttctctgtgagagactagagctcactttttgcacctgttccagtgtctgctcagacaggaagccccaccctggtgtgcaacacccaccttctgccttcattgtgggagggatccttgcaattccggaagtgggttcttctgccccaccagcatcctgaatatctactcctgcagggagcgtacatggcctccactgactgagcctctgctaagtgacagtttgacactatgagttattccctctagaaaggtagttttggtgtctttttttcttgaacagttatttgtgtttgaggaacatgcaccccagctgagtatgggtttgtctctgaaagtgccctggggacaccaccagtgtcatccctccagtgatttcccccagtgcaggcccctgaatacagaggtccttccctttgctcgccccaaagacttgcttatacttggaaaggcagcaggcctcccaggcacaagcactggacaaggacccagcacgtgcactgctcactacctgggccttggtgaaggcctccaatggggtggatcatctctcctctccaggtttcatggaaggaaacctgtcaagctgttaccttggctgccttcttcctcattgcctcttcaaggaaggcaaggccagttttatgataagttgtttcccccaagtattctagagaagagccttgttcttctgtagaccagaagcctcactttggctgcatccctcccatcacacccaaggtaactccccctttaaaaggaggctgtgtgtggggccaaggtgtaagctctgctatgtctgccttgcggtccatgtcatctacttagaccctagctgagggacagtagcttagcgtctgtaggcttagctgctgaggaagaggcccacggattgttctgcacagggaatgtcggtgcgtgtgtgacatgtgacatttatttagggggagggccattggatttcacgtacagactggctcaggtgtgtatcacttaatgctggatgtcaaaatagaccatggctggtgcctgagaaaagttaaggtactgggtggcttctgtaagctgacagcaaaggcagtgtggtgacacctggttaaagctgttttgtgaggtgtgtcatgatccttcaagctgagtatttccttcctctggggagagggtaactgcagtgctctctaatgacgcagtgataaaggccacccagagggtagcccagccctcccaggctccttacaggctttaatacagctggttgttggatcacacatgagcctgaagtcattgctgctgggtcatttagcccattcctgacatggtcctagagtgggactggtcccgtccagccttcttagcatcatagctgcgttctaaagtagtgtggactgaaggcaaagaaactcaggtcaaagcacagagcccgctgcagctgtgagtgaggtcacctcactgcagcccacagcagcatagcatttctctgtctcatgtgacgtcctcgtcccttagtagacacatcaggcttccctttctgcacagggtcaagggcacactgtgtttgtagctccgtacatttgggtccccggggctccttcatagctgtggagttacgatgatccagtggggagcttgataccatggggctggtaggaagacctgcctgggcccagggatcccaaccggggccttttgtattgatcacaggtctcagagcccccagcttccataagacccaaaacagacgacacttcctcacagtcccctgcgtcttctgagaaggacaagcagtccacttggctgcggaccttggctggttcctccaataaggtgctatgtgggaacctgtctggggtctttgggggtggtgcaaggctcttcttagagccaactctgtgcctctactcagcctcaggggcataaagtggcgtgtttttctgtaatcactcacatagattttcttgacagagcctcggctgcactcaccctcgccagcgcctttctgctttccggccctggtcccctgcagtgtctgcgagtgagaaagagacgtccccacacctcccagctttgattcgagacaggtgagtggggaatagacaggactgagctctggtttagcaggctttgatggtgttggtgcctttagtcttaggataaactgcctagaccattaaagtctttgatgaaggtgctgagttcacagacagtattaagaattagcctctagccgggcaaggtggcgcacacctttaattccagcactcgggagacaaaggcagatggatttctgagttggaggccagcctggtctacaaagtgagctccaggacagccagggctatacagagaaaccctgtctcgaaaaaccaaccaaacaatcaaaaagatttagcctccaacattcaggaggcagaggcaactgaatctctgtgagtttcaggccagtctggaatggatagcaaattccaaagccaggcttgcataaagatcctacctctgaaaacataaaggtctagttgtgtactgtcctagcccaacctgtgcggcttttgtggttctcagccattttaatcttgaccttgttaggtaaagtagacagagaagatgtcctgtgtcctggccgactgagcaggatgcgttctacgactcatgtagggttttgagaggcagatataccctggctaagcatctgtttcctatagcttctactcctacaagagctttgagacagccgtggcccccaatgtggccctagcaccaccaacccagcaaaaggttgtgaacagtccaccctgcaccaccgtggtctcccgggcaccagagcctcttactacttgtatccagccacgaaaacggaagctgactctggacacagcaggagccccagacatgctgacacctgtggctgctgcagaggaagacaaggattctgaggccgaggttgaagttgaaagcagagaggagtgtaagtgtggacaggactgttccccttgggaggtggggtaagggggtgcatttggtatgaccaagccagcgtaccctggagtgcctaatgctttggtttctctgtctgtcctcagtcacctcctccttgtcctcgctgtcctctccgtcctttacctcgtccagctctgccaaggatctaagctccccaggcatgcatgctccgcccgtggttgcccccgatgctgcagcccatgttgatgccccaagtgggctggaggcagagttggagcacctgcggcaagccctggagggtggcctggatactaaggaagccaaagaaaagttcctgcatgaggtggtcaaaatgcgagttaagcaagaggaaaagctgacagcagccctgcaggctaagcgcagcctgcaccaggtaaggtgggcagcaagaaggcccatgaaatacaggagacagcctccttttaggctgcccaagcccccttggggacccgtggggttcttccccaacactctggagggcccagccctgtgaggcatttgcttccaggaaggctcccatagtggtcccagcctcagctttccctgtccgtgggcctcactaaagaattggtgtgttttcttggccatgacaaaggccagagtgttaatgggagggaggggtggctgcaggagtactgcctctcactctgtgaggagttggttgattccccagcaccgtcagggatggcttctgaagaagcccctcggagaagagccgaggcacctgggatacgcttcggaggtgtgtgtgtctccgctgctcactaggctcctctgctcttacctcttctctaggccagagcctttcctcttacaccttctcttcacactatttgtttttctgacatgagtaagagaggcccagttctcaggcgcctagggagagcgaggcgctcagctgatgttctccaccagggctctgctgcaggctcaacctcagctgaattcacacctcagcctgagtctggcagctctgggggcagcctcacatgcgtgggctttaacacaacacaaccctgtcgatcctcggggctgcaggatttcagagttctcctcagagtgaatcttagtcgttctctcatccttccttgctcccatcctgggtagaggtgtgattctccacatgagtattcatacgggtcaggggtcacactgcatgctttacaagtagggaagaacataagaagtaccaaaagtaactggctccatctggctgggagccaacgtcaggcctcaggggcagtgtctgaggcggtgctggtcctgtcctctgctctcattcagacaaggcacgagcgcttgggagggggggtgtgaggaggctctgctgcagcctgtaaatgaccacagctagtcaccgatcgctgctgaaccccgtagggaaagacactggcagttagggggacagcctggcaggtggcaggatggctgggaagatgctgggctgccagtaccttgaacccgttggctccatgtcctcccaggagctagaattcttgcgtgtggccaagaaggagaaactgcgggaagccacagaggccaagcgcagtttgaggaaagagattgagcggctccgagctgaaaacgagaagaagatgaaagaggccaacgagtcccgggtgcgcctgaagcgagagctggagcaggcgcggcaggtccgggtgtgtgacaagggctgcgaggccgggcgcctgcgtgccaagtactcagcccaggtacctaccgtagtggatttgctagtaacactggcatgtacagaggtagctgctgtcaccaatccaaggtcctcagtttacccattcctagctggatgtgaggtgatggtgtgtcacgcctggtgtgtccagcagacctgggcctgggtgctggggactattttccatagccatgggtggaagtccaccccccactaggaccattatggccccagaatacagcctttcctccctgctgctggcttgggaagcaagctctaaactgggatcaggagatgggcacacaaaggcagtttctgcagcttagggctccatcccagtgagcccttgggggaaaaggtcttcccagtttgttttcactgctgtttgatgctggtgctaggcactgctgacctctcgcttggcgtccctttcagattgaggacctgcaagcgaagctgcagcatgcggaggccgaccgcgagcagcttcgagctgacctgctgcgggaacgtgaggcccgcgagcatctggagaaggtggtgagggagcttcaggagcagctgcggcctcggccacggcctgagcatcctggaggtgagagcaacgctgagctgggtccctagcctgggcagtgattgccactgccacgtggacccctatgcgtgcgcagagggcagcgggtatgtggctttgcaggcccggcccatgcctctgcagccacacagcacaacgtctctactgtgcctattaccaagcgagtgtttgtaaccacatacttttggaatccactgcaaaattttctactggccaagttcaagtgagcaagccatgcccccagctgcagtcagagttgagaccggctctgtggctcgtagctggttctctgcttgctagaacattctaacatttacacttttgttataagctatttaaaaccagtaaggagacttgatattcagagaatcaacatgttttttaatgactaactgtaaaaggcccctacacgtgacgccatctggacacccactctggcgggggtggcaccacccaccgccgtcctgggaagccatcaccgctcatctgtgcccgcggctacaagaggacagcaagggttttcttcagagtctattttttcagcaacaaggaccccagtcttcctgctgctgccaggaagagcagggagagcgccgcgtgcgagatgagccccaacactgcccgccttaccgccgctgccccgcccatcaccatcaccactaaccccgccctgcgggcaccaggaggcctgagcctcggtttgcccaggcccctgggtgcccctgcccacctacaccttgaggggctgacctgtgttaggcagtggccatggcccagtgtgatgttgtgttgctcacacacgccacccagccacccatgcgctgcctgaccacagcaaccccctcccgtgcggcagacgtcactcctcgcatcgtgagctgaggctgcagcattggaacaaaacagcattacatcacttttcctttaatttttttttccttttgttttgttgttgtttgttgttcatttaaacatgtatttagaactgcactttgtcagaaccttccagtcccttcttactccccggttaactgaggtttttaccaatttctagagcagttcaaaccctaagtgctcaagcgcttacacatcccctctggtgcttggttgaacaagggaatcacgagacaatgaaaatgcagagactgaacttgggggtcgttctgtgccttccagcatcttgtacagcaaaccctgacttgtctttatacccccaaaataccgtcttcagtagcgactgaatctgccactgtcaaaatacgttacttgcatttattccaaataatctcgtttactcttaactgtttatgcaaattgtataaggtttcttatgcccaagcttgaaaaatgatttcccagtagacaagaggcccccacccatcctccaattgtgtttatttacatgagaagatcatacaaaagccctccgctctagtcctagcagggcagccatgagccgaggggaggtggagaaggcttgtgcaggtacaaacgacctcaaggactgtggcctgcaactggagactgctaagccctgacgtctggtgccgaggtcgtctgcagggttttgcccttggtttactgaggggggctgagctgctgctggtccccccttctgacgtgcaatgcaaaagggacatcatgtatacgcagcatttatttggagtttttcctttggctttttttcctctctttttcagttatgaaacttgtatgcatggatttcacatctccatagctagacccgccatgggcattatgaccgtgtctcctaaagggtcggttttgttacgcaacacgaagaatgctgtctcagccttgtttttctagagttgtgtttttcagtcatttcttcaagaaaaactaaaatgatttagttggagcaaagctttaagtgtgttggtgtgcttctgtgtggctgtccctgttgctagcagatcacagtgatttggtcccattggagcctttggccccaggggcactcactttttctcatcagagtctctccttgccacagcccgggtcaccatcggttccctggcctccctccgtggtccagcactggccccagtatgctgtgtatgcagcagggactcttttccccacatgccaggatgacttggatctgggaagggcgtgtcatctcagtttgttcctcccgcacccctcctccccctgcttcctgtgggatcagagtaaggctcctgttggccagtagcttgtgatctgggacctctggggcctcgtgtctgcctcactcccgggccccagtcctgggtgaagttggcaaagcactgggtatcttgtgcggctgccgtggaaggcggccctgctcgatgcagggtctgcagtggcctgagggcagccaggcactgcatgcctgtctccttatgaggaaggctgcaaatttcagagaaagggaggtgaggtttccaccatgttggctgttgactctccctgtatgttaaacccttgaccagtttactcgtttctatcctggaagatttttaacaaagggaaaaaccaacagcaataagtcattggtgagcagctaactcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctgctgctaacgacaatacgacggcttactctgctactcgagtaactatttttatgtaattaatgtatgctttcttgtttataaatgcctgatttaaaaaaaaaaaagaggaaacaaagaaaaagcttggcatatttatctatttctctgtgtacctgttagtccttttgccctctcctctccccaccccccagaaacagatgacgttgtacaataaaggactttgcgagtaccatgggtgcctgcagcccccatgcatgcagtcaggtcctcaggaaagggggagggggaggcatcgcaggaaagggggagggggcatccacaggacagacccggagctgttggtcactcagctgtgttaccaggaaccttggtaacctttttggacaggactcagcagtgctggacagatggaatgggcatagcccttcctggcagaggttccacaagtgttctgctgattcaaaactccctggggccaaactgagtgcagaagagtagacagggaaggcctgagtggagaagcccccatcccatggtctggctgaggtctccttcatcagccaggtcctctgtatggacacagctgcccctccatacttagctacaactcttgaaacccaacttcttggctggtaccagcttctaagtttcctaagaaaacttactggggactccttacgtagggctggtagcacccaggtggtcctggttcctgtcctgtgactcctcccatcttcatgcctgctcagacacaccctgccttgcccacctcagctcagctgtgccaacctgtctcctggctcctacctgccaccagagagtcaaatgggctgttcctagggcaagcaaacaagcctctatctgtctgtctataatctatcttacctatctatctacctacctacctacctatcatctgtccacccgcccacccacccattatggaaagtcagatcccaggcttcaaccatgggaaacaggcccgtgtcctgttctgcaatagctagcctagccagcccagttcattcctactgtgataagcctgcactttctacatatccccctgcctcaagactatcccctagtcttcaaattctgcctagggaagaatccctcggaccatccagcccagaccctggcctaggcatgccacccctatacctttctggcacctgctctgaagagcctctgcctgtcctggggtcaggcttctttcagtccagtatgaggcagagccaggccccaccgtgccggcctgagctaagaggaggactctgcctgctctgcaggagttttgctcctgcctgtttttggtggcctgggtgtaggaactttcaaagcccatcacctacatggaggagactccagaagcaaagaaagggaagtgtggcttaaaatgcggaacatggaaggctttttactggtcccccggccctcctcacagacatccaacagccaaaactcatcccgcttccagccaggtgaccctggggatggagtgaggatgcccatccattcctgccaccccatggtcctggtgacgcataaggccatctgtgatcaagcctctgccaagttggtaggtgtgttggcatcaggggcaacaagccgtggaacaggtgtaccactgcaggcgggcacaggcaggaggagttggctagcctaatgtcttcatagcatcctgtgctgggccaggtgtccagctgatctggcacggaccctcctcttcctgagtatggacctggtagtcctcactggcaggaagctgggtccaggctctggctcacattgatcttgatacacaaatgcttgggcagacagacagtacacccaagggaaccggggaactcaacatggggacccttctcacagtctccagcagagacctgcctgagggtgatcctgcagcccccgtatctgctccatggcagttctccagtgttcttggctctacagctaaagagctggctaactagccagacccaagctgctagcccaagcccactcagaggcaagccaggtttcccatgcttcctgggttctgtgctagcccttgtaaactgcccagttcactgttaactttctgtccacccagtcctgaaccccagaggatttcaagtatccatggccagttgacagtctgtccccaacacttgagattgtcctcaacccctccccatctcacttcaggcttcccctgcaagtggttgctaatggcagcagctgctcctcagaggggacttgcttcacactagctactcaaagggaaatgtatgtcctcagatgcctggggagccgggagggagctagctaccccaggctcttgaggaaccagaggaagtagtgactgtccccagagagggagacaaggagcaccttcgcccaagccctgcctactgctgatactaccaaatgagatggtctaaggaccttatctgtgatggaaaacagaggtctcttgtccttgagacacctgtctgttttgagtagatgtgtgcactgtgtgtgcatgtgaagggctgtatatcggagacaagactgaccatgggcaggtgcaggccctggggcagtactttatgcccactctctacccttggggagaggcccagggccagatgaatttgacccctgtcaggcagggcaacagggcgaacatagtagagatcctttgtgctgtgttcatttctggccttggacacgtggatgggacccctgcctgccagagccaaggttcatggatcactgcaacaagaccttggggtctaacctcatgctgccgcctactcgggatggacaagtggtccacatctctctcagtatcctgtttctacagtaaccacttcactgcggttactggtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacattcccgctccttccgacgggcgggggcgaccctggtctgcagctctgctaggctcctgctagcctggggatgagctggccccggaggtgactgctgcggggaagcgcgaccgcgcgggcttccagcggttcgaccgcagtcccagcctgcgggatcattcctggaccccaagtcccggcagctcccgaagcctggggcccgcgggtcctgcaaggcatgccccgcccacgggccgcgcggcctccgcctcgccctactacccgcgtgcgcttcccttcccccgcctgccgcggattccgacgggcagggcccggggcttccggctgcgaggagagagctcggccctgcgggaccagcccggcgccgccccacgcgcaacccgacttcctgcggcgtaggatcccagagaccggggccagagtcctcgggatccgcctcagagcatgtgttcgtggtctgcatagaaggatcgcgccctttttgggaggttctcaccggccttgccacggggtgcagcctatgtgttatctaaaatgggatctggtcgccttaagcaactctctgctgctgtccctagtcacttcactgctgccctagcgaatgtcccaagactggatcccgcgcctggaacctgcagtcctacaggcggtttcctctgcctccagaatccaccccggcaaaccccacgggactggtgaatgtgaagttccacctgtcacctgatcagtgtgcataacaccccacactgggatcggagtgtgtagaactctacccagccctcagccaagtccctgtccccatcccagggccagagaccacttgttagaagcaggttctgaggcccgaggccaagcctgcaagcagggcttctttttctcagcacctgactacccccacggaaactgatcctcacaaataactctctcatgaatcatggaactcttggaggagcagatgtgcctccagttgcagaggtccctagggaggtttgtcggggtcctgggaggtggtcctgagtcctcggacagaagtgtgtgtggtcggcagctgagttaaggtgtgattcctgaaatttatcttaggaatatttctggctgacagccggggacaggatgccctcgattggtccagccccactctaacaccaacaccaagacactgggcccttgggctatagcccaggatccccatccaggaggggagtgttgcaactctgatcttgggctcctccatggagtacctgattcagaggtcatggtttaggagcctggggtgggtctgccctcctgtatctcctagcctgtatcacactaaaggagggaggttccctgttctactggggctccagctgccaacctgaggcctctgtgtcctgattgtctacaggacaaaggtgggagagtggcaccattgccaatgccgtgaggataaatacaagaggcaacagtgtctggccattgcaacagggcagacagtctgctccttaggtttcattttatgccaagaggagcctggacagagccactgtgtatgtgtgtgggttgcccatacactctgctgtcccgttcttttgtctggctcctgaagacctacacagaaccagcaattcctctaccatgggcagtccctaccacacctggcctccaaactccactggaacctccccttccctctggctgtgagggacctgtctgaggccgttccttctctgaggaaaactgagcagaaaggggcaggcttgccagctaccgctgaaaattgtctcctccgtagtggttttactgggctaggcctgtgggctgccctgacactatccaggatcaagggctcccagtgaactggcagagctggccaggctgtaggaaccggtctggcaggcttggtcctggaacctccaggaagccctggctgggaggggcccaggcagagcacagctggcctcacacccgcctggcaccaagaccaggcaacctgcccgggctgtagacagggcttggggaggcctcccctgggagtatcctgagtgaccagcctgaccagtggaagaagctgggaggagctatggccacctgtgccaaacaggcccagggagaaggtggcacagaccaggctgtccagcctagttccaggctgtgttctggtcatgctgtcctctgttgaccccagatgtgtcccaggtggtctggtgagccagctctctgaggtgcctctagatgcttgggccttgaggggcaggcaggtcttcctttgagtctttctccttcctgtctccttgcttccttctgtcttccttccttgaacttccttctcttctatctcccatccccgtctatctttgtatctcacacaagcacacgtgacagtgccctgcctggatgctcagtatcttatctgttaagtgagtgataggcagactggtagtgccccccctggaggggtcagaagttagaaggtagcactggagagaaaggctttgtctggagttgcagcttctgggctgggctgggctgggctggggagggtggtccgcgccctctaacttgtccaacctccttctctcactggcccctgcaattcccaagtggggtcagcatgtttggagtggtggcttgagatctgagggctactagttcccagaaaggaggtacccagaggctctgtcattctcctaccaggtctccaggcagtccacagattgctgctatactcacctgtgtcagccaaagaggctgactctgcacagttcctgtcaggcagtgctggtgatccaaagccatggagtccgatgacctagtccctcccacccatggaagagggactacccaggcaggacagaagctatggttgttattgtactaggcaccaggtctctggatagaagtgagaccacctcactctgggagctgtggccagacctgtattcattcatcttggccacaagctaaagtttcccagtggaaacttggtacccagaccaggacagagggtagctggggtgaagttgcccactgggcacgtgctcctgctgggtctccatcctagctctgaccatcatagaagaggggatcccacaggggatgggcaaacctggagtggggcttactggctggcaaagcctgagtcctgggaactatacccctagccaccttctgaaatgagccctctcaatcccaggatagtgagggaccctcaggatggcattcccaggcttcagttctgcccaaagtcagcctgaccatgttgctgcctagtgaggccctggggcctaaatggcctgtgcgctgggggaggccagtcacttctgtggttataggctgtgcgctctgcagttcttgcactgggctaggctggacgcctaatctcctcacataggatttacctcaagcaaattatacccaagacctgccccactgaactttgtatgtgtgcctatatgtgtaggtatacatacatgcatgtatgtataagcatacatgtgtgcatgtatgtgtggctgtacatatgtgtgtgggtatacatatgtgcatatatgtctgcatgtacacacgtgcatgtatgtgtgggtagatgcatgtatatatatatatgtgcaggtatgtgtggctatacataagtgcattatgcatggacatacatacgtgcatgtatgtgttggtatacatatgtgcatgtatgtgcaggtatacatatgtgcagaagtaagataattcttgagtgtcattcctcaggtgctattcctctgatgccacattttactcattcattcattcatttataggcataatctctcaatggcctggagtatgccaagtgggctagcctgacttgccagggacccccagagaccccccactcccacctcccagagctgactgggattataagtgtgtatcaccacagcagccatttcttttccttttggggggctatttctttatttatttattgtgacagggcttctctgtgtagccctggctgtcttagaacttgttctgtagaccaaacttgtcctgctggccaacctcagagatctacctgcctctgcctcctgagtgctgggattaaaggtgtgcgccatcacagcccagcaggggctttttattttttctgtgagctctggagaatgaactcaggtcctcctgcttgcaagacagatgcattcccaactaagctatctcctccatccttaatttagtctctactcttcttttaagataggctccgtctatatcgccaaagctggtcttgagtggacaatgatcctctcaactgctgggattacacattaccagatctggcgctagaactcttcttgggcattcaagtttcatgtgcttggaccactcggcggcagggccctgggtggaggaggggttgcaaacgagaacatctgcacctgttcctgtcctggccacatggagggccgggccagttccagcgaccacagttctcagaagaccagcagttaccagtacagatacacttgtccagaagaggcagtgtgtctgtctggatattgtggctacccctaatgtcctgagacaaggataagaagccagtgtcatctcagaacctcagtggctgtgtcaggaagccagagcaggaagcccggggtcttgcctggacagctggtgggtttgctgatgactgtgtaggtggccagcctggagctgtttgcagaggctgtgatggaaagcagccccacctggcctgcctcgattaccaggacagacctgatgccagctgaggagccagtgtggcacaagccccgcctgccatacccacatggaacagtgactgcaagtttcaaaagctcagcatgctgtggggagttaaataccagaggctgcctgaggatgggctggaaaacggcagctgcggctgctcactcccagccattttccttcctaaattgaaacatcattttctttgtttttcttttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggaggagactacagaatgttgtactgtgcctgaagggcagacttgagaagtgatgctcatgagtagtttaggggataacagtagagggcaggtccagagacctcctgtgacctggtgaaaagatggctgacccagggggttgggcctcctcagcagtcaggtgtgtcccttcagcggcagttatgagaccccccccccatgacccttccttaccactgctggggatgaccaggtaaggaggccctcttcactctgcgatgctagggaacctgaacttgaggctcctcacgctggatggcctagttgcccccagttcttgccttcacagaaatctaacgtagacctccgtggccctgggaataatgttggtggggcagatatgagggtcctcagagggcactgggacactgagcctagcctctacctgtgtcccataagactccaacccaatgcagtgctagggccaagagcctgctagaaggagtcccacaaaaggtgctactcagggttggtatttagaattttattgacgtcagtagctgtggggctcacgtgggcagccctaacgctcaggttgtttaggaatagagaggatgtggtccctgggagaagcagcatcaatctccattcagggaaggctggccttcccatgagggtattgctggctcctttatgtccaacagccaagagtagccgctagcttagagcttctggtgatcttcagggacatggggccagtgggtgtcccccttggctaagatccgcaggtgtttgaaggtggtgggcagcctgtggcccaggaagggagggctggtcacatcacagaccatgagcacatactcccctgtgagggacaggcaggggtatcaggctagtgtgaccactggagcctaggctcttcaccctccctgggtatctcagccctatcatctctgcctgccacagactgccatcctgaggttgggtgtttggttagcaagcgtttgggcaaagcaaccagcttcgcaggcccagcctggatctgaagtaagcagtggtgtgggccagcccttggggtcaagccacagagacccctgctcccaactgctaattaggccacgtggctgagtctttttgtaaatacttgactacattgtttttggagaaaacacattcattttctctaaatatttaagaaatagctgggcctctgaaggtttgaagtgtctggtggggtcctgaggccctgggggggtgctgttgggaaagccctaggggactggagggtagaaagcctgggggtctctggagagggaaagccctaggggg

SEQ ID NO: 1412 - DNA, 4713 bp, Mus musculus
atggaagctgcagcggccggccggggcggcttccagccgcacccggggctgcagaagacgctggagcagttccacctgagctccatgagctcgctgggcggcccggccgctttctcggcgcgctgggcgcaggaggcctacaagaaggagagcgccaaggaggcgggtgcggccacagtgccggcgccggtgcccactgccgcggagccgccgcccgtgctgcacctgcctgccatccagccgccgccgcccgtgcttcccgggcccttcttcatgccgtcggaccgctccaccgagcgctgtgagaccgtgctggaaggggagaccatctcttgtttcgtggtgggaggtgagaagcgtctgtgcctgccgcagatcctcaactcggtgctgcgcgacttctcactgcagcagatcaactccgtgtgcgatgagctgcacatctactgctcgcgctgcaccgccgaccagctggagatcctcaaagtcatgggcatcctgcccttctccgcgccctcctgcgggctcatcaccaagacggacgccgagcgcctgtgcaacgcgctgctctacggcggcgcctacccgccgccttgcaagaaggagttggcggccagcctggcgctgggcctggagctcagcgaacgcagcgtccgcgtgtaccacgagtgcttcggcaagtgcaaagggctgctggtgcccgagctgtacagcagtcccagcgctgcctgcatccagtgcctcgactgccgcctcatgtacccgccgcacaagttcgttgtacactcgcacaaggccctggagaaccggacctgccactggggcttcgactcagccaactggcgggcctacatcctgctgagccaggactacacgggcaaggaggagcaggcccgccttggccgctgcctggacgacgtgaaggagaagttcgactatgccaacaagtacaagcggagggtgccccgggtctcagagcccccagcttccataagacccaaaacagacgacacttcctcacagtcccctgcgtcttctgagaaggacaagcagtccacttggctgcggaccttggctggttcctccaataagagcctcggctgcactcaccctcgccagcgcctttctgctttccggccctggtcccctgcagtgtctgcgagtgagaaagagacgtccccacacctcccagctttgattcgagacagcttctactcctacaagagctttgagacagccgtggcccccaatgtggccctagcaccaccaacccagcaaaaggttgtgaacagtccaccctgcaccaccgtggtctcccgggcaccagagcctcttactacttgtatccagccacgaaaacggaagctgactctggacacagcaggagccccagacatgctgacacctgtggctgctgcagaggaagacaaggattctgaggccgaggttgaagttgaaagcagagaggagttcacctcctccttgtcctcgctgtcctctccgtcctttacctcgtccagctctgccaaggatctaagctccccaggcatgcatgctccgcccgtggttgcccccgatgctgcagcccatgttgatgccccaagtgggctggaggcagagttggagcacctgcggcaagccctggagggtggcctggatactaaggaagccaaagaaaagttcctgcatgaggtggtcaaaatgcgagttaagcaagaggaaaagctgacagcagccctgcaggctaagcgcagcctgcaccaggagctagaattcttgcgtgtggccaagaaggagaaactgcgggaagccacagaggccaagcgcagtttgaggaaagagattgagcggctccgagctgaaaacgagaagaagatgaaagaggccaacgagtcccgggtgcgcctgaagcgagagctggagcaggcgcggcaggtccgggtgtgtgacaagggctgcgaggccgggcgcctgcgtgccaagtactcagcccagattgaggacctgcaagcgaagctgcagcatgcggaggccgaccgcgagcagcttcgagctgacctgctgcgggaacgtgaggcccgcgagcatctggagaaggtggtgagggagcttcaggagcagctgcggcctcggccacggcctgagcatcctggaggtgagagcaacgctgagctgggtccctagcctgggcagtgattgccactgccacgtggacccctatgcgtgcgcagagggcagcgggtatgtggctttgcaggcccggcccatgcctctgcagccacacagcacaacgtctctactgtgcctattaccaagcgagtgtttgtaaccacatacttttggaatccactgcaaaattttctactggccaagttcaagtgagcaagccatgcccccagctgcagtcagagttgagaccggctctgtggctcgtagctggttctctgcttgctagaacattctaacatttacacttttgttataagctatttaaaaccagtaaggagacttgatattcagagaatcaacatgttttttaatgactaactgtaaaaggcccctacacgtgacgccatctggacacccactctggcgggggtggcaccacccaccgccgtcctgggaagccatcaccgctcatctgtgcccgcggctacaagaggacagcaagggttttcttcagagtctattttttcagcaacaaggaccccagtcttcctgctgctgccaggaagagcagggagagcgccgcgtgcgagatgagccccaacactgcccgccttaccgccgctgccccgcccatcaccatcaccactaaccccgccctgcgggcaccaggaggcctgagcctcggtttgcccaggcccctgggtgcccctgcccacctacaccttgaggggctgacctgtgttaggcagtggccatggcccagtgtgatgttgtgttgctcacacacgccacccagccacccatgcgctgcctgaccacagcaaccccctcccgtgcggcagacgtcactcctcgcatcgtgagctgaggctgcagcattggaacaaaacagcattacatcacttttcctttaatttttttttccttttgttttgttgttgtttgttgttcatttaaacatgtatttagaactgcactttgtcagaaccttccagtcccttcttactccccggttaactgaggtttttaccaatttctagagcagttcaaaccctaagtgctcaagcgcttacacatcccctctggtgcttggttgaacaagggaatcacgagacaatgaaaatgcagagactgaacttgggggtcgttctgtgccttccagcatcttgtacagcaaaccctgacttgtctttatacccccaaaataccgtcttcagtagcgactgaatctgccactgtcaaaatacgttacttgcatttattccaaataatctcgtttactcttaactgtttatgcaaattgtataaggtttcttatgcccaagcttgaaaaatgatttcccagtagacaagaggcccccacccatcctccaattgtgtttatttacatgagaagatcatacaaaagccctccgctctagtcctagcagggcagccatgagccgaggggaggtggagaaggcttgtgcaggtacaaacgacctcaaggactgtggcctgcaactggagactgctaagccctgacgtctggtgccgaggtcgtctgcagggttttgcccttggtttactgaggggggctgagctgctgctggtccccccttctgacgtgcaatgcaaaagggacatcatgtatacgcagcatttatttggagtttttcctttggctttttttcctctctttttcagttatgaaacttgtatgcatggatttcacatctccatagctagacccgccatgggcattatgaccgtgtctcctaaagggtcggttttgttacgcaacacgaagaatgctgtctcagccttgtttttctagagttgtgtttttcagtcatttcttcaagaaaaactaaaatgatttagttggagcaaagctttaagtgtgttggtgtgcttctgtgtggctgtccctgttgctagcagatcacagtgatttggtcccattggagcctttggccccaggggcactcactttttctcatcagagtctctccttgccacagcccgggtcaccatcggttccctggcctccctccgtggtccagcactggccccagtatgctgtgtatgcagcagggactcttttccccacatgccaggatgacttggatctgggaagggcgtgtcatctcagtttgttcctcccgcacccctcctccccctgcttcctgtgggatcagagtaaggctcctgttggccagtagcttgtgatctgggacctctggggcctcgtgtctgcctcactcccgggccccagtcctgggtgaagttggcaaagcactgggtatcttgtgcggctgccgtggaaggcggccctgctcgatgcagggtctgcagtggcctgagggcagccaggcactgcatgcctgtctccttatgaggaaggctgcaaatttcagagaaagggaggtgaggtttccaccatgttggctgttgactctccctgtatgttaaacccttgaccagtttactcgtttctatcctggaagatttttaacaaagggaaaaaccaacagcaataagtcattggtgagcagctaactc

SEQ ID NO: 1413 - protein, 727 aa, Mus musculus
MEAAAAGRGGFQPHPGLQKTLEQFHLSSMSSLGGPAAFSARWAQEAYKKESAKEAGAATVPAPVPTAAEPPPVLHLPAIQPPPPVLPGPFFMPSDRSTERCETVLEGETISCFVVGGEKRLCLPQILNSVLRDFSLQQINSVCDELHIYCSRCTADQLEILKVMGILPFSAPSCGLITKTDAERLCNALLYGGAYPPPCKKELAASLALGLELSERSVRVYHECFGKCKGLLVPELYSSPSAACIQCLDCRLMYPPHKFVVHSHKALENRTCHWGFDSANWRAYILLSQDYTGKEEQARLGRCLDDVKEKFDYANKYKRRVPRVSEPPASIRPKTDDTSSQSPASSEKDKQSTWLRTLAGSSNKSLGCTHPRQRLSAFRPWSPAVSASEKETSPHLPALIRDSFYSYKSFETAVAPNVALAPPTQQKVVNSPPCTTVVSRAPEPLTTCIQPRKRKLTLDTAGAPDMLTPVAAAEEDKDSEAEVEVESREEFTSSLSSLSSPSFTSSSSAKDLSSPGMHAPPVVAPDAAAHVDAPSGLEAELEHLRQALEGGLDTKEAKEKFLHEVVKMRVKQEEKLTAALQAKRSLHQELEFLRVAKKEKLREATEAKRSLRKEIERLRAENEKKMKEANESRVRLKRELEQARQVRVCDKGCEAGRLRAKYSAQIEDLQAKLQHAEADREQLRADLLREREAREHLEKVVRELQEQLRPRPRPEHPGGESNAELGP

SEQ ID NO: 1414 - DNA, 98546 bp, Homo sapiens
  misc_feature (1)...(98546): n = A,T,C or G
gatggagtctcgctgtcacccaggctgaagtgcagtggcgcgatctcagctcactgcaacctctgcttcctgggtacaagtgattctcctgcctcagcctcctgagtagctgggactgtaggcacatgccaccatacctggctaatttttgtatttttagtagagacagggtttcaccaggctggtctcaaactcctgccctcaggtgatccgcccacctcagcctaccaaagtgctgggattacaggtgtgagccactgccctcagcctgttatttttagtttggaattctagtgtgtttctttattttaatagttaccaaagaaatacagatacatagataaaagaaacaaaaagaacccccaaagttagtacagtttaaatactgaaactgtagaatctgtagaaactattgtctctgtggaactcaccaagccctggccctcctttgctcctccattacggccctagcgtcagcttctttcaaagctttcacccatttttttttgtcttagctctctccatacttctcaattatgtgctcttgctgctcctccttggtttagcagctttatacatggtgagatgttactggagaatgagggttttgctcttatccaatgctccctgccccaccctaccatctcttcttctgtcttcccaaatgagcaatttcctcatttttgtttaagttgatgtctctattataatttgtactataactctctgctgagtcaagtagtgaactctgcttaggttttctctttatttttcctggagttagtagtggccttgctttcttctgtcatctgctgagtttcctctgtgcctatggcccatcccacctacctcttccaacaagccctccacacagtgtttgatctagtcagttgcatcctaccttccactggttccttgttttcctggagccctgtgtccttctggcttagtctgggctgcttactctctgggctccatgtctaggctggtgggcagagatttccatttccccttcatggactgggacagacccttcttagctcttattgttatgatggaagcccagttccagatcccattcagaaagggcctgtggccatgactcttgtctctcactggccttaaccagcagccctcagtggacgtgagaccaggcccaaggcttgcattggcagtttggtttccactcttgcttaccactgtggcttgagtgctatcttcatttctagctctgcacagctaccttccttgtgcctttttacaggacatttaaaaaacaaatctggccaggcgaggtggctcacacctgtaatcccagcactttgggaggctgaggcgggcagatcatgaggtcaggaaatcaagaccatcctggctaacatggtgaaaccctgtctctactaaaaaatacaaaaaaaattagctgggcatggtggcgggtgcctgtagtcccagctactcaggaggctgaggcaggagaatggtgtgaacccaggaggcggagcttgcagtgagccgagattgtgccactgcactccagcctgggaaacagagcgagagagtgagactctgtctcaaaaacaaaacaaaacaaaacaaaaaaaccaaatctggccaggcgaggtggctcacacctgtaatcccagcactttgggaggccgaggcaggtggatcacctgaggtcaggcgtttgagaccaacctggccaacatgtcaaaaccccatctctactaaaaaaaatacaaaaattagctgggcatgatgacgggtgcttgtaatcccagctactcaggaggctgaggcaggagaatcgcttgaacccgagaggcagagtttacacagagccgagattgcgccactgcactccagcctgggtgacacaacgagactctgtctcaaaaaaaaaaaaaaaaaaaaatggccgggcacagtggctcacgcctttaatcccagtgctttgggaggccgagctgggcggatcacaaggtcaggagatcaagaccatcctggctaacacagtgaaaccctgtctctactaaaaatacaaaaaattagccgggcgtggtggcgggcgcctataatcccagctactcgggaagctaaggcaggagaatcgcttgaacccaggaggtggaggttgtagtgagccgagatcgcgccactgcactccagcctgtgtgacagagcgagactcggtctcaaaaaaaaaaaaaaaaaaagcaaatctattttacccagcatgtgtttgtgcttggactaggaaggggaccctgcaccatcttggctggggttgtagcagatgctctggtgtcctgtggctcctccgccccaccctcacagcgccccactgcagggctgcagtcagaagcctcaggttgcagcctgcccgacagctcaagctcagcagggccgaatggagaatgtgtacctcctcctcctaacattgttaaaaataaaatttgtattttgacacaatctcaagcttatagaaaagttgcaagaatagtacaggaactttttttcccctgaagcatttgagggtttgttgccgcatggtgctcaccacaccccaaaacaaggacattctcctacacgccccaacacggctgtccaaggcgggaaatcacgtggagtcagaccccactctgggctttctggttgtcccagtaatatcccttgcagtaaagagatcagcctgggaccacacattgcactgaggtgccatcatgtcttctgtctccttcggtccggaacattcctgggcctttccctgactgttctttgaagcttccaggccaggccttttggagacggttccctgtgtggctttgtctgagatgtcatcacagagagacacaggttgtgcatctttggcaggaaaggagcagatgtgacactgtggtctgctcaccccaccctgtcaggtggggcaggactctgatggatccagtatcaatggagcccaccgcgatcgctcggttaaggtggggtctgtgtctccgctggaactgacattctttttccctttgtgacaaattagcattttgtggggaagattcctccctccctccctcgttcctccctctctccccctctcttttttagagacagggtctcactctgttgtcctggctgaagtgcactgatgctatcctagctcactgcagcctcggactccttggctcaaccaatcctccttcctcagcttcctgagttgctgggaccacaggtgcatgccatcatgcatagctactttttgttattgttgttgtttgttttatttttgagacagggtcttgctctgttgcccaggctggcatgtagtggcaacatgacagctcactgcagccttgacctcctgggctcaagtgatcctcctgtctcagtctctcaagtatctgggactacaggcctgcaccaccacacttagctgatttttaaatttttttagaagtagggtctctatgttgcccaggctggtcacgaactcctgggctcaagcagccgttccaccttggcctccccagaagtgctgggattacaggcatgagccaccatgcccagctgatacgtttaaaatatgcaaatagctctttttaaattttcaattcattaatatattttaataaatattaaaatatgtatagacatatgctttcctattttatttgataattataactcattactatcattaccatctattaatatcattattctgtctgatttggcaaacaggccgtgactcagtgccctctccatgtgacccggtgtgccttatgtcttgtcgttactctctctcccttcccagccctggggtcagccatctctttttttttttttttttttttttgggggacttttccctcttgttgcccaggctagagtgcatggcgtgatctcggctcaccgaacctctgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagcgagccgaaatcgtgccactgcactccagcctgggcgacagagcgagactccatctcaaaaacacaaacaaaaacactttggttcccttcagtgaatgaaaattgggagccaagactgggcttcctggtgcgctcactactgctgaggggtccctcgtcttggtgggcagagtgagggctgatgtttatacaaaacacatttacatcaacagttttctttataaatatggacatttatgagatcatgcaggtatcaataattccaatccaacaccacatgcttccttcctccctttctgtattttaacatcgagaaacctgactcttgctaccttaaactcatttcctgattggatcaacccccccactccagtgcttgtccctcactcccttgcgctctggccagggcagcccctgggatggctctgagccctgggttctgccctgaggattcagctccaggtgcccagcggtaagaggctttgcagatccctctttagggcccggcttcccctcccccgctcacttgctctgaccctttcctgtgcttccttggatcgcctcccaagcaaagcactcgaactcaaatctttgtcttggctgggcgcggtggctcacacctgtaatcccagcactttgggaggctgaggggaggagcgcttgagttcaggagtttgagaccaacctgggcaacatagtgagatctcatctctataaataaaaaattaaataaaaggccaggcacagtggctcacgcctgtaatctcagcactttggaaggccaaggcgggcggatcacctgaggtcaggagtttgagaccagcctggccaacatggtgaaaccccgtctctactaaaaatacaaaaattagcctggtgtgatggcgcatgtctgtaatcccagctactcgggaggctgaggcatgagaatcacttgaatgcaggaggctgaggctgcagtgagccgagatcgtgccattgcactctagcctggatgacaaagcgaagactctgtctcaaaaataaagtaataaaataaaataaagtaaaataaaaatctttgtctcagggcctatgtttgggggaatccaaagtaagacaaaggtctttctaaaatttctactggccgggcacggtggcatagcctgtaatcccagcactttgggaggctgaggcaggtggaccacctgaggtcaggagttcaagaccagcctggccaacatagtgaaaccctgtctctactaaaaatacaaaatattagctgggcatggtggcaggcgcctgtaatcccagttactcgggaggctgaggcaggagaatcgcttgaacctgggagatggacgttgcagtgagctgagatcgcaccattgcactccaacctgggcaacaagagcgaaacttcatctcaaacaaaaacaaaaacaaaacaaaattatacgaagctgatgttacttgagcaatttttattttcacatttgaaggtttctttcccagtaactgagcatgtttttgccaatggcagtctatgcctggctgctacaaggccttccttctgcttcctgaggaggagagagtgggtggcagcagggcagggcaaggcagggtggagcagagctggtctgcgatgcatttccccaccaaggtttccaagttcccccaaagcttggggtaccccttgctttgccagtgtcttcctctttctggtcctggggcgccatccaactcatctccacactgctggctccttaaggtgggggtctcaattccaaggccagcctcccaggaggccctccctgcctacagccagccccagccactccgcgccttttggggatctgaaagatctcgctcccgtactagcaggtttgttgattgactgttgtctctcacaccagaatggaaccacacggggtacaacctggtctccttaccctgatcccagtgtctacagtggtaggagctcatcgaacaaggggacaaactcatgactagctgaccaagcctgtcaccgtggtaggggccagggagaaagctgggaggtccctgcctttgcccgcatgccagggcttctctgggcaggcaccacgtccatcccaccctactccgcgctgtggctgtgcctgcagccttaacccgcggcctgccagtatggtggcccgcgtgggcgactggcctgggcagctgctgggcggggctggagggtggaaggccagcaggcgggagacaccccccaccctcttccctgccaagctcagggagaaaagtggaccctggtggctccctctaggcgtggctgctctgacccttggtggggtgggtgccttcctctggaagctctgacatattgggggaaggaagtctcaagagtccacaaaggtggaggtagcttcagagaccaactggaggccctcacctgtccccgcaccttcactccatggcacacctatggctacttcccaggggtccgcactctggacaaagtgttggtccctggctaggaccctgcaaagccagaggcacagaaggaagcagaggctctgggtgggcactgcccatgctaggggccctgcacagagcccctggtccaccagaggagccagaggaattctctgcttgattggagacacttcccagcaggcctggctgcaaccaccttctctgagttacaatttgactgagttgtatggaattcaaatccagatggaaggaagtgacaacgtcaagtgcaacactagctgtgttttgtccaaaacgtgggccaacgaaactatctccaggaaaacaaataagtcccttttctattttttttttttttttttttgagacagagtctcactccatcgcccaggctggagtgcagtggtgcagtctcagctcactgcaatctccacctcccaggttcaagcgattctcctgcctcagcctcccgagtagctgggattacaggcatgtgccaccatgcccggctgatttttgtatatttagtagagagggggtttcaccatgttggccaggctggtctccaactcctgatctcaaataatccacccgcctcagcctctcaaagtggtgggattacaggcgtgagcccctgcgtctggactgaatatcctttttttttttttagacggagtctcgctctgtcgcccaggctggggtgcagtggcgcagtctcggctcactgcaagctccgcctcccaggttcacgccattctcctgcctcagcctccctgagtagctgggactacaggcgcccaccaccacgcccagctaattttttgcatttttagtggagacggggtttcaccgttagccaggatggtctcgatctcctgacctcgtgatccgcctgcctcggcctcccaaagtgctgggattacaggcatgagccactgaggctgaccctttttttttttttgagacagggtctgtctcaaaaaaagggtgtgtccctatcacccaggatggagtgcagaggctcaagcacggctccccgcagccccaaccttctgggctcaagcaatcttcccacctcagcttctcaagtagctgagaccacaggtgcaggccaccatgcccggctaattaaaaaaaaaaattattttttgtagacagggtctcactatatcgcccaggctagtcttgaactcctgggctcaagcgatgcgcctgccttatcttcccaaagtgctgggattacaggcgtgagccaccttgccgggttaaatatcacttttaaggaaatgatcttcttacccagctttctggtgtgtgaacacacagagaaagcctggcctccaattgtgggggccaacggagtgaatgggaagagtcgggggacagcgtggagtgtgaggacaaggagacaacccccaaggcagcggagagagggagtatggagccgccctggggtcacctacaggtaggtcctggctgcctctctagacacctgccctgccgcaggtccggccaagacctgcacagggactccgggccggctcccccaggataggaactgcgcccaggagtgctggtttgaggcaggttccagcctccactggggaagtgaggggcaggaggtcccagctgaaggtcactcaggttgcagcggcgtggccctctcgcctccgcccagcacccaggccagcttgggcacccccggcccgtggggcatgtccctccgcctcaggcgagcacagaccgagccctgcccctccccaaacacaccattgcgtccctgcgcccgcaggcctcgctggaagctgcctcccctggagaccacccggccgactgtccaacttcggggccccgggcttcccgctccccgccctgccaaggcttgagtctctcccactgcgtggccaggcgtggagggccggccgatccgaccccgaaagacgtctcagcgctccacggccccggggcggaggtcaggggtctcgccggcccgaacgccgggccccgcggggccgaagtcctgataagccacctggcaggagtggctggcagaccggctgcgtctggggcaccgggcgccgcccctcccaggcccgaagcccccggcccgcgcagcagggacactccgccaggggccggcgggcggggcggggccggcgcggccgggagccgcggacactcggccaccgagccaccggccacggcgcagcgggggccgccgggctgcgccgccagggtcacgcgacgcggtgcccgtctcggcgcagggtccctgggcgtggccgctgtccccctcgtgtgtgggaccccaggtcaccgtgtggcgtcccggtagtgtgtgggaccccagaggcgtccggggcctccccgctgtgtggtgtcccaccctgggagaaccccgggtgcgtggcgtggccccccggccgcccccagctggtttgcggtcgtggcgggggcctgtgggtttctgggccccgacggcggcgagacgggcgccttcccagcggcgcaggaagcggcctcggccggaaggggggccccgggcgccaccgccgcctccgcctccgcccgcgcccagcggccctcggcgggcggggccgagcggggccgagcggagtcgagcatggccgagcgtagccgagtcccggccgagcggagccgagtcatggcagggcgggtccgagcgtggccgagtcccgggcgagcggagccgagcgcggccgagtccgggcggggagcgcgcgttcctggaagagcccggctggggagcgggtcacattcttggccagcgctagggctgaggcggacgcacggcaacaaacagcgcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtgagtggccccaggcctgggagctggggaggatgcgcttggggtgggggccccttctggactacaggctctggtctccgaaggctgggacctgtgcttctgccgtgccccatgtctccagtcttcgctttgttttagggaaattcagagtgttccgactggcagggccagagagtttggtaggaaggccctcctgcccgttccccaggacgagcctggagtgcgggctgtggcggtggggtggggggccaggcctggtgtgtggggaaggcccgcaggcccacaggcattgcccagataggaaggcacaggcctcatgctcccgagaaagcggcctgccccaggtcagggaagttaggtccagctgggccacggcccggatgcctcaggcccaggtctttcttggggttggggtgaaggtggctgtcctcgccccgaaggcacccagcctcgaagacggagggctgcctgcctttgggccccaggagacagagcttgggtgaggcgaggcctggttttgttactggctcccgctccctgtttggtgccttgaagttttgggacacagacacaaaatgaagccaggtgtccaggcttcagtggcaggggcccgagacttggcggctccagcactgtgctggttggtctccctgggcctgccagggaccaaatcccagagtccgccgtgtggggtgagggccatttggcacccggctgaggggcctggtcagcaggctcctgggcccgcgtgctggagttactggcggcctgcgatttgctttggactcacccatttccttctctccctctgaaacgcagaggggtgcgccggagagggaggctgctggcctggctttgttgtttgccagttggaggatctatgggatccggcatgggcagctcccaggccacgaggtgccgaaattactcagtggggtcctcaggaactttccgttgcgtacctccccaagtatttgtaacttttcttttaaatatccaggcttattaaattgcacacacagaatgctgcattggctcagctattcttgggaggcctaattaattcagctattgcatcaaactttttttttctaaatctgtgaatagatgctccagcccggttttctctgggcgcccctccagcagagtgtcagatcgtggggaggaggggctgtggatggaagcgagggactgtcgcctctgctcggagggggctgcggagggtgcatgtgtgtgtgcatgtgtgtgtttgtgtgtgcgcgcttctgaccctgccaggccagggctcaggtggcagccgcctgcagacctgtgggctggggaaggatgctcgtggcagagctgcagacagacgtagcaggctggggcccttcgtgtcacacggggagttggttggggtgggcccgatggcgctccctgtgggctggggcctttctttttggggtggccgcaccctcgtcagtgcctgtggctggaggaagccacatgtcgggggggattgtgggctcgtgcaggctgcgtagtgggtcacctgtggccaaggcctgagctgctgggacacgctcacgtcactgtcttcagagctgatggcagaggatctcggttgagcagggtgtgtctgcgtttgtttttgtccgactgtgggtcatgtgtgtgcttgtggtctttctgtcttcctgggctttgctgggggcccattggagtggccagtggggcctcgttgtcacagctgacacagagcagggcccaggccacccggcttctctctctctgtggttgtgagcgccggggtccttgggccgccatagagacaggccagacaggctctggtcatctcagcggatgcctccgagccgcctttcccttttgaagtccccagcactgctctgaaatttcatttaccgattaaaaagcaattcccaggccatactgacgacgtgcacggtgtgagtgactgcgtcctctaggcctgagtggcagccacacagcctggccctggcagtggtgtcctccgcctggctccctgaatgttcaccagctcctgcgggttttcctctcctcatgctcctgggggtggggcacccatcctgcccgtgttgcctcctgctctatgttcttgacgtgggatggcggccagggactctgccctcgctcagtgcctgccctttaggctctgtgactgtgcacttgggagttctgggcttcagggtccccttaagtctcctcaggacagccgtgtgcgtgtctctgtgtgcacaggagcgacacatgagaagggagtgtggtctcagggtgggcgtggacccacagtgcccagaccctacttgtcctagaaggagtggcctgggaggccccgcctccgccctcactggccgccgttggctcctcccactcgtgtcttgacagcttattctcgggatatgttttgatttcttcacttcctttgtagcttattttaatatttttgatctgccgaagatgagggcagaacaaagaatgtactggaactctctttgcagggctgctgctcccagcaggccttcgggctctgcggagccggagggggctgaattgccttccgggtgtttgtggccaggccagggtcgggtctcctgcctgagtgggctgggtcagcgccactctcctacccatggtgggaggtgggagagggcggagatgttcccgggtcccaaaccaagtgggaggcagggctgcagctttctccttggaagcctcctgtgacagcggctgtgcctgagcctctggcctgtcggcagtgcagtggcagcatgaggggcagacagtcttcctccagatgccccctcatgtcacggggttacagaggaagcctccgcttctgtccagtggctgtcgggcccggccagcttcctgctgctgtatcttggaagaccatgtgggctgcatgggtgcttggcgagtctcctcttagggaccctggggctgctatccttgacaggggaccttgtctcacctccccactcggtcccacactggctttgtgaccttggacgagttgcttaacctctctgcctcagtgtaaactggggactactgtttattgatcttggactttatgttttgagtggtacaggtggggcacagatgggtcattgtgctgctgggagcacttagccaagactggagcctctgagccttccccactcccacccctctttcttctttccggtcggctcgcctccttcctcgggttctctgatagctgtaggactccattggactacatttttttgtcagtatagacagctgtcagagacggagacaaaatgtggcagttggagctgccgcttggcctgctgcctgggacgcggccccttgtcccgcagaacgtcagccaagcgctttccgtgcaggctgataacagggtggtgccgtgcttcccttgggccgtggcaggatcctgctccaagggggggtcctgctccgagggggccggggtttctgttccaacagggctggtggggggggtcctgttcccagaggtccgggatcctgttctgagggggccagggtcctgttctgggccgggggtcctgctccgagggggccgggcgtcctgttcctaggggcggtgggctgcctgtgtgagagctgttcttcacctgccacgtgcagtctgggcattctggtgactggagaatttgggttgtgttacagtgttgttgctctgtcctgcagatgcctgaattcccaggggtcttgcaggtccccttgcccttgctctgtgtgggctggcgtgggtctcagtgggctgtgggttgagggtcgcttggttgggaagctctgcgcgcttcccagtggagggtccgcgacgggggttttctgatccctcatgctggcttttgacccgtgtcactgcaaggctgcccctggccccaggcagcgtttcttcaggcaggtgcccagccaggtggtcgggcttgagacctttgagtctcgaggtctgttctggggaatgactgagcttgtggaggccaggaaggggttgctgggcttggagagcctctggggaggagttgtgttttgctctttgctgttttaagctgaaatgatcacaggaagggacagcatcaagagtttctttctgggacacccctcactcagctcagcggccgtgtgtgggtttggggctgtgctctcccagacaccctcaggtccggggagcacttcgggggctatctgtccctttgtccaccagcttcctttggaaaaagtgtttgctgcaagtgtttttctccagcttttcgtggggttccctgtagtcttgggccatgctctggggtcaggctcccggcaggccctggtccccgtgcagaaggccagggtctgcgggtttgggctggtctgccccccaggtgagggttccggaaagacggccggctgctgagtcttctcaagcaggggaaacagcagctcgagagtggttcttgacctctgcccaccccagctggctgtgcacggactggggagggcatgggcagctgcccccaggtggcttctgcagggagcagagcttagtggtcattttcccggcatggtctgtcatccgtctgtctgggacccctctgggagctgggctgggtccctcgccttctggggcagcagggtcacggtgggggggctagtcctctctttcagcatcttgtttctcagccgtccctgcggctatttgtgcaatgtctgtctgtctgagtctccgggtgagggcagacaggatatggtgcgaggaagtctggggtaagtgtgagccgaaccccgccctggagtctctcggggttgtggggccacagccccagcttaggttaggccttcactgctgctggcagggcctccagagagaaggcggtggttccggggcctgggccctgactgtctggcaggaggtgtccacgccggcggcccggctctctgtggcaataatgtgtctctttctaaggattgcgaaagttgagggaggatttctccactggaagaattatgcaagcttcaactgaaatgtttttaaaaagtttctttgttttgagtcaaaatacagaaggtgaattatttccctaatatctgggagagctggaaaagaaggcccctgtccttattcttcagggctcttcccctcctgagcagtggtcaccaggccagggtgtcatggagggggggctgcctggggaccagctctttacacctggcctccagagcgggtggtagggcggctccttcctgccctgccctggctgtcaccctcgtggtctggagcagggtttttttttgttgttatttttttttttttttgagacagggtctgtttctgttgcccaggctggagtgcagtggtgcgatcttggctcactgcagcctccgtctcctgggttcaagcgattctcctgccccagcctcctggtagctgggattacagatgtgtgccaccacacccaagtaatttttttgtatttttagtagagatggggtttcaccatgttggccagcctggtctcgaactcctgacctcaagttatctgcccaccttggcctcccagagtgctgggattacaggcataagccactgtgcctggcccctggagtgggttctgccacggaaggcatccccggggtctgcgggctggaggggtcgcccccactgtgccacctgttctctcgaggcctggttgccctctgcagaccaggtgccatgccaggtgaccctcaggaagctctggctcaccccgggggctggggggcatgataagcgatagctcttaggtgctgctgctttgtgaatatgagagagttccagaagggccccgcttcccagagcctgcatgttggtttcactgtgtggtacttgatatttttccaggctgccttgctggggtggcctcgatggggggcccagggagcctccagctctggggacatgctgccacatgagcctgcttatttacgaaaatgaagaaccaggacttgagtgtgaattttaaatgagattgtggggacaatagtaaaatccagactaggaccagatggactgagcacctgcgttggccatggcccggaggtggcgtggtggtgcctggcgcctgtggccctcagcatgtgtcctgccggccgcctagtaggccttcgcttgaagtgcttattcctttgagtaatgctcctgtcttttgtttggggggaaacagataaagggggctttgagaggcgtctcggcgtgatcctgggaaacggccgagattctgttcggtgcttggtgttcgtgtcttctctgattttacctttttgactcataaagatggaaggagtgctctgcctcggtgcctctgcagctgcagatgctgaatcggggcgtttaggcctgcctcttgggctggcacacctggcggccttggtcaggccttcttgggctgcctctgctggggtgcttgtctcactggccgtgggggttgttgcctgtgtggttgtgttgctggcttcaggggctagggttagggacgcctggtcacgtctgggtccccagtttgggggccagattcaataactcactgaatgactcagtggaactctgcaggcactggcagtcaaggtttattggcaggtccattctttggctagaaggagaatgctgtttcttttctcactgtttcaccatttttttttttgagatggagtcttgctctgttgcccaggctggagtgcagtggcgtgatctcggctcactgcaacctcagcctcccgggttcaagcaattcccctgcctcagcctcctgagcagctgggactacaggtgcgtgccaccacgcctggctaattttttgtattttagtagagacggggttttaccatgttggccaggatggtctccatctcctgacctcttgatctgcccacctcggcctcccaaagtgttgggattacaggcatgagccattgcgcctggccattgttccacctttggaagaaattggttcaccgtcttctgacctggggggcgcttctaccctggttccatattgagggctgggaagttgctggaatattattacccttggctggtgaggctgagtgctgatgctcctcccagctctcagccctgcctggaccaactgcggcttctgctggaacgtcggcggctgacttagaaagaaacagctcctgttctaggcttcctgcaggtcccacggtgctgcttgtttcagagaaacgcagctcaggctggcggcctcaggtgggcatgggtggcaggggatgccatcacccaaatcagggatctttctctgtcctgagggttccaccccaggacccagggcactaactgggttcttgtgtggcccttcccgaccagacctgacccctgagctgcgtgtgtgaggtgatggtgactccacgacagcttgtgtgccgttatgggggcacctgaggactggctgacctcaccgggaagtgcgtcaggagtgggtgaggggtggtgggagggcagggagcgcccagcaggtgtccagcggtgctggcgctgcctctgtctctctgtccacgccctgtgtgtatctggagtggcttaggtgctccctgcggtgctcctggctgctgtggttcctgaaggctgcggctgtgccggtggtttcctttgatgtcagtcttcttctacaggggaaaccatgttgccaggagagccaggtgtccgctaattacgttgtgttgttctgcccaggagtgaacctgtaagtgatgagaataagaagcggctgtcagcctgcagacccgccctcaccctgtcctggttggggtgctgcctgctgggaacccctggtccagctgttgagaggaggctgactgggggcacagttgttgcagagtctgatgcaggctttctctgccgggaaagtaacatggaaacattgttgcttttactatggagcagatgtatctttgcccagaaacagaaatgctcttggtttctttttttggaaataaggcccataggctgggtccttcttgccctgttgagggaacgtgtctgtccttagcgtggaggccagtctggccgggtgctgagctcgtcctgcagaacacgcgtgaacgcctcatccctgagggccccgggaggctggcgccctctgtgggaggtctgaggttggcccatttgaccctatccaggacgggttacttaaggagtccaacgggccttgagaggctgatcaccctcgtgtggcgggcgtctctccccggtgccctcccgcctggtgctgtcaagggcttctctgtgccaggcgctgggctgtggcagccccaggtccccgcctggtgtggctgcccacggtccaggcagctccagggtgggcatccttggctccctccctcaccagctggccctgggaggtctgtctgagaggagttaggcctcattgtccgtgctcagagaacccgagccttccttaggaagcagtttgtccccgtgcctcccttcaggatcctgtggcctgagaagcctctgcgtggcagtggatggcagctccagctgcccgtggccctctttttttatggtttcccagatgactgggccaagctgggcctctgcatcctaggcatgctgttccctgcgcttccctggaaggtcggcggccctgcgtggacctacacggtacccaggacaggcctgccatggcaccggttgggcctctgggcacagggtgctctgcctccatggccctgacaggctctgatgcctgaggatgggggccgggcactcccagccttgagacttccctctgcagaggtggcacaagcccggggccccagagtgaggggactcttgcctgcctggtgagggtgagcgtggggtctggactctgacccctggtccaggcgggagaggagcacactggacagggcagccgagccaccctctgcggagctgtggacactgcgtgtgtggtgctgaaggtgtacacgtccactgaggccacctgcgccgctgcctgtgtcctgtgggctggcactcaccgagtgagagctgtgtgcagaacctctgctgtcagcgggccaggccacactggggagggaggtattccgtgtgcttgcactgaagcctgccccaggctgccttctgggttagggatacccaggacctccatagctggtgtggcgtctgtgagatctcagctgctgcttccctggacgcccgtgtggacctggaggggggtggggacccggcctggcatggtccctggccacctgcctggtgctccgggttgtgccgttggcagtgccttcgctctgcctcacctgctgcctccgcctttcctggctacaaccctgttgcccaaaccattaaaaaaattatactaccaagttgaatgatatgcaaatgtagtcaattaagcgaggggattttaattagcagtttaagttcatgtgtgaagtgccttgccttaattacttgacagttttgttgtaaatttgctaagtttttttttgcagaactatcaaaactgtgatttttgttaacattcttggatgcggtgagtggcgcccagcttgcctgaccctagtgggttttgtcttaatttataaagctctttaaactgtgaaaacaaggtaaaccccctgggttgcctctgtgtggctcttcgagtcaagccgggctcgatgtcttccttgtcactggctggggtggggacctgcctcgtgcgtggtcttgagctcccgttgggggaacgggagaaccttcatcccatgtgggtgtagccgttggcggcacctttgtacggggacacaccctggacctgaatggagtcaggaagggtttcaacctggatggcccgcgtgccggggacccgcaaggtgtgcagtggcaagggccggtcctggtggcgggctccctggtgatgctggtggatggttgtgcgtgggccttggggttcacagttcagtttgggagaggcgagaacccctcactttgaagtctttcctggccaacgggaggcttctcagagcagctttcacggctccggggctgagtgaggcctgtgtctaggctcatcctgccctccggggcgtcccagtgtgcctgggcagtggcgcagctggctccttccactgggtttaggtgtgcttctgctccccactgctgcttcagctgcgtcctttgcgggtccccgtaacttcagtgcccccacccctgttcggttccctgactgagctcggcgcctctagtgtagatgggtttttaattttcccagctgaacgtcgttatttggattgtgatttctttggtgtttcaatggactgtagatgaaggaggacctgttttctctcaggagtgtctgtggggtctcttgtcctggtttgctcagtgaagtgtggccccaagggctgagggaggtggccaggaccccgcagggtggcccccaccacagaggctgctgtcctccgggttcttctccactttctgggaccttggccgaggaggcctctgggagggtgaaatggccacaggcctggagaagcgacaccggtgggaagccaccggcagagaagtcagggaggagggagtcctgggcctggaggaacgtgggaggggcaggcgcctcctagcagcctcaagaaatgtgggccaggcaggtctggctacgggcaggagtgtgtctgggactctgaactgccagaagcacttggcggcaagccacatgctgtcacaatgttgcctggcccccatgaggaggtcccgtgggtggtggcgggtggtggctggttgtggggcaaggctgcgggactgggaccgctggcttcctggggccatcgaggctcccagaagaagaaatcaagaggattttaagaagcagagttctctttagcccgaagtaaccatacagcattaacaagaaaacttggaattcttcgaagtgaagctctctctacttgttcggaggatggaggacagttctagatccaggagagcggtggcgcagacacggacttcacccttggtgggaggggagaagcacagcatcctgttgttcgtgagtcaggtgagaggcgcgagaaaccacagctcttaggaaaatccgtgctgcccagtgtgggggccgtccacagcccttcggcactgctggggaagtggccctgcgtcgaccccaatcctcctcagctgtgttcagcccctgagatgccctgggctccctggttgagctttggtgggtaactgcaggatgcacacaggagctgcaggcgagggctttgtaggagctctgtggccgccccacatccctggcctctgccattttctgcctaaacgttgacacatggaagagggagcccaggatgctgtgggcccagaaggtggggccctgcgggctccatcacttcactccagggcacagagggcccagggtcccctcacacttgcctgtggggaccagtgggaacaattctcattttactgtcattatgaacttgcggcttaaatatgtctgtggacttcaaagtgccatcctgtgtggaaaatttccagctttcactgaagtagagagattagctcaatgcaccccatgtatcccgttcaccagttatccacagctcactcattttgtttcatccaactccctctcctattttgagggggagggattgtaattttttttttctttgagactgagtcctgctctgtcgcccaggctatagtgcagtgctgcgatctccgctcactgcaagctccgtctcccgggttcacgccattctcctgcctcagcctcccgagtagctgggactacaggtgcccgccaccgcgcccggctaatttttttgtgtttttagtagagacggggttttaccgttttagccaggatggtctcgatctcctgacctcgcgatccgcccgcctcggcctcccaaagtgctaggattacaggtgtgagccactgcgcccggccaggactgtaattttttgaagcaaatcccaggcatcatcttatttcatatttaagtgtttcaatatccacatctaaggaatatggaatcataaaaaacgctcaccatgacccattaccttgcctaacaaagctgagggcaatttccggacaccagcccatgttcaggtccttcctgtctcagaagtgttttcctgctgcttttcgggacccagggacagcactgcgtgcgatggatgggtcttccgtgcatgcctgtctgtgtgtgtgtgtgtgtgtgtgcctgtgtgtgcctgtgtgtacgtgtgtggtgctgtgatgggctgtggggacagtcccgcgtgctgacctgagcctggcagagtcaatatcttgttgggaggcagcaggccaggagagagcggagctggttggaggagggccagcctccccacctagagaccgtcggtgaccttcctcatgtgatgcgtcccttggtgtggcccccagccgctagtggtgaacctctgtaaatgtatgtgaacacttcccgtgcatgtctagtcaggagagtaatcagagaagcaattggtatgtgctcatcaaagaaccccagaacagccgagaagagtgcagagggtaaccccttctctgtctttgttcttggtgggttgggggagaagtacagtgtcctgtttgttcacgtcaggggagaggcaggaatgtaccacatctctgtcgctggaaacgtgggaagccgggatgtggcctaccgtggccccttctggccccgcaggggagtgggtgtccctgccctcactgtaatctctaccacattgatggaaagatttttctttttcttatttttggagacaaggtctcgctctgtcatctgtgttggagtgcagtggtgtgatcccagctcactgcagctttgacatcttgggctcaagagattctcccgcctcagcttcctgagtagccgggactgtaggtgggcatcaccacgcctggcggatattttttttaattttagagatgtgatctccgtttgttacccagactggtctgaaactcctgggctcaagtgatcctcctgcctcagcctcccaaagtgctgtgagccaccactcctggcctgaaagtatttttcgtaattggatttttccatatgtgcactaaggtctgcctttttccctgaatgaggcataacaagtatttctgtggctgtgttctctgtgggaatattattgtgacatgcttgtaagaagtaagtgaaaagcacaccagcacggtattcacatagcacagaaggttataaaaggcaaacgcagacatgggtgagggcagagttgttcttggtttgtcacaagggcgtgtgaacgcggttccccacctgccctgctctgctcagcagctttgggatatgagtgccttgggtgcctggtgcctttttgggccagccctgtggtattttggagtatccgttggtattgagagtctggaacttacttagtgtctggggcatgggccgtgttttggtatcgcaagagatgcttcagggcgcgtgtcagcacaaacacatcacacgggcttcgtgaccacgtgctggctgcacgagatgtcagtgtgctccgcgtaccacctgcttcatccccgccctgccctctcgtgctcctcggcagggggccgccatccttatgccccgcctgccctttctgcagctgtgggtgcaggctggccgttgtgctctgttgcaggagctcctgtcaggctgctggtctgcgcgtgtgctctccgagtgcctgtcactctggctgactcactgtgtcagtgtcaccgtgcagctttgctcgtcctgttcttgtgccttgggacgagtgggcagagtgcttgctgttgggtaggctgtggtgcaccatgtgggcctgggagtgaaacagcttggtcagagggcatgtcggtcacgccaggctgtcttccaaagcgtcccaacactccctgtcatcggtcttgttggctgtaaacgagttctctgctgcatgggatgctaggggtgtggtgagtttcttgtagacgtggcaggtcagaggggaggcacactgtctgccaggcaccctgttatttactgatacacgcacacgcaatacacatctctatagattgcttttgtatgttcactcagctgggatgattctgtgtgtgcttagatctttgttcacgtttctgatcatttccttagtggactctgagattcccctaaaaggtgggattgttttacccaaacttttctttctttctttctttctttttttgacacagagtctcgctctgtcacccaggctggagtgcaatggcatgatctcggctcattgcaagctccgcctcccgggttcatcccattctcctgcctcagtctcctgagtagctgggtctacaggtgcccgccaccacacccggataattttttgtatttttagtagagatggggtttcaccgtgttagccaggatggtctcatctcctgacctcgtgatccgcctgcctcggcctcccaaagtgctgggattacaggcgtgagccactgcacctggcccctcctgacaactttaagattctgtcatttaggctgggcatggtggctcacacctgtaacggggtctcnnnnnnnnnnnnnnnnnnnncaacttttaagattctgtcatttaggctgggcatggtggctcacacctgtaatcccagcactttgggaggccaaggtgggtggatcacttgaggtcaggttttcaagaccagcctggccaacatggtgacaccatgtttctactagaaaaatacaaaaattacctgggcgtggtggtgtgcacctgtagtcccagctacttgggaggctgaggctggagaatagcttgaacctgggaggtgaaggttgcagtgagctgagatggcgccattgtactacagcctgggtgacagagcgagactctgtctcaaaaaacgaaaagcaaaaacaagattctgtcatttagagtgtctttgttaatttgaaaggtgaaaaatctcatcatttagtttgtatttctttgctttttggtgggttgattgttttgttatttcagtatttttttctgtaacttgtgcatattacattttcttattgtggcaaaataaacataatgttgaccattacatgtagcattcagcagtgttgaacacataggctgacagtgaaggaatggaaaaagacatcccatgccattggtgaccaaaagaaaacaggagtggctccatttgtatcaaacaaaatatacttttcttcagaaactattactagaaacagaaaagtagttacagaacaataaaagggtcgaatcaactggaagatctaacaataatatatacgcacctaacctcagaacagctaaaactgtaaagcaaattcacgctgctgttcacccaccttcccaggctcagcctttgtccccatgagacactcactccccattctgcctcccccagcccccaacacccacccgccgctttctgtttctgtgactttggtgactctaggggcctcctgtgagtggaatcgcacaggatctgtccttttgtgacagcttatttcactcagcaccatgtcctcaaggcgcagccatgcgtagcctgtgtcacagtctccttccttctcaagactgaaccgcaggctgctgtatggatgtattttgtttacccatttctgtcagtggacacacgggtgacttccacagtttagctgtcgtgaatgatgctgctgtgagcacgggtgcacagtgacctctggagaccctgccttcagttctgggtgtagacccagaagtgggattgctggatcattgatcattctatttttattcatttatttttgagacagcatcttgctctgttgcccaggctggagtgcagtggcacgatctcggctcactgcagcctccacctcctcctgggctcaagcgattctcctgtctcagcctcccaagtagctgggactaaaggcatgtgccaccatgcccagctgatttttgtatttttagtggagatggggtttcaccatgttggccaggctaatcttgaattcttgaccttatgtgacctgcccgccttggcctcctaaagtgctgggattacaagcgtcagccactgcacctggccctatttttccttcttttttttttttttttttttttttttgaggcagggtctcactctgttgcccaggccagagtgcggtggcacagtctcggctcactgcaacctccgcctcccaggttcaagtgattctcctgcctcagcctcctgagtagctggggctataggtgtgtgccaccacacctggctaatttttgtttttttagtagagacgggtttcgccacgttggccaggctggtctctgactcctggcctcaagccgtcatcccgcctcggcctcccaaagtgctgggattacaggcgtgagccaccgcattcagcccgtttttctttttaaagaaccgactgtttttcatagtggctgcagcattttccactcccagcaacagcgttcgagcagcactgtctttgcatcctctccagcacttgttctgttttttgacagcggccatcctaatgggtgtgaggtggcatctcattgtggttttggttctcatttccctgatgattagtatgttgggcattttttcgtgtgcttattggccactcctatatcctctttgaggaatgtctgagtccctctttgagtcgagttgtgtgtgggggcctttgctcagttgtacgtctttatctactctggttagtgatcctgttctacttgtaaatttctgtctcctgtttgtctactgcgtgcaccgtggtcggatcctgcctctgttgctggaggctgcctctgtcctctgctgtggtggtcaggaagctggagcgtctcggcgccagattcatgtttgtaagaggagacgctctgtgagcctcggtgtgcagcgctgtctgcaagtcagactccccacccctcctttgtgcgagctgggcgggggctctgccgggactggtggtgttcatggagagggcttctgtgtgatgaagagatgacagtgacctgctggggccgaaggctgtgagtgccattgggggagggagtctcagagagtgcggcagtcgggcctgatggggctgctcttctgtgaaggggcacctaccgtgtgcctggcctgtagcagcagcaaagaggaacctgatgggggggggcctcaggaacctccacctcgcccactgtggccaggctgcttctgctttctgggaggcctgtgcaagagccatgggcacaggccgggcacggtggctcacgcctgtaatcccagcactttgggaggctgaggccagcggatcacaaggtcaggagttcaagaccagcctggccaatatggtgaaatctcgtctctactaaaaatacaaaagttagccaggtgtggtggcatgcacctggtcccagctacttgggaggctgaggcaggagaatcacttgaacctgggagtcggagtttgcagtgagccgagattgtgccactgcacttcagcctgggcaacagagcaagactccatcttaaaaaaacaaaaaacaaaaaagggagccgtgggcatgtgtgtgcacaggtgtgcatgggtgtgtgcagctggagagggaagggcctgggtcaggggcgccctcagcctggagccagggaagggcagcgagaggaccccagactcccaaatgaccaagggcctgtttgcagcgtgcttctccctcctttcttctggctctgaagttatatcctgccagatcctggagaaagttcttttagcaaaatgatggcttcgctgaagatgatacttgccacctcacagaagcctgtcacgttcctccctttggaacccattgccaaatgtgggtggtgtggtggacccggggcaaggggccattctctggcagcccctagaaatgcctccctggggttggggtgcagccaccaggcaagaagtatgtacccccttgccctggccacttggggtttctgggacaatctgctggcttggccttgactttttcctgaacctaggagcccagggcctgctcctggcatcaggacttgctcttcctctttcctgggccccacaggtgcccttggggagcacacagctgccccagcccgagtccagtctggctctcgggaaggggccttactgctggctgcacaccttggcctccttcccctggatgcgccattgccaacgcagctgggacagcccttggacgcagcgtgcccgccccttttaccagggcatgtgggctgggaccagtttcagccccatgttgacttgtttggctctgctggtggtgacgggggggcgcggtggcggggggccttggtcgcgtcgtgtctgctcttgtgcaccggtgcctcacggagaggctgtggtgagtgcgcggaaggaccctggtgcttttggggactttctggagcagcccacattccttccccagagccctaggggcctggccagctgcctttccaggccctgaggccaccaggttcttggggggagctcctaggttctgctttggcctggctgggtggtgcccacactgccgcgtcccctctccggggctgcccggactcagcctggctggcagccatttccgttacttggtttccaaaggccccatcttggaatcaggagcaggctgtgggactcagggtgggttctgagcttggtgacccgctctgctcttttgtccggctttgtcctaactgttgaatattaatgaggggcgccgcagggtggctctccagtggagggtcctcactttttgttttgcaaataacgctggggcccctgcgccactggggcaatgcaactgtgacggtgctggttggattcaaaaggaagcctggcagtggcggggcctggacaggcagcctttgacctgaggcggggcggcgctctgcgctggttcagaaaagccgtggggcagcctctctggcaggcactggctgtacctgttggttttcctttgcccacagtgaagtgaaagtcactgcagctgggtttgctgtttaactcactgtctttccttctcacgtcttctctgtgcaaatagtggtcagtgtactttttgattatttcagtcaagtggaagtttctaggagcgtagagaggcagcgtggcttagggtttaggagcatggctgggctaccttcctactctgagtgtgggccacgttacttttctaggcctcagtttcccattggcccctctcctgtttggaagaggcagctgggtcccacaagccatctcaggagccgcgtctgggcgctggcacggggactgtgcccacagccagccagcctggtggtcagctgatggattcccgtaggtacttagcaaaatgcctggagtgtgcgaggctgtcaggccagtggcagatgcggtcgagtgctgttgtttcttggtgctgcctggcactgccaccctgatggtcggctctgagttggaggccagctttcatggcagcgttgttggtgggcgtgcagggtgtgtctgacctgggcctgggcatcaggtcccattgtggttgggtccacagggccccttgcctcattcgtggaggtgctgggggaattctacaggctgaggacgtgtgaggctccagggtccagcgtgcaggccggatgttcctagcgttgccggccacgcagacagccgtgccaccaggaggttccctggcaatgggagacaattgtctgctcagttcagccttcagtgccccagggctgttttgagatcaaggctgagggggaccctttcaagtgtctctgcctttggtggtcccgggtggccggctcctcacccatggtgtggtctgagtgggctgaaaccgaccccaggtgattcttattcggaagagatgtttctggaaatgagagcaaggcagtgagtggagagccagctgagagatgcttgactccccacctgctgctgttggggccaaaagcgtggaggagggaagagccagcacagagggctcacggtgtcccctgctccaaccgactcactggccgcggcctcatggggcctccctgtcctgcctcctgctcaacaggccacaggttttgttggattcgtcaattatgacccaggttgttgaactggaattggagatgtttttacagttggagagtttgttacagtcagaacatttcgggttgttggagttcggtgtcttgctgctgttgcagcttgcatcttttggccacagtttttttttttgatacagtgtcactctgtctcccaggctggagtgcagtggtgtgatcttggctcacagcaacctccgcctcctggattcaagtgattctcctgcctcagcctcccgaatagctgggattacaggcgcccgcccaccacgcccggctaatatttgtatttttagtagagacggggtttcaccatgttggccaagctagtctcgaactcctgacctcaagtgatgcagccgccttggcctcccaaagtgctgggattacaggcatgagccatcgcacctggccatggccacctgttttaaggaaaccactcagtgtcttaaaagttaagggtgctcattgccctgctcaacagagagtcccgtgtggtgctgggtagccctcgtgccgctctctggccgtcccagaacccgctgtccgttcccagcgtgtcctcgagtgtggggtggccactgctgcccaggtatgccactgtccatggctgatggaggagcaggaagtggcccatttgcaagcctgctgcctgtccttggtttgggtctttttattttgagaaatctccaaacctacatacagcgaagttgcaggaagaacgtggtgagtccccattccctgagctcagctgctgctggcactggcctcctctcgccacgactgtttttgcaactttttgccggtcatttgagagaatgtttcagtcagtggggtcctccctgctaagcccttcattctgaatttctaaaagtaaggggatgtggtgtgtgaccgtgacacggtgaccaagtctgggaagctggctcccctggccacgctctgccgtgtctgccacgccctcttcagtagtttacttctgcctgggacctgcctggcggctcagctgactcttctcttgggcctgcctcgttgccctaggcagctggctgcgcgttggcagggcccggacgggcaggtgggtagcggcagccccggggggccggtgccctatcagaggcgtgggaggcatcaggagcaagcggcccccatgcttttctcaggggagcctctcccttggtaattaatgagtaatccgccgaggggaactttggaccccaaaagtcccctgtccccatggactttatccgggtgggccaggatccctggtgagtctgcttgtcttagggatggggacgtggggcactgaccgcactcttggccactgctgctgctggagtctcgcctttctcctcccgcctgccttcttgccgtgtagtagcgctgcggaccgtgttcggaaagagtcacttactgtccgttctagtcacagttttgatgcccaagttgaccttctgttggctgcccacaggtctgggtatctgctgatgttcttttatttatttattttttgtagagatggggtctcactctgtggcccaggctggtcgtgaattcctgggcttgagccatcctcccgcctggtgtcccacagtactgggattacaggtgtgaacccccgctccctccccctgccccagcccctgctgaggtcttatttcagagccggcagggttttcccagctctcaagcgccctcacgtcccaccacagtgacgtatggtgtgttcactcctgtcctggtccccaggtcgtgtggggccatcgaggctcatccccagctgcagccgccctcctttccctgtagagccctcgcctgtgtaacggttactgcctctgtgtgggcagcatctgggggggctggcgccgggcagtgggagacctgctccatgtcactggtggaacccaatgtatgtgataggttcacaggtctcagctgtgaaattgtgtttgtacacggtggctttttctagaaaaatgaaccgcaaagtatttctttcctcgtgaatgtcgaccattttctcgagtctggttgttgttggccagtgacacaaacctgcagcttctccccttcttgcttccctccccgccccttggctccgggcacagcgtggctgaaccggcttatctggcctcgtctctggaggcctccccagctgtcatgtccgttgacatttcactgttcctggcagtggctgtgcccagacgcgccgtggcacgtgggagtgatgctggtctttgccagtgctctgcacacctgtggggaggcctctcggggtttcctgccaggtctctgtgcaccccccggtgagagatctgaggaggaggaggaggaaccgagggcaggtagggcgctcttcagatgtggagggttggaatctccagtttaataacaaactttatcctaccttaagttttcaaaagtcttgtaaagaacgggtccattcatttttagctgctccgtgaaaggtgagaaagctgagtagggggctgtgtcccaagaccagggtttgctgtggcctggctcgattgagaatcccctgggccccaggagggtgctgtggctgctgaggaggctgccccacgttctgatcctggtgcagggctgcactcagcctccccagaagcagcttggtcccgggtcccacctggcactaacctctgcagggcccctttatgtcatggtgttttggcctgtggaaggctttcgtccgtctgagctgctgactgagggtctttatttccacactcgagagaaacctggcggcccagcagtcagtgcccgcggagcaggtacagctcagggaagggagcagcccttgctcacggtcctttctggcacagtctgtggccctctggagtacccggccagcgtcctcacagctgtccccaaacgcgtggtatgggttcctccctcagggccagcaccaggctggtgctcagctcttctggaagagccgtcccatggtcccagcgcatccgtggaagagtgaaatattgaacgttacaagaaggaagtgaggccaggcgcggtatctcgtgcctgtaaccccagcacttttggagttggcgatgggcagatcacttgaggtcaggagtttgagaccagcctggatcaaaatggcaaaactccatctctactgaaaatacaaaaattagccgggcgtggtggcaggtgcctgtaatcccagctacttgggaggctgaggcatgagaagagcttgaatccgggaggcagaggttgcagtgagcccaggtcatgccactgtactgcagcctgggtgatggagtgagaccctgtctgaaaaaaaaaaaaaatagagttgctaaattggagtaaatatttcataacgcgattcagttcagttgctttagctgctctgtgagtccagcacccgcctgcagcgcagcctcccctgtggagtctggagcacccaggcctacatcacaggctccagagcacccgggccggtatcacgggctccagagcacccaggttggtatcatgggctccagagcacccaggccggtatcacgggctccagcacagcgggcaaaaggtgggaggctccccagactttaggtgtctggagttatccataaagggggcttcctgagttttggtgtatcccttggtttacaacccagggagaagcctggccacttgtgagtgcaggtcgtccttggacacacacttggaggaatcggaaggaacaggacacgcagccttatgttcctgtcagcccttcctgcacatatgccctgtctcagggggctgctggcctctgccagggcctcctcacttttgttcctgaggacatcttcccagcgcgtgtgcacttactaaatgagccacatgcccccagttctgacagctaggaacggtgcgagcagatggaggatggagctggtgctgctgcccacaggggccctgggagtgaggctgcgggtccctcgtgccctggtgcggccctggcttgaggccttggtttgggggtgttgtgccccccctaccagggctgagagcccacagtgacagcagaggggaggtgtgtgcgggggccgggcatcgatgctggacttgctgagggttgctttctggtggtgtgcacacatcttgggccagagtggtgtccccagagtgcctgctgctggaagagaaggctctgggtccttctggatgcccatcctggctgtgtggaccacggcggcaagggccacgtgcctggtcgtcaggccacggatgcttgtccggagctgcctcatgtggctcttgcacagaaggcaccattctagacattccaggtgggctccagtgaccatgaggggctggggttggcactggcgctgctcctctgaggtgttggacccacgtgggagctgcttgttcccctccagacactgattgtgaagaatctggaaggtccacgctagaggaggccacgacctgctggtgcgcctgcaagagtgctggcccaactggtctccatgcgtggtgcccgttggagggggtgggagggctcggctctgctctccccccgtgggtcttcgtgtcacagggtgcttgggggactctgctgcactgagatctccagcgtgacatgtccccgtcccaaacagccctgaaatggcaatgcctcatcctaggattaccgtcccttcccgaaggcttgaggtcctacttagatgtctactggactgctttttattttaatttacttgatactcagtctgggtgcgttgaagacgcggcctctggctgtcagcctgtccttgtgtgcagtgaccggtctacctgtctggccttgtgcctagacttgtggccgtcaccactatctctggggaggggtgaagtggactgggaggtaggagccgaattggagtcttctctttgttcctgaagttatcacagtcttggccagactgtggtcactgcgtgcgtgtgtgtgtgtgtgtgatgcgcagggcatttgctggtggaatagcacgggccattggcatttgcacctgaggcgtgcagcccccctgctgcacacctatggggtccctgcggtcaggtgagctctggggggtttctgagggtggagacagccacaacaacacttctttcctccaaatgcctgtgctgtgcacttgggtgcaggtggcttttaggggacatggctgggcactgccccacagtgtcacctctgtgtcctgtggtgcgtgctgtggactggcaccacaccccacgtgcttgttaggccagtttctctcaggtgtcggtcaccctaccatgcggcctttcttttgtcttttatctttagctaaggagtccatggcataccaaaagctgaatgatgacagccagtgtccccatcctgtcctccccaactttccacaggcagggacgctccccattcttgctgcatagtcttctgttgaccccatgtacctgagtgacccccacgtacctgagtgtgacaagcactatggtgcttgacctcagtccagctgcttagacctgtacctgccacagccccacgtgctgacaccttgcgtcttgagttttgataaatctatcctttggctgattaatatgactgagtggtgtcttctgaccccatttcttatctggaacactgtgtcctgacttcatttcctgtctggagcacactgtcctgacctcatttcctgtctggaacacactgtgtcctgacctcatttcctgcctggagctctctgtgtcctgacctcatttcctgtctgtgccgctctgtcctgacctcattttctgtctgtgccaccctttgtcctgacctcatttcctgtctggaacatgctgtgtcctaactgcatttcctgtctggagctctctctgtcctgacctcatttcctgtctggatctctctatgtcctgacctcatttcctgtctggaacatgctgtatcctgatatcatttcctgtctgtgccactttgtccggacctcattttctgtctggagcactctgtatcctgacctcatttcctgtttgtgccaccctttgtcctgacctcatttcctgtctggaacatgctgtgtccggattgcatttcctctctggagctctctctgtcctgacctcatttcctgtctggagccagtgacctcatttcctgtctgtgtcactctgtcctgacctcatttcctgtctgtgccactctttgtcctgacctcatttcctgtatgcaacacactgtgcccggactgcatttcctgtctggagctctctctgtcctgatctcatttcctgtcaggagcactctgtgtactgacctcatttcctgtctgtgccactcttgtgtcctgacctcttttccagtctgtgccactctgtgtcctgacctcatttcttatctgtgccactctgtgtcctgacctcatttcctgtctggagcactctgtcctgacctcatttcctgtcttgtgtcctgacctcatttcctgtctggagctctctgtgtccttacctcatttcctgtctgtgctgctttctgtcttggagttgcgtgcctgacctcatttcctctccactgtgtgttcctggagttaggcatcatcttggtttttactcccttgcttggttttctcaggatctctggctgctccgtccttgctccagcgttcttctctgccccctccctctgtggtccagaggccgatggccagctggccctcacctgcccgccctgggtatttctgtgctcttcctggtgagggattctaggggttcccctcctgggttcatccttacctgagtagccacagcacactgtgcagttgggtgcctgggaggcacgtgctttgggtgttgcatggctgacctggtaactgggcacccgtgtatggagggctggaacagaacacttgtcggcgctcctcagcgtcttgcctctggtgtccccatggcgaagtcccctgccatctgctttgggctctgacatgtgacctgactgtgcccttcaggagctttcagaacctcctcttagatctggcattcaaaatgtcttgtcagacacctcgaggcggcttgtgtttggccctgtgttgggcgcctattgggcccttgtcaggtttttgttgccaggaggctcgcgccccgatcttcgggatggtgcccgtggcatcttctgctcggtgctccctagggctggacgttggtcctcctggcactggtgctccggttgctgtggtctccctgctgttcccttgtggctcaggattactctctggaggtctccgccttatcatgagcactttctttgttggctacttttagtttcatgatttcattttcgtttctaagatatctatctctttgtaaaagctcccaccttttgtgacttgtggatgctgtatctttctcctgttgctgcagacattaatgatgtttttcttgacagtttgtcctgctggtttcctctgcattcctttggttggtttcagacctcggctttaaaggggcatttccccacattgccaattcttgaccatctggtcacgtcaaggctgacgtgccaatggctgcaagggggagggcacctgggagcccgcggatggctcttatgcagacgtgcgggccagccccgatcctgcttctgcaaggcctcccctcccatggtggcgctttggtgccagagcgcgtcggcgtggctccctagcgtctgcctctgcagctgcttggcccccagccgcctcctcccagctgcctcctgccctatgtgtgcttgagctcgagacaatgcttccttcatccaagagccgggctctcggcgatttttgagaggagaatggggttgaagcgatgttgctcttccgtcttaaaactggatttctttcctcatgcttttgaattattatatcttcttgacatgtttctctggatttgcaaaagatttttatattttatatatttatttatttacttatttatttatttttgaggtggaactttgctcttgttgcccaggctggagtgcaatggtgtgatctgggctcactgcagcctccgcctcctgagttcaagcaattctcctaccttagcctgctgagtagctgggattacaggcatgtgccaccatgcctggctaattttgtagttttagtagagatggggtttctccatgttggttaggttggtctcgaactcccgacctcaggtgatctgcccgcctcagcctcccaaagtgctgggattacaggcttgatccactgtgcccagcctgcacaacattttaagtaaatgttgacattttaagcattgagcaaggaagagtgtgaagaggtactttataaagggaaatatggcaatactgattatttgcgactttaaccagaagtaatctttggacagccagatgttattgtcttggaatgtggtgttttatctagtgacaatgtgtgtgcatgcacacgtggacacacaggattcctggtccttaaacccgtatgttcggtgtctgcagcatagaatggtctcggctggtatgtgtgggaccagctcagatgcccctattctagatgccgaggccgaatcgccccctagggaggatgggacagtggctgtgctgagcgtgctacggcgtcatggaagaacagcagaggcgtttgagaattgtgttttttaaaaagagttgaaacttgtcagtcaggaaatggagtaacaggtttatcaggagtgtcattttccttttttttttttttttctcccatgagtggcttggtcggggaactcatgtttttttttgtttttgtttttgagtcagagtctaggtctgtcacccaggctggagtgctgtgatgtggtcttggctcactgcaacctctgcctcccaggttcaagggattctcctgcctcagcctcctgagtagctgggattataggcgcctgccaccatgcccggctaattttttaatttttagtagagacggggtttgttggtcaggctgatcttgaactcctgaccttgtgagctacccaccttggcctcccaaagtgctgggattacaggcgtgagccaccgtgcctggcgggagctcatgttttatctgaggtggcccagggccccacctgggagcagggtcagcagtgcctggcccttgagtgtttgcctcggggtgtgttccttttaaatcagatcagctcatcacttggccggttttctagaccagcatattcaaacccaaggtttggaatcttgggctggcttctgaaatgacatgctgtgggctccatccccagaattctgggttcccaggtccgaggtagggactgagaatgtgcatctctagcaagttcccagatgacatggtggctcctccggaacccctgcctccttttgtgggtaaagttttacaggtgcatggccacgccccaccgccctcgccggtgctgtctgtggctgttttgtgccacagcagaaaggctgagtaggtgcgagagagaccatgtggcctacaaacccaaaatatgtgtgatttggtcccttacggaaaacacttgcaggttcctgatctagagaaagaataattgtaacgcagggctacattgtttttgtgaaactctttaggatggaaaagggcatctctgaggtcagcgacagaagccgtggtggtttcatgccaccagtttacctttgtcctgagctgtggaggttgtttaaagctatagatcaaatgaagcctggaatataagggtgcagttaggatgattgctgtgtagttattttttaaaacggctttttgaggcataattaacataagctgcgtatatttaaagatacagttagataacttttgatgtatgcaaacacatataaaacatgtataaaaccctcgctgccgtccagatgatgaacctgtccgtcacccagaagctctctcctacccacacccctttctccccaggctgcagcagtctgcttttgggcctgtagattcgttgccttccttagagctttgtctaaatgaaatcctacaatatgttcttcttttggtctggcttccttccctcagcgtcattattttgggctccttggatgcgtggcgtgtgctgggcagtgttcccctgcgtggatgtcgcgtttgttcctccatttgcccgttggagcgtgtggagtgtttccagttcttgactgtcacaaagaaagcggctgtgaacattcgggtacaagttgttgtcgggatacacggttttatttccctggatagatacctaggtgtggaatggctggatcatatatttgtgcttatgtttaacttttagaaactgccagactatcttccaaggtggctgcaccattcctcgtcctaccagcagtgagtgagagttcctgctgctccacgtcctggccagcgtgtgtggtgggcgggcttaggcgttcagccgtcctgatgggtgtgcggcggcatctccttgaggtttaagttgcgcttccccaatcgttgagaacgtagagtggcttctcttgtgcgtatttgccaccatatgtcttctttggtgaaatgtcccttctgatttttgccagttattttagactgggtttgttgttttactgttgactcgtgagatctttacgtattctggatgcaagtcccttttcacatttgcgccttacgtagactttgtccctgtccatggctttccttttctgaacggtgttttttgaagagtagaactgcaaaatttttatgggatccaatttttcagtttgttctttttctttttttttttttttttttttttgagacagggtgtggttctgttgcccaggctagagcacaatcttgtgatctgggctcactgcagcctttacctcccaggctgaggtgatcctcctgcctcagcctcctggctagctgagactacaggcacatgccaccacacctggctaatttttgtattttttgtagagacggggtttcgctatgttgcccaggctggttgcgaactctagctcaaatgatccgcctgccttggcctcccaaagtgctgagattacaggtgtgagccactacgtccggcctcagtttgttcttttggtttggacttcggtttcctagctgggaactttgtccctaactcaaggtcacagagattatctcctgtattctagaaattttgtagctttaagttgtatatttaggtctgtgatccattttgagttaatttttgtgtgcaatgcaaggtgtggacctgagttcatttctttgcctaaggtgttcagatgtttcagtggagtttgttgtaaagattagttctctactggattgtctttgtgcctttgtcagaaatcagctgtgcagatgtgtattcagttgatccacttgtttatctttttacatcaacgccatgctgttttggattattgtagctttgaaataattgttgaggtcaggtgatattcgcgctctaaccctgcactttttcagagctgttacagctattcgggatcttccacttttccatatgaattttagaatcagtttgtcaatttctgtgaacatttctgggaaattttgattgggattgtattgagtccatagataaattgggaatatcttaacaatcgggagttttccgaccaacggaaagctctctgtttatgggttgttattaatttagtattttgtaatttttagtgcacaggtttttaccatcttttgtcagatttattgatttatctattgaggttttttcttggtcttgtaaataatatattttaaaaattcgattactggatataaacggccactacagttcttatatgttgatcctgcagcctgtaaccttcctaacttgctcatgagtcctagtggcttttattgtagttgccattgggttttctgtgtagatgatcatgtcgtctgcagtaaaagcagtttcacttcttcctttccagtctggatgcttttttatttgtcctgcttaatggcaccggctagggcctccagggcagtttgaataggagtggtgggagtggacgccctcgctcctgatctcctgatctggaaggcgtggaatcagagtttggatgggagtggtgggagtggacgccctcactcctgatctcctggtctggaaggcgtggaatcagagtttgggtgggagtggtgggagtggacgccctcgctcctgatctcctgatctcctggtctggaaggcgtggaatcagagtttgggtgggagtggtgggagtggacgccctcgctcctgatctcctgatctcctgatctggaaggcgtggaatcagagtttgggtgggagtggtgggagtggacaccctcgctcctgatctcctggtctggaaggcgtggaatcagagtttgggtgggagtggtgggagtggacacccttgctcctgatctcttgatctcctagtctggaaggcgtggaatcagagtttggatgggagtggtgggagtggacgccctcgctcctgatctcctggtctggaaggcgtggaatcagagtttggatgggagtggtcggagtggacaccctcgctcctgatctcctgatctggaaggcgtggaatcagagtttgggtgggagtggtgggagtggacaccctcgctcctgatctcctgatctggaaggcgtggagtcagagtttgggtgggagtggtgggagtggacgtcctcgctcctgatctcctgatctggaaggcgtggagtcagagtttgggtgggagtggacgccctcgctcctgatctcctggtctggaaggcgtggaatcagagtttgggtgggagtggtgggcgtggacgcccttgctcctgatctggatttggcaccgtcgagtgtgatggtgcatgttgggttttcgccagtgccctttatgagtccgaggaagtccccagaatacggttcctagtttgatcaggaaggatattgggttttgtcaggtgtttttttttcttaatttattgagattattaatatggtgagtgtctttctatttcaggttactaatgtgatgaattatattgactgattcttgaatgctaaaccaattgttcattcctgggatagccccccttcagtcgtgatgtattattattttagaatattgttgaatttgtttttttttgtttttgtttttgagaccgagtcttgctctgcacccaggctggagtgcaatggcgctatctcggctcactgtaacccccgccttccaggttcaaatgattctcctgcctcagcctcctaagttgctgggataacaggtgtccaccgccacacccagctaattttttgtattttcagtagagacagggtttcaccatgttggtcaggctggtcccgaactcctgacctcaagtgatctgtctgcctcggcctcccaaagtgctgggattacaggcatgtgccactgtgtttggcctcttgagttttatttgctaaaattttgcttagaattttttttttttttttttttggagacggagtcttgctctgtcgcccaggctggagtgcagtgacacgatcttggcttgctggaacctccgcctcctgggttcaagcgattctcctgtctcagccttccaagtagtagggattacaggcgcatgccactgtgcctggctaatttttgtatttttaatagagacggggtttcagcatgttggccaggcagtcttgaacttctgatattaggtgatcctcctgcctcagcctcccaaagtgctgggattacaggcgtgagccactgcgcctgccaagaatttttgcatttatattcatgagggatgttggtgtgtgtttttttttcttcttcttcccgtgtatctttgtctggttttggtgttaacagagtaatgttcttgtagaatgatttgagaggtatttcctcctaagttttctgaagaattttttcttttaaaaatgtttggtggggggactgggcgcggtggctcatgcctgtaatcccagcactttgggaggccaagtcaggagttcgagaccagattggccaatatggtggtgagatggttcacccatctctgtgccactgcacttcagcctgggcgacaaagcaagactccatctcaaaaaaaaaaaaaaaaaagtttcgtggggctaggcatggtggctcacgcctataatcctagcactttgggaggccaaggcaggaggatcccttaagcccaggagttcgagaacagcctgggcaacatagggagacactgtttctattaaaaaaaaaaagtttcgtggaacttaccattaaaacctactcggacccagagtgttttttgtgggaagatttttagctatatagactattcagtttatctgttcttggttgagagttactggtttgtgttacacaagtaattttctcaattcaactaaaaatgccatttctccctttgtttctgaaaggtatttgcgtaggtatagaattataggttgacttcaaaaagtttcaattttttttgtggtttaatttaatttaatttatttatttgagatggagtcttgctctgtcacccaggctgaagtgcagtggcacgatctcggctcactgcaacctctgcctctgggttcaagtgattctcatgcctcagcctcccgagtagttgggattacaggcacccgccaccacacctggctaattttttgtatttttagtagagacagggtttctccatgttggacaggatggtcttgatctcctgacctcatggatccgcctgcttcaggtttccaaagtgctgggattacaggggtgagccactgcgtccggcctgttttatttttttgtagagatgggatttcaccatgttggtcagcctggtcttgaacttggactcaagcagtctgccctccccagcttcccatagtgctgagattacacaggcatgagccaccgtgcctggccccaattttcagtactttaaagatgttgctgtactgtgttcctgcatgcgtgcttccagagagagatctgctcatcctcttcttgacggacatgcctcttctttttttctttctttcctttgtttttttgagacagaatctcactctgtcacccaggctgaagtgcagtgggacgatctcagctcactgcaacctctgcctccgggttcaagtgattctcatgcctcagcctcccgcgtacctgggattacaggcacccgccaccacgcctggctaattttttgtatttttagtagagacggggtttctccgtgttggccaggctggtctcgaactcctgatctcaggtgatccacctgccttggcctgccaaagtgctgggattacaggagtgagccacggcgcccggctggacatgcctttctttaagattgtctctttgtcactgctttgagccactttgctgtggtttccccgtgccgcatgtgtttggagtacgttgtgtagtttttgtcaggtttggaaggtgtgtctcctgcgtccctcctctgggcacttggtggcccgtgtgtcagtcatgtgaatgttgtcagctcagggtgctcttctcatcttctggattcttttttttcctctatttccctgtgagtagtttctgttactctgtgtccatatcacaaaccttttcttccacaatgtctcctccacggttaatcccatatagcggatgtttcatctctagaagtttgatttgggactatattatatctttcgtgtctttattttactcttttaaatatgtggaatacactgtaataacagttccagtgttctctgtgaatttctatgtctgtgtcaattctggttgtttgcgatggatggatgattttcttcattgtggtccacattttcttgctttctggattctagacgttttgaaatgtgcctgtttgggtgctgaatgtttttgtattcctataaattggctgggcatggtgactcacaccagtaatcctagcactttgggaggctgaggtgggcagattgcttgagtccaggagtttgagaccagcctgggcaacatggagaaaccctgtctctacttaaaaatacaaaaattagccaggcgtggtggtgcacacctgtagtcccagctactcaggaggctgaggtgggaggatcatttgaacccgggaggtggaggttgcagtgagcttcaatcgcgccactgcactccagcctgggtgacagagccagaccctatctcaaggaaaaaaataaaattaaaaaaaaatcttgagctttgtctagactgcgttcagttatttggaggcagcttgatccttttgagtcttgcttttgtgatttttttttaggtgggtctagagctgggctcagggctcattctaggcctgataattcaccactcctgtggcagaatcttctgagagacataggaccccatgaatttgggcaatttcctgtctgtcgggtggagacaggctctctgcctagcctggtgcaagcctcaggcctgttgtctctaaatctttgtgggtgactcttccccagcctcgtggagtttctgcacatacatactgtgatctggggtctgcggaattgccaggggcctctgcagaccccaggccctctgtgtggtgctcccttctctgctgctccgtcctgtgaattccagccgccatgctctccctgaattgtcagctccatctcaacccagtttctgctgggccctgcctgggtcctgcttcctgtaccatggctgggaactctcgggaggcagtgagctggggctgccagagggcttggctccactttgaattttggggaccaccgtcctttgctgcctgacctccagggtccctggggccattgtctcccatctcctgtcttgtctgcgtttttggcctttccagggaggagggtgatgggtctctgtgacttcaccttggctgcaggcgggccctggcatcgcagtccatgagtgacctccagcttctctcatcagccaccccgttcatccactccatttgtaaaatgagatagaaaatgaagatggtgctgtcgtcacagcggccggatatctgtagctcgtgggctcccctctaggctgaggctcttgttgtgggagaaagttgctcagggccaagtttcagatagaaagagcgaaagtaactggaaatgttgagatggccctggaggccctcagggtggcctctgcttcagggaggaaggtgggcaaatcacgctccgtggcagcaggtttaaaaacatcgctgaattgtgctgactggcacatccattgtgagcggatgtgttttccttctgcaataattttggctacattaaattcgttttgttaacatcttcatcaccgccttttcagtttcagcgggaattgattatgaacaaagtgccatgattttgactattcaggcgagcaactgcatcgagccagcactgaactggttttgtaacaagcttggtgtccatatcgctcttaataacatctgcaggcacaggcgacgatagcagttgtgggccagccgtcaggaaaggggggactagcacgtaccactcagaattcagcttgcgcgggctgcggtggagttctggggtttgtttgtgggcatttccaggtagtctgatcctgtgaggagcaaggaaggggtgtgttgacagggccgttcgggccggagcaggtgcgacaggaatgtcccacgtcctctcgtgtgctgtcgggagacaaacctcttcctgcttcaatatcccattcgttccagagcctcctttcagggtggaaggggtggtggatggctttgggattgggccaggcctgagggcactgagggagtggggcattaggggccacgtggtcagcactgcactctgctctcatcggaagctgggcagtggccagaggcctgggaaaggcttgttgtgggggcggggggcgcaccacacttcagggatgcagccggcctttgggcttcaggaaacgcagctgggacatcctgaggtgtgtgaggctgatgcatgggcctttctacttccagactgtcccaggacacgggtccacggtcacacggtctccaaatgagcaggaacaccttgcatgccctgcgagatgtgtttgaaagtcacactttggttccaggtcacagcttgaacctcaggccacctccagtgggaggctggaggtcctgtgtgccacccggggcctgtgtgctgtggtggtcgtggctctgtgggtgccgggcagaggcctcccaggctgggcagccgccacccctctgtggacgctactcacccttagaagcaggttcccacaggccagggcactcccaacagcactgcgtggagctggtgcccacccctgtggtcagatgcatggcgcccgcagccctggcccaggtgccccctgggttgtgcggcggggccctggctctgtgggtgggtggctgtgctgccgctgctgtcgcccatccttgggggccggcgtcgcctccctgctgctcctactgtgtgctttcttgcccctccagtgcctcccagggggctgtgtagccaggtgtctcagagggctcagggctcctggtagggtttgggtgggctgaaccctgcaccctggcccgggtgtggggtcctggtgctctgtggcctgggacacccgtgcttcctgcaggctctgcgtggcgctgatggagggcctcttgttaagggggcacggtagtgagtcaggtgcccgggggctcataagccaccttggggtatgtctgggtgcatggggactcctctggcctccccagcggtgctgagccgtcactgcagggcagccatggcccatttggctggtgctgagacaaggtgaattttcttggctggcttgacaggtccccctttccctcaccatggagtttcacccaattttcagctttgacggagaaatgaggcttggagtctttttctggcctgtgagggctgcagagcagcgtgcccaggggctgtaggcgcagtccagggagaggccatgacaggagtgggtgtggggactggtggggacagcgactgtgccttctggccccacccagagagccccagctgctgtgctgccgtattctgattccttcttccctccctccctcccttctgcctttcccctttatcctttccccccttccatttccatttcccttttccctccctccctctctttccttctctccttctctccctcttcttttttcgacagggtctggctctggctctgtcacccaggctggagtgcagcagcacagtcttgcggcctcaaccttgttggttcaagtgatcctcccacctcagcctcatgagtagccgagactacaggcacacaccactacatctggctaacgttttatattttttgggtagagatggggtctcgccatgttgtccaggctggtctagaactcctgggctcaagcgatcctcctgcttcagcctcccaaagtgttgggatgacaggtgtgagccaccgtgcctggcccatgtttgattctcgatgcagatccagccctgggaagaaagcaccgctggccatgactgggcagagccagagagtgactaaggggctgttaggacagagacagtgggttttgcagtgatgtgagctttgacggaagtggccacactgcaggcccccacagcgtcactagtaggccaagcggacactgcgggacacgttccccaacgtgggatgtccgtcctcagcagtctgtggccttctgtgaagcaaagccgttttgcaggctgggttcatccccgttccaggcccgcactagtggcgcctggttatcaggtgtggtgaggagctttgctgccctggagcgtcgctttgtgggcagaagccaactttggaatcgcctcatggctggccctggacctctcctccttccttccttgttggttgctgttaagccagccttgggcaccagggacagtggggacgtggctgtgcaccgggcccagggctggcaggaggctgcttcagggctctggaccagagcagtgtgtggctggtggtacctgtggctggcgtgggtctggcgggtctggtggtgcctgtggctggcgtgggtctggcgggtctggtggtgcctgtggctggtgtgggtctggcgggtctggtggtgcctgtggctggcgtgggtctggcgggtctggtggtgcctgtggctggcgtgggtctggcgggtctcgtggtgcctgtggctggcgtgggtctggcgggtctggtggtgcctgtggctggcgtgggtctggcgggtctggcatgtttggtggtgcctgccatcaggctgccgatggatgagcctgcctgtcccccacggattggagttttgcccaggggtgctgtgccctggtcattgtcccctacagccaggcagtaaagtgtggccagcaccttgctgcaagagagggacagaggtcatctgtctacgagctagagcaagggcaggtgggcccactggctggcgctgcgtctgggttcggtcctggacctgctgcgtgttatcctccctgcgggcctggcatgggagtaggggctgagagatgctggtgacaccactctgacgccacggcctgaggcagccgttggacagtgcccatcttgaatgcagccctggtgacctgaagcccctgcgttggtccctcacaggccagggggtgtggccacagggcctgggctttgtcccgtttacgagaggtcaggcggtcacagggtaatgggaggcctgtggttcctgggctgccatctggcgattgtaaaacgggcagtgtgcagtgttgagggggcgctggggaaacaagctgccggctgaggaggccgcactccccgtgcctcccgggcagacacctcacggcctttctctgggtgtctgaacccaaggtgaaaagttcaggctgtccctgctctccagaggggctggaggtggggcgggagcagagactggacctggccagcccctcccgcttcccttcctctgggcccctggactctgggggcgagggcagggctgtttggctgttggacatccttgctgtccctttgctggactctccagaggaccagcatggaggtgcacaagttcacatttgtccctctcctgccccagggcacctggccctgtcccgggccaccccaggctggaccagctgcccatgtcaccaggccaggcgctttccctgtgaatgagccgatggccgcaagtgcctggcctcaggcctgggctgtggggatgactgaggcccagtgaggagtgggctggggcctggtgtgacctgcacggtctgtgggggttggagggatgcgcgacttgggcccaccccagaacttggggtttcctgatgggtgttggggtgcacacaagcctgggctcctttgtgattggcgaccccagggtcccgggacagtccctgagaagcacagaggcctggacactcccacctcccagtcaggccctgccacatcctccctgatggctccaggggcttttgttcactgaagaacacttgctgtcctcccctcagaagagtctgctcggtgggggagccgcagggggctgctccctgtccaggccagagaaaccaggcagcctctcccgccgggagaggtcccccacaggagcctgttatggagccgcgtggcgcctgggctggtgtcacccctgggagcccccttttaaagaagactcattcaatgtccctctctcagacggcctccagcgtggcgattaagcgctcagatgctggcaggttccgcggagtgcccggctgccctcggcaggggctttgtgttggctgccctgccccgggctgaccccagacgctcgccttttgtgctacgctgctctcgcccctcgggaacctttgtcccattgagccccgccattgcctggggccccttgcctgtccctgcgggcccgccccagggcggggattgtggccctggtcccctgggggggggtagggggcttttggtggcctaaggggaccctctgagcactcatgcaggcctccccccaacctcacgtccaggtctgttgccgaggggccaggagattctgacattgtgcgatggccccagaggttgacatcctggggaggattggctggtgatgcttccagaaagtggtttttgaagatgcatctggtcctggcccgtggatggctggcgggactgggagagacactccgggccactggctgctttctcgcagctgttctcctctgggaggacttgcccctgtgggcaggtgcaggggcactgagcggaggggcttgggggcccctgcccgccccaggccaccttgctctctctccaggcctgcgtcctgcaaagaggccgggtcaaaaggtcactgccccgatttttattgctgtctcttacgttctcacgacctcttgccctctgcacagatgggcggggctggagcttccacgagggccggcctttccggggattaaaaacccactgaaaggtctgagcctagctaccaagcttaaatgtcttagtagcttaaaaatggtgttaaaaattaagcaaaacacacatagacttccaggtttagcataaatagaaaccagaggtgttgagaccgtgctgccccctcaaaccagcgcagtggaaagaggggcagagccctccacaggagccctccgctggggggttggggagacggccctggcccagcgtctgcagctcccagcggcactgaatggcagtggccgtccctgtggtctgggggcctccttcccccacaggctacacaagccctggtcctgccaaggctcggggaagccctttgtgactttagaaaaataataatggagggtgaactggttcctatttttgcattgtaattgattgccaagaacccctgaaattaaatacaaccatgtattttaaatggtgtccttaatgtagaatgtttttatcaaaaccaaaactccctgttgaggccttagtgttctgtcaatagcgtgttggagtctggttcccgtctcccctgccccggcctatgtgtgctgaccctgggaccggtgaggcagttctcaccacgccccgagcctccccctcccacgccccgagcctcgccctcccacgcccctcctgcccccgaggctcgctggcgtctgtgcttcttccaggcggagggggaggtggtaggcaccttgggtcttaaatcagagaaactgtcccagcagtagtaaaagtcatcagctggccccaaagagcccctggaaacacaggctgtaccccgcctccatggagacatttggtgccacctgcgttcagtgcagatgccacacggctcttcctgagatggcttccgaggccatttggcccttcatctcgggaacagaccaagggggtgttttcggccgtctgagacccacctgggggtgtctgggccttggccatgctgccttctccaagccccatgcttctcccggcccctcctccttcccactggcgccggagacctttggtagtgggtgtggaaagacagcagctgtggggtccctgtcctggccggccactcctccttcccaccagtgccggagaccctcggaagtgtatgtggaaagacagcagctgtggggtccctatcctggtcagagggtggcattcctcccacagtcctgggagccacagggctgagatgggacttctcagcttggcatggggagggcaggacggggtggctgccatgcctcattctgtctgtgatggaaacgggagggcctggccctgcctctgttactgagcttgagccagggacacccgtgaccctgcctggggcggtcctccccagccttgtgagccagggcagaggtgcaggttgggtggctgacctggtggggggtaagaacatccacggagaagtgtgacgagtgtgcgaccagagtgtggacccagccaggaggcctgaccgtgactgcagcctcccccagcattgcaccaaagtgtgctcgtgcaggacctcgaagatgccccgtgggcagcgttcgggctgaggctgcagggggccttgggagcacggtggccctcctgtctgttctgtggaccgggtgcggatgggccgtgcaggcagacgtgctcttgggtggttgtggtggggatgcctctccgcccaccaccctctcactcactgccctggctggaaggtgacggcatctccctgaccggcagcgccaggatggcagccccacaacagtgtcctggtcgccccagaggcatgctgagcgcccatgcgtgtgcgcaggtcctacgggccgtgtccagacccagccccggggtcaggtgacacctgtagttgggtgagcgctcacacaggcacctccaggtaagggggattgaggaaggtagcgctttgtcaatggcactggttttgctccgaggctggactccttttccctttgaggagctctgctcatgtgctttgcctgctttcccatggcaggctttttattggttaaataaagacacaaacttttcatcagtctttgcaaatacttggttccggcaagttcttggcccttcccaggcttggggctgccggctcacggttcttctctctgcatttcagccaggcccccatatgctgggtttgcaggtcacgaccacccatgacggctgtgctgcgtggggtgcagttccccgtgggcgccgagggtggtgtggggctgcctctcgctcgctccaccagccacccgagggcccgtgtcctggtcgtggccgcgtgtgctctgctgtgtgggtggtcagtcctccccaggggccacctggatggtgtccactcctgccccatggcaggaagtcccagcggcacctggccacgtccctctaacatgtttctggaagtgggattctaggctggagcctcatagcgggcagatactgccccctggccatgagccatgacagttggttgatgggacttgaaggggcctctggacagtgtggctgcagccctggaccctaggagaatagcagccgtgatggggggcagggaccccactttctgggtgggagtgaggagggccggctgctgccccttgctgcagtcatcttcagtcactttcccggccgccacggccccctcctggcttcttgctctcagcagaggggacaagacccttgtgagggtgggcacaggcactccaattgtttggggccttcgctgtcccttgctgtctgtgctggtctttccaggcatccccaggccgtgtgtgtcagcaggtggaggctgggcacctctcacccacccaagctgaagcggcctcacagggggtggcaccaggtgtttctccagctgaacaagctcgccctggaacccccaccctgaaagggctactgcccccatgagaggagcttctagagatggtggccagccttgggggcccggtggagatgtgttcgcggggtcctggtctgattctgtcttggaaggaacatcgggcccctgagaggtcagagcagtggccggcccacggctccgctcaggcgccacggcggctcctttctgtttcttgtagtcactgagttcgaggttcccacagggaggaggcttcctgtggctccgccgtcagggagcagtggggctgccccagcctctgggggctttttaggtgctctgaggcgatctgggtgtggcctggccggtgtgggcagctttgcccttcgtctgagaccccgagccctggggcaggatgaggggtgtggggagagtttgctttttccagagacgtttatctgttttttttttagacggagtctcgctctgtcgcccaggctggagtgcagtggcgcgatctcggctcactgcaagctccgctcccgggttcacgccattctcctgcctcagcctcccaagtagctgggactacaggcgtgtgccatcacactcggctaattttttgtatttttagtagagacggggtttcaccgtgttagccaggatgctctcgatctcctgaccttgtgatccacccacctcggcctcccaaggtgctgggattacaggctgagccaccgcactggccagcgtttatctttaaatgtgccttggacctggcccctggctctttgggagggagagtccttggcaggccccgttgcctccaccccaccagtgcaccttggctcctggtcactgcccaccctccctgcccgggcaggaattcttacaggccctacactcctgaagggaaatcaggctggtcctggggcaggcagcctctcagagctgttgagaattgagcaatctccttgtgctctttcaagctgttcttttctttggttcacactgagcaagggctggttgctccgatagggagaagacgtgaggagtggcatttactgtgattgagcacagggcctgtggactctcccattcacgcagccacatttcccaaaaagaagtggtcctgctccccaccccccgacccccactgcagcgccacctgcctttatctgtacttggagggacagcgcagcaggctgtggctggctaccccaggtggctccacccagctctcagaagttcacctgctgcactcagaggccgtttacttgaggtttgatatttatctccaaaggaagggctgccccgactggcctggaccctccagggagttcagcaagccggaaatgcgtgtctgctgctctcctggcccctgggccacctgcttctgtggccctgggattggggagccagggctgagggcctgtagggccccctgtctgtgcctctagaggccctgagccacctcctgcagtgttttagatcccataagcaagagacagaattgtgcatggatggtgagaaaacatgaagctttttatttgtaaacagaaaatggcagggctcactgtgtggggctggggacagcgctaggcctgctttaggccgtgcaccccaacctggggtgttccaccaagaggggtacagtggcctccactgtgagtatgtggccatcctctggctcctgattgctgagttcctgattgctgtctttgcgtaacttaggaaccccgatgaagagcccgtgctcatagctccgttcctgacatgttcaggaacgcctctgttgaggtttttctctttggttctggaattcctgggtccctttgacccctgatgcgtttgttttgggtgttgatgagcactggagctgcttccccacagggatggggcattggggagattccgacacagcagggccctcacccaggaggctgctgtgggtgctggagcggttgcttccatggagctgggattcctctcatttggggctgtaggaaggggtctttcctctctgtgctaacagttgtttgtttaaaaagaaaggctgtttaaacctttcaaacttaaaacttctttttttctttggagatggagtctcaccctgtctcctcccaggttcaagtgattgtcatgcctcagcctcctgaatagctgagattacaggcacatgctaccatgcccagctaatttttgtagttttagtagagacggtgatatggtttggctgtgtccccacccaaatctcaacttgaattgtatctccaagaatttccatgtgttgtgggagggacccaggggaggcaattgaatcatcgggctggtcttttctgtgctattctcgtgatagtgagtaagtctcatgcgatctgataggtttattaggggtttctgcttttgcttcctcctcattttttctcttgccgctgccatgtaaaaagtgcctttcaccacccgccatgattctgaggcttccccagccatgtggaactgtaagtccaattaaacctctttttgttcccagtttcgggtatatcttcttcagcagcgtgaaaatggagtgcacacacacgtcagcactgtgggcgcacacacctgcactcacacattcatcaggacccatgggcacacgtgcacacacacgtcagtcctgtgggtgcacacacctgcactcacacattcatcaggacccatgggcacacgtgcacacacgtcagcaccgtgagcgcacacacctgcactcacgcacacacctgcactcacgcactcaggaccgacggacatacgtgcacacacacatcagcaccgtgggcgcacacacctgcactcaacgcactcgtcaggacccacgggcagatgtacacacatgcaccagcacccgtggacacgtgcacgcacacatcagcacccatgggcatacatggatgcacacatcagtaccatgggcacacacacatgcacccactcccgatggcttcggcttgctgggtgcctgcttcgccctcgggtgagcaagtctggaggcaggcacttggggtggggccacagtatggttcttaggagcccagtgtcccctggacccacttgctcccagccttgggtcccaaagtgctgctcccactggtctctgtgccccacccatcatgggcagggctgtctgaacagggcagagtcacgagtgatgcaagggtggggtgtggaggccttgcctagaggcagcagccagctctggcttggctgggccttaccttcactgtcctgctgtgagacgcaggagccctgggggaggacggcagtctgtatcagggcagtggtgaaactgcagattcctaaatgtgatctggagacgactcttgctggagaaatctacccaggtcccttgggtctgtccctcccttcaccctccacagtcagggacaggctgcgtggtgtgcctccccatctgtgcgtggcctcagcgcagcaggcctgtcctgcccattgctaaaggtagagcccggcagattcattgtgtggtgagggcttccccagacccaccaactcctgtgtcttcccatggtgagaagggtggggtctctctggggcctttttttttttaggaagtcactgatgccactcaggtgggtgcccagctccccacctgatctctggagtggccccttctgctggaggctgccccaggctggatgccgtggcctgcagaccccccttcttgcagtccctgggcaggcagcacccatgcgcacacgtgcacacaggccgtgagcactgccctgtgagccaggtggtggtggggggtgttggggctaaggtttggttagggcccgagtgcttgcgcacccccccatccaatttcccatggtgctgggatgctgccgcctcctggaccctggcgttgaagtgccaccttcatctccctccccagacagtaagctccagacaagggcaggctgtggccgtcactctggccagctgctcgggggcttggtggctgctgggtggtcgcctggactctgccctcctgtctcctggtgtcccggaggggccttgctgggctgggccctccaccgccccattgggcgcctgactctcagggcgcagtcagttctttggggatggccctgatctctgagcgggactgcctctggcctttcttctgcatcccctacggaacagcagcctgctagacgccctgaggaggcaggctgaggggtggaaggggcgtggccgtgcccagcagagaccaccctctgatgacggtgggcgtcctttccagcccctctcggggcatcgcttcatcccttcccccatttccttcctggccctgctctccaagtcttgtgtgtgtggtggggcctggcttccctcccggcctctcgcctgttcccgcccatccctctctggttctctcaggcctcctctgggcttgccaggaatgtaggggaattagggggagggggacacaggaaatgcctcccctcctctgacaacagctccagctgcagggggaggggggaggggagagcagagtgggtgagacgagggagggctgaaggggggagtcggcttggggggagagtgttctcctgcccacccaggcactgggcgtggcccagccccacagacagaacagttctttcttccttattttattttttattagagacagggtctcactctgtcgcccaggctggagtgcagtcgtgtgattggcctcaagcgattctcccacctcagccttccaaagcactgggattacagcagtgagccagtgtgcccagcctcttcctaagtttacaccagtgtgggcatccagtgaggggaactggcctgtgatgcggtggtccttgtgacatgtcaggcagttttagagtagggtttgttaaaacatgggttaaattgggccccacccccagccctccactcctcagccattcaggagaagcgcgaggcatgggtgcgcgaaaattctgagtctgccttccacctgaaccccctctggaaggtctgaccacgggctgggtgtggtggctcatgcctgtaatcccagcacttttgggaggccgaggcgggtggctaatgaggtcaggagttaaagattagcctggctgatatggtgaaaccacgtatctactaaaaaaaaaaaaatacaaaaattagccggcattgtggcaggtgcctgtagtccccagctacttgggagggcgaggcaggagaatcgcttgaccccgggaggcggaggttgcagtgagctgagatggcaccactgcactccagcctgagtgacagagcaagcgtctgtctcaaaaaaaaaaaaagtctgaccacagccccttctcacaagggggctgccccttctaccctcgttggggaaggcctggtctgctgtaagtgcagtgaccggacattaaaataccccggaatggtcttggaaagagccacttctgggagtcttcccttacccgccacacaccttttaaagagaaacctgaagacacctgagaagacaggcggcggcggcgatcttcagagagaagatgcccgagaagacaggcggcggcggcgatcttcagagagaggacacccgagaagacaggcggcggcggcgatcttcagagagaggacgcccgagaagacaggcggcggcggcggcgatcttcagagagaggacgcccgagaagacaggcggcggcggcgatcttcagagagaggacgcccgagaagacaggcggcggcggcgatcttcagagagaggaagcccgagaagacaggcggcggcggcgatcttcagagagcggacgcccgagaggacaggcggcggcggagatcttcagagagaggatgcccgagaagacaggcggtggcggcgatcttcagagagaggatgcccgagaggacaggcggcggcggagatcttcagagagaggacgcccgagaagacaggcggtggcggagatcttcagagagaggacgcccgaaaagacaggcggtggcggagatcttcagagagaggacgcccgaaaagacaggcggtggcggagatcttcaaagagagagatgcccgagaagacaggcggtggcggagatcttcatagagaggacgcccgagaagacaggcggtggcggagatcttcaggagagaggacgcctgagaagacaggcggtggcggagatcttcatagagaggtggcggagatcttcagagagaagacacgtgagaagacaggcggtggcggagatcttcagagagaagacacctgagaagacaggcggtggtggagatcttcagagagaggacgcccgagaagacaggcggtggcggagatcttcagagagagagacgcccgagaagacaggcggtggcggcgatcttcagagagaggacgcccgagaggacaggcggtggcggagatcttcagagagaggacgcccgagaagacaggcggtggcggagatcttcagagagaggacgcccgagaagacaggcggtggcggagatcttcagagagaggacgcccgagaagacaggcggtggcggagatcttcagagagaggacgcccgagaagacaggcagtggcggagatcttcatagagaggtggcggagatcttcagagagaagacgcccgagaagacaggcggtggcggagatcttcagagagaggacgcccgagaagacaggcggtggcggagatcttcagagagagagatgcccgagaagacaggcggcggcggcgatcttcagagagcggacgcccgagaagacaggcggcggcggagatcttcagagagaggatgcccgagaagacaggcggcggcggcgatcttcagagagaggatgcccgagaggacaggcggcggcggagatcttcagagagaggatgcccgagaggacaggcggtggtggagatcttcagagagaggacgcctgaaaagacaggcggtggcggagatcttcatagagaggtggcggagatcttcagagagaggacacgtgagaagacaggcggtggcggagatcttcagagagaggacacgtgagaagacaggcggtggcggagatcttcagagagaggacgcccgagaagacaggcggtggcggagatcttcagagagaggacgcccgagaagacaggcggtggcggagatcttcagagagaggacgcccgagaagacaggcggtggcggagatcttcagagagaggacgcctgagaagacaggcggtggtggagatcttcagagagaggacgcctgagaagacaggcagtggcggagatcttcagaaagaaagcccagagttccatagtgggcgggtgggcagtatttcggcttgtgtggcaccagggcagggcctccgaacccatggaaagccttgcttcccccaagcccgctggctcccagccctccaccctcatgatagggcctgggtaggggctgctggtcaccctttacccccacccaggaaaaggtcaggaggctgggctccccgtcaaggagcggtttccagggacaccggctctcgggggcgccagtcctgtccttggcgcccagcacatgctactagtgacattcgcaagggtgggtctggttctcagcctccgacctgtcaccccggtgtgggcccagtgacctcagtgagctcctcctgtgccctaagctgagccactgtgtacactgaagaggaggctggggtcctgtgtgcacctggcccgcttcccttgccggtgctgggagacgggagccagtctcggaccctcatctgccagcagctcctgtggctgtgggggcgcaggcatcttggctgactagggaggatcccgtgggaatgaccccacgccatggccagggaggcgcccccacccggcccaaccgcctttgtcggggatcctgagaggctttgtgcggaggctgggtcccaggctgggttccgagggtgccggtgcgcccctcctatgggtgaggctgtctgcttacagttgaacacttctccccacttctgcgccaggcctcactcagtctccccagcacggagctcttgttgctggcccagggcctgtccaggtcctttgacagggcaaggactcagagcctcaggggggggagggcagggcctcctgaggagtatgtctctgtgaaaatgggggtgaggaggtggcaagcatcgccttttgaggacagagtcttggagaggtgttggctttctagggagggccctgtgattctcctgcaaccatgtgggccggggccaggaccaaagccatcgtgctgtcgctgtggatttggtggccgcttcccctgctcagatgttgtactgcaggcctgggccttggcttggggtctctgtgtctccatgttcaggacaggcttgtggctttgggtaccacgaggggccatccagcccagggggcttcagggagctgcccctcaagtgcatgtggggtgctggggtgcagccctgctgcccatggcccggaagtccaggcagcactgctctggttcgaagctgccccaagggtacgggaggcccgtccactagaactgaggcctggcaccatgttgtgtcggttttcatggcgagaaaacatcgtgggcgtctgctggggctggaggaggcgggaggccgaggcagcaaagctgacccgctggcgggtgggggccactgtggcgtccccttcctgcaggaggcggggaggtgcttgtttccctccagagctgctgtctgcccgcagctagtgccctgttagcaggtgcagtgcccgtgccatcttctccccagacccagaccctccccaactcatggagaccctgtcctccgggccatcccccgtccatgaatgcccggggcttggggtccatctcctgtccacatggacctcccctcttgggtgtcacagctgcatcagaggccccagaggccggccctggggggctctggccccaacacagcgtcctccccgttccactggccggggctccctcaggttgctgccctgcctctagatccctgatccctggacccatgctgccgagacgtcctggtagggttgagttccctcctctcccaccccgaggcggcctgagaagagcctcttggaggttcaggtgacctggcctgggtcagcacagtagaggcggagctgccctcagacctcttttgtaacagttatctcatggaaacctaaaacctaattgggcaacggcagctccgtgtgaagtagagattgtctggaagagatttgtccctgttctgtggagcagggcagatgcagctgaggtgcctgggggggcagggacccttccccagtgggctcaccccagtggtgtgggggtggtagaattcaagctcacaccggcccagagggcccgctgtccgtgtggacctcctgtgactgcatgggcctcttgcggcggctccctcccgccccacaccggcctatgagccctccctggcccctgggtggctgggagggctccaggcagggaagagtcagggaggggtggatggccggcgtggctgtaagaatgacaggtggacacgggggcccaccttggcctgtgctgggggccccggtggctggagagtgagagtgggtgctctcactgagggtctgaccctgctccgcagtgcagtgtggaggtggttttggtgccacacacagcacaggtgcaccaggcgggcctttctgatgatcagaattcataagtggttttattttgtaaattaacaggacagaaaagcctttttgttcttgctaaagttttatgatttcgtgtttgggccaccagggtatctggaggctgggggcagtcgtggccagggtcagagtctgggttggagataggtgtcatgcggcagttggtgtggccgtgtggacttgtccccatctgtctagtaaatttccatctgccctgacgtcagctgcctttttgacatgcatttggaaggtgttaacaaatggacttagattcttccaggccggtcgcagtggctcacacctggaatcccagcactttgggaggccgaggcggctggatcacctgaggtcaggagttcaagaccagcatggccaacatggtgaaacccaatctctactgaaaatacaaaaaaattagctgagcgtggtggcgggtgcctgtaatcccagctactagggaggctgaggcaggagaattgcttgaacctgggaggcggaggttgcagtgagctgagatcgtgccactgcactccagcctgggtgacaaaagcaaaagtctgtctcaaaaacaaacaataaacaaacaactcttcctttgaaagttttgttttgttgtttttgttttttttttgagannnnnnnnnnnnnnnnnnnnnnnnnnnnnnnnnnccatctctacaaaaatacaaaaattagctgggtgtggtagtgtgcctgtaggcccagctactctagaggctgagaggggaggatcacttgagcagcctgggaggcagagattgcagtgaactatgatgatgctaccgcactcagcctgggtgacagagtgagaccttgtctctttaaaaaatcataaaatgcaaatgtaagagtgtttaacttgtggaatcatcaaaattgcacagttcttgatttgaaccccaaatataataattaaagtgcgtgtgcattttattcttaccacatcagggcaaacgctgcccaaaatgaacctggctgttggagttcgcttaactcacccatgtggccacgcagctctcgctctgagtgaggacagactgcgtgtgggggctgtgggcgcctgtctccctccctcccaaggctccggtcgtgggctagtgggagaaagtgactgggtgggaccaacgcgacctcctccactggacgctctttacacgggctgggaatggcagtgggcttgcatgtggcgtgtgccacctctgctcatgcatgctctgtggtcacggagaactttgcttataaaagaacatcttatcaaaggtgaaactgttcagaatgccaatgatggggacagagcgttaagcccaggacatggctgcgtgcccacaaagccagctctggatggaaaagtaacgagtggagggcgttttcttcccagacccggtggtccagccgtgagtgtccagctgcaggccccacagcagccagctctgggcgaaaatctagagggcccctgcgcaccctcccgcccggggtgccctggcccagggtgcacctgtgctctggaccctgggccgtgcggggctccagggcgcctggagactgccattttgtgtgggaaggtggaggcgacttgggaatgcgtttctttagattttaaagatgagagagtgttggccttggacaggaaaaattccaatttggtgagaaatggaaatatccaattttttttttttttttgagactgagtctggctctgtcgcccaggctggagggcagtggcgcgatctcggctcactgcaagctccgcctcccgggttcacgccattctcctgcctcagcctcccgagtagctgggactacaggtgcccgccaccacgcccagctaattttttgtatttttagtagagacggggtttcactgtgttagccaggatggataatgtccaaatgttttatccaagtccaaatagcagtgttggtggtaggtgtgctctgcctgtgggtgggggtggtctctgtctcaaggtgggctacgagggtctgccgcagggggggtgtggacgggtcttgcatgcgtcaccttccctgtgtggggcgtgggggtggtctccccctagaaggacagggcttgtggcagccgtgagatggatggattcccagggatctcccctcaccttgggggatgagcccaggctcctttctggggtctccagtgtgtccccgatggaccagcttcctgcatggcaccgccctccggccccaccccgagccctgagccccgccttgagccctgggcgctcctggccctggcctggcactcaagggctgctttcagggctgtttctcgtctgtcttttttcttttctttcttttttttttttcttccttgagacggagtttcactcttgttgcccaggctggactgcaatggcacgatctcggctcaccccaacctccacctcccgggttcaagtgattctcctgcctcagcctcccaagtagctgggatcacaggcgtgtgccaccacgcctggctaatttttgtatttagtagagatggggtttctccacatgggccaggctggtctcgaacttctgacctcaggtgatccacccgcctcagcctcccaaatagctgggattacaggtgtgcaccaccattcccagctaatttttgtatttttagtagagacagggtttctccacatgggccaggctggtctctaactcctaacctcaggtgatctacctgacttggtctcccaaagtgctgagattacaggcatgagccactgtgcccagcagggctgtttacttaaaggtacatgttccgatccctgaattcggttttattttgaggttaggagtgagaacacgattggttgtcgtcgtttcctgtgggagtggctcttttcagaggcagacagttgtctttgctcgtgcgtgcacatttgtttgcatgcgcgtgagacccccaggtggttttgctctgggagtcgtgggatgtgttctcagctcccttcccttgtcctgagtggccttggttggccacagagtcagctggcagtggctgtctgtgggtcacctccacacatggatgaaactagcctgaggtgggctgttgttggcctgctggcatttttggggtcatggcagtgccctcaggctggtgatagtgggggtggggaccttgtctcaggtaccaagttcgtcttcatcctttgatcccctcttccaaaaactaccccctccccccgccacgtgtgtgaggcctgcagtggtgtgcacagaagccacccttgggcctgctgggtgacaggtcccctccaggtgacgggagctgcctcgctcttcctgcaggtccccggtgccgcctggttttcccgaatcgcatgcacctgtcactgagctgtcagtgtggtcagcttgctgcacccacccgggaagtggagctgggggaaggtcatgttctgcaggagacctggtggctcaggccctcaggacccagctgcccctccccgaggagcagtggttggtgagaaagcacacagaaggcagaggctagagatgcagctcctctgttatgttgagcctctctaggcagggagctcagagacccggaggtggccctcctgcctcctctctgtcaggacttgacacctgtctcagtggccatggctgtttgtcttcatccctcttcggtgagggtggcaggcggccagatgcccattacaggccacctctcctgccagccagtcttcgagggctggtcaccacgtggccactttgtgaggcccctcctctaagatcaaatgtggcactgcagagctacaccaaccccgagccccgcgcagggcagggcaggagaaccaagatcgtgggggtgggggggtgcagggcagggcaggagaaccaagatcggggtgggggtgcagggcagggcaggagaaccaagatcgtgggggtgggggggtgcagggcagggcaggagaaccaagatcgtgggggtgggggagtgcagggcagggcaggagaaccaagatcgtgggggtgggggtgcagccacaggtcgtgctcccggggctggctgtagcggctctcccctcccccgagcccaccgtgtgcttcttgtccagccttttgagatgaccacagctctcagtttggccccacagcagcatctgggttgacgtccctgatgaggtttggaaacagcagagaaggggttgtcctcttccaccaagagcctggctggcctggcctccctctgggcagcacctggctgggctgactgggcagagggaaggggtggcctggccagggtgagcatggggtgcttgccactccacagagggggtgcaggaggcgcctccaggccacgttgctccaggacatgccacctccacagccccctccttggagtctttcctcaaggtcttaggatggctgtttgtgccctagcacagagacccttgccctcttgtgtggcgccgggggtccctgttggtcagggatgttcctagagtggggagggagtcggtaaggcaagggtgatgttggttgtaaggggtggagtccttggtcttaagagatcaggcagggcagccctgggctgcccccggcagagcctttgccccaggcaagtcccggggctcctgggaagaggctacttctcagcctcttgagagggcctccagggcacaggcagggagcagctgtgagggtgtggctgtgatggggactcttgactgcagtgtggatgtgagctgattgggggtaggccagccttctgtgcgggacacttgggaactgaggggacacagccgccaccctgcactgctcagcctgagcacctctctggctgtttggtgctgcacgtgtttctgggcatctgagatgaggccccagggcctttgcttccagacaccaggggagagagaccagccccagaacaacagttggcgggtgggctggggtcgtcagagcttctgacctcatcaggggctcccccagagttttctgtgcgctgccgtgtgtctgggccagcgctgggggcaagcgatgccttctgtggtttgaggtcttgtaggcaggaggaggaggaggaagagggcacctgctgagatacttcactggtctgagggccccttctgccccagctagcgcttgggtgagggttgggcttgcggagccgtcctgtaaagccggggatggcaggacgcattgtcaccccctcctgccgctcttacgaaacactcttaattgagtccgattcttggtgaatcagccttccaagaaccgcgaccgcagcatcctgtgccgcttctgtgttccgcatttttctctttctgcagcgtttcctctcattctggatggaaaggcctgtttgtctccctcaatctttggcgagggtggcaggcagccaggcggccattacgggccgcgcctcccaccagccagtcgctggcaggagcgtccggggagggagcagaccccgttcaccctcaccccagaactgaagcagcgaggggacccagacgagctgcgaatgcaggcgctggggatgctcacgccagcttgctgttcttgggagtctgtttattcttttaagctatttcagcatttaccttcagtagcatcggaggaaaagaacgatacattcgccccagtgtgtcccctgggggacctctggctaattttcggattccgaaagtgaggttttgcagggctgtgtggccactcctttgtggtcggccccagtgtcatcaggctggtttcaaatctggggtctgtggttcgaggctgagtgcagggctcaggctggatggggagggtgagaagagtggggccagacttcccggggtcagcacacacatctagggtcgtcatggagcccatggcagcactgcctggccattggcccctggtggacgcctcagaccgaggtcccaggagaaccccagcaaggttggggctgcagagggagccctccccgggacagcagctggaccagaacagaagctgggccctcccccacccccagtctctgcagcccccaccctccttccagcaccttcccccctggatggatgggtctttgtgttttgatgccccttggctctggcattgtgggggggccccctggggcatgaggaagagggccagtgccaaggccccgagggagcgctactaattgctactcagtttccttagaaagatttggctttttgtcatcaacagcgctaaagtaacagcaaagatgacctacttaagcgaaagaaaaatccgagtgaacctttaaagctggtattctcacttcattttggggcttggggttgtcttgcagattcaatctgtttcctctgtgccacaataatcagaaaataggttaatttaagcccaatatgaaaagtgaattatcatgtgtgaaatattaatggcacttacaaaaatagctttataatttcttgaaccgtgaaatcttcagagaaggcccatagctcacgtgagccgattcttgagtgagggtatttgggggtgcacctggaggagacagcgatggtctcagcagggtttgtctctagagtgcctcagcgcgagcttctgccagtccccggagaggagtccccacgcctccttgccctgctcagggctgcacgggagttgccacgtaggagagcacagcccaccttgggcttttggggttcgggcttttggagtttgtccaggctttggggtggggctttgcctgtagaagctctgagctgtgctgcatggtagggtgaccgcagtgggctgccctgggtgccccatgaaggactgagcagtggggtgacccttcatctagcagatgttcatcagggacctgctgtgggccaggctggggtcacactcagaactgactgcagccaggtggagaccccacctcgagagctcctccttcctagctgtgtagcccacaccccctggggagccgtagcagtgtgggggcagctctgatggaggggtgtgtacctggccacagctgtctctgggctgtggtcatcacccacaggtccttttcagatgcggtgcccacctgggtgtgtggacatgacccttgcctaagggagggagagaggaaggcctggtaccaggcagtgtcctctgcctgtgcccctgctggggaggacgtgagggcctgtggcttttaggaaccttgaggaggtgggggtggtcttctgacgccggcggggctcctgaaggtgcaggaaggcacagtttgtgcggagtccccttcggaggaagcaacgcctgtccctggcggggccgctgagccaaaggccgtgtctcagtggcaccctctcccagccgaggatgtcggcaccatttgggcccgtggacttcctccagtctctgggtggtggtgagtggggcctgctgttgtctagcagccactgttctgtggggcttcactcctgggcagggtgcacgggagagcaggggttggcaggaacccggcaaatttgtcaataaacctgaacctgaagtcccacaaggacggaggctcagtagggctcgggcctgagcggggcaggccagtgtgagctggggggtggggcaggccactgtgcggagcggggttctggccgccacagggcttttgttctgttgctttggttggcgatcgggactcaccatgttagacctgaggttcgtggtgggatccaccggcgtggccctgggtggctgccctgtgtgctcagggagcagtcacgggccctgagtggtgttgcccgtgggcctggaaggtccagccgagggttggggcctgcggatgtcacttctctgaagatgagaagccagggcgaggcccccccccccacatctggaaggttctcctgcgtcgccctctccttccaggcacatttggccgtccccttttctgcgtgtctgtccccaccatcgtgccctcttcttctctggactgcgtttggatgatttctttgaacggtttttattctggaaagttctgctcgagcatctggtatctccctggtgtttgggatgtctccttctcattcccccgtgtcttgctttaagctgcgtgtcctcgtgtttccgctgcccctgttcttgggcactgcgttgtgttctgtctgggatccccgtgcaaggcccctgggtctggtggctgctgcccggcctctgggaccgtctacctgtcccagcccccgtttccccgcttcttcagctggcaccttgaaactccgtgccaggtgagcaggcctgtggctgcaggttcccggaatctgtcgtgggttctgggttgtcccttccagtgcaggcggtggtcaccgcgccaccatgggggtccaggcagcaggatggtcatgtgatgggggccactctgggcttttcattctcctttcatctgtggcctcggaggctccccatgttttctgaggtgcacagaacatggaggggtgctcatctcatgtcagatattggaaggatgtcgtgcaggaaggttcgagggtctcggggtggtcctgagaagccgatgtgataggtgcggcagcttcctcttcccctgagcgggggcttccagagcctccctcccactggtgcccatggggtttgagcctgatagctccgcaggattcagctgctgtgagtcacagccaggatggagaggtctaaggcaggcctgatgccgggcagggcgacatttctagaaaaggtttcatctggtgatctgctaaatggcatgaaaatcacaaaattggcactcagtgaccatcaggctggctgtgtgtggctgctctcctcaacaagcaaatggctgcccccatccagagccccgactcccgctggcctcccccgtgcggggatgtggggaccagggcaggccccagagaccacctgacctctctggcaggaagaagaccacgtcgtgccgtttcctcctcccttgagcccgttagctgtctcggggaaccggtaagcccagggccaccttgtcacgtcctccactgaacgtgggtccacgtagatgccagccccttggtcttgcccagaagttgtgggaggtgctggttgccagggatggctatgcatgtttgtccccatggcagggaggcctctgggggcctggccctccccccgctagctgcttctcacatttttgtctccccgagagccacctgctctcccagggccctcaggcccccgtctgccagtctcctggcacctgggctggggtctgcgccaggcaactcccacagcagggcaggatccaccctccacgttatcattactgccatcccctgtgcctgggatggaggccacgcccacccagtggggcccctctggaaaggagacttgacctcagggtggtggcagggctctgtgggatgcccctggtgacagggaccagaatgttccctaaagtggatgtcaggcccctggctcagatggagctttctgttcttgatgggctttagaaggtgaaaaactaggcttccagaggtgaagttgcactgtgggctttgtggcaggtgagcgctgcctgaccctgaacagctgctaaagactcagacctggagccttcctggtgtcctgtgtgtccacgcaggtgtgccagtgtggcagccctgcgccaggagctgcccctgcatgtcatggcagcatccatgccagccgagcgcccctctggctcccaggcatctcatcctgtctggctctgagggccgtgctgcagtgaaaaccattcaccttgacagtttggctttcgaccaagaattcactgtcatatttttgatttttaaaattaagactgtattcagatataatttgcgtaccataaaattcttccttccacagaatatggtttaatggtttttcagtatatgcagccatcatcatctaagttgagaacatttttgtcacccccaacaagaagccccatgcacatggtccgtcactccccaggccccaaatcccagccagcactgatcttggccattggcctgtcctggtcattccatagaagtagagccacgtgactgtgtgtgtgtctgggccacgcgtggctgtgtgtatgagagccatgcgtgactgtgtccgggtcacacgtgactgtgtgtccgggccacgtgtggctatgtgtccgggccacgtgtgactgtgtgtgtccggcctcagcacagtattttcaaggctccttccttccttttcatgactgaatcatactccattgtctgcacagaccacaatctatcccgtcatttgtctctggatgcttgggtggctgcactttgctgctgtgagcacttgtgcacaagctgtcgtgtggatgtgtgttttcagtaacctgcgtgtacgccgaggactggaattgctgggcgatgtaactgtgttaagcttccgaggacctgccagactgttttccacagcagctaaataattgtacgttcctcttagcaatgcataggggttcctgtgtctccatgtcatcaccaacacttgtccaaactaaaaaattctaggccaggcgctcatgcctgtagtcccagcaatttgggaggccaaggtgggcagattgcatgagttcaggagttcaggaccagccagggcaacaaagtgaaaccttgtctctaggaaaaaaaacaaaaaaaaaaaaacaaaaaattagctgggcatggtggcacatgcttgtagtcccagctactcaggaggctgaggtaggaggattgcttgagccctgggtggttgaggctgcagtgagctgagatcgtgccactacactccagcctgggtgacagagcaagactccgtctcaaaaacaaacaaacccagttctagccatcgttgtgggcgtgagttgacgtctccctgcggtgtgattgcgtttccacagtgaatgatgtcaggcagctttgcatgcggttactggatgttagtatcctgtttggagaaatggctactcgaattctctcccatttggaaattgggttgtgttttgtgttttccttgctgacttgcagagttcttcatgtgttctgaatctggtcccttaccagctaccgggtttgcacgttttcccttgcatcctgtgggctgtcttttccctttctcgatggtgtcctttgaagcacaaagacgtcgtgattgttttctgggaagccttgttgttgtgttttctctctgttccttgtgctttggtgtcatggaagcacttctgcgggggcgggagtctggactgaggccgccacgttcctgctgtgaaaaccttcacgtgcgctcgcagcctcggctctacagacggttcagtccgggaaatggtttaaggaggccgtgcacagaaacagtctttgcagccagggacatgagagcataccgtgctgttcccacaaggcccgtggcctctgcaggtgagaattggtggcctcccttgaaaatactgaatggaggtgccaggcacccgcacaggctcttggtgtgggcataggccgtcttccacttgaagaatgtggcaagatggtctgaaaaccacaaagtttgtgtttggagacacggtctcagtgtgttgctcaggctggagtgtagtggtgggatcatacctcactgcagcctcgaccttttgaggtccagtgatcctcccacctcagcctcccaaggagctggcattacaggcataagccaccacgccgggcccacggctgaagtttgggttgtatccttttaaggaatagcagacgggttttcagccacaccgaagagaacctcagcgtagcagagtgttgctgggccatgtgcttcaggagcagggccacaggcaggacctcgagtgcccagcccgctcaccacgctgtgggcggcctcttgggaatgtcagaacaccagcacaggcgatctcctcggaacccagattgtgggcgatcctgccgctccacctgctgtggccccagggttgcaccaccatgtggactgtggctggcagcttctggaggcttcttggtgcctacaacatctgcgccactccacagcgttgcctattggtggcagccatcccctccataagcccgtggcccctgtacagagacgaattggcgctcacggactcaccctgcgaggcagcatctgcgtctgcaggacttcccggcccttggccgcacatttccctccagttcccatcatggcagctgtgcctggttgcggatgctgcatgctgaggagaggaggcgtgggcccgcccggtgtgcatgggcaggtctgagactggccactcccatggcgcatgcattcccctggagggtccccttgccccgtggctgcagcctggcaggagaagacgctgaggggacgcacgggaggggttgcagggtgggctgtgctgtgtggcaggccttggggtgtagccgcaagctgtgggtccatccccccgcaccagggtgcagttttgacaccgggtggtcatgggccgagcatccatgcaggtgtggagacggaagcctgacccacagagcttggtggtggcccctggactgacctgtgggttgctcaaccgctctgccactgtgcgttgttcacatgtgaagccggcgtcacaaaggcctcaatgtctgtttcagctggatacatgcgcgccctcgtgggggcttgagggcacactggccgctggacactggggtcccggggtgactgaggctggtgccctcctgacaggttgctgggctgcaagttgaacagaaaactggttttcttcactctgcgaagttccctgtggttgtccctggggttggagggagttgtgttgacatcatcatggctgctgctgtgcgcctctcccttggagcaggtgtggtccccggctcctggattggctgcccatgctcaggatggtctggggtgtggccgtggcctgtccccgggccggatggctttctcagcagctccctgaggcagcatgagcagaggcgggaccctgcccgggtcctgtttcccccttgtatcctttggccctaatacggggtcccgtttaccaatgagggcaaagagaccagtctaaggggaggctgaaaactcacaggcaggcctgtctggccttggggtctgggtgctgcttccaggcagaccacatcccaggtgaggtgcagacattcagagacagacgtggccgatcctggctgctgtatcaacgcgcccaccaaatggggccttctttgatcatcagtcaaaagcaagaatgtgcctgtggtgggcgggcgcgtgtgccagcttccaggccgtgggctccttggtgcccagagctcaccctgtggtgcttgcccactactcactcccgcctccccggagtcttgccctggggggtcctggtgtgggagctgccttctctagttgggtggagccttgcctgctggtgcctgtgagccctgggtgggtggatgccgggtggtcgtggaggttcacagcaggctctatgtggttgttttgtgtggatttggggtgtgaattctctcagcaaaggctgactcagaccccagtgttcagaaggttcaaggaagcgaccgtcagcgccgagtggccagcagggcggggatgcggcgttgagccccgtcattcagcttcagtgtggagaaggcccggagctgtgggcatcagctcggggacccgagtgactgtccctgcctcggggaggggggggccacacgggcaggcggggcagcagcttgtgcccatgtcctcctcacggactctggaagtgagaggcgctgaggccacagtgggggaagtggcccagctgacgacccgggctctcggtgccctgggaggagctgttgttaggacatgtgcagactgggttcagcctgtctggagtggctcaggtgcctggggacagaggccagctgtaaccgctgctgcactcggttctggattcagtgccctccgcctctgcggcgtctccctcggcagctgtccaggactccagcctccctgccagggtaggggacatggagcgtctccttgctctggggggttgaggtcttctgtgtttggaccctgtgggatctggcaggagaagcagcccccactcatgttgtgccaggggcctggggaagggagatggcagttctgtgacctccagactccctttccttattgcaggggatgggccagcgtttcgccctgagcatctgcacgtgtcaggcaggaaagggtccccaaggccttctcaatggctcttctctgttcctggcaccttacaggcctgaaacgcagggcccccaagggtggggtgtgcatttttggagagcgtcttttctgagactcccccatggggagctggtggcttgcttgtggcagtgtactgtggctgcccagtcctcggcaggcatccactgctggctcacctgtttgggccaccgcctctgcataggtcctgtgggctttgctcaggaactgttccgtcagagggcctagggtgtccacagtcttgggcccgctattcctcagcccagccctgccctgccctggcaggggggcacctgtccttgggtgcaagctcacacgcgttgcccgggtgcctgctggccaggtagcttgcctggtcatcctcggggtgtggggaaggaccccaggaggggaagtggccgcggggcagcgcggtgtgtcgtctggcctccgctgtgtaagctgacagtggcctgaagggctttgggatggggcagccccttgcaggcctatccaggcccagccccattgctttggtgtgtcaggtccagagccgtgctcctgcctcgtggcctgtgggctccaagggcgggttttgaagccccaggaagggtcacaccagaggcaagcggtcgtagctgctcttcccagagtaagactcagccgtctgtcactgggtgtggttttgtccctgaccgacagctgacactggggcccccaggggccttggtagggcgggtggcatcccaggcctgaagacggctgtctgcttcctggggctttgagaaaccaatactgctcaggtgacagtccctctgagagtgtcacttcctccgcccacaggggcgcagacaccttctattttacacgtttctctccgtttctctgatgctgcagagagcccgccctgagagccgggagtcgcctgatgaggggtcggcaggggtcttaacggagtcatgtctccgaaggctcgtcctggctccctgaagaccaggagcgtccctggccccaaggatggccctgagcccatctgcctcaaccctccagatctgcagggtcctcggccaccccccactgagcggattgggctcggggccccgggcctacggtcctcccgccacctccacggggcggctgttggggccccaccaggcagagccgtgttctcaggcgttggctctcatggaggtggcctgaggcatctgactctttcccctcaaggagtctctgagtctcccggagtcagcgccggctgttgtggcttttccccgggtgataactgagccgaatttccgcgcccgcttcagtggctgcttagacaggaagctccacccagccgggcgtcctcggccttctgtgcctctcgggagggtccgcatgattccggaaggggctctgctgcagctaggatggcacccgcccctgccaggcataggcacagcaccctgcggtcagggcctccgccagacgtcatcaacactcacttcccctcgaaagccgccacatagagggggtattttcagtgtcttttttcctgaacagctattttagtgtctctgaaaaaaaccatccacagccgtgagccttcaggggctgcctgccctgcgtccccggccctgtgcgcccgagcacttatctttctcccttgggcccaggtcagagccaggcacctgcccctcccctggccccaccctgcttgttccctgagggctgcagggtgggtgcacgtgctgcaggggaggccacgggctttggccagatcttcccccagggccctccatccccataattggagcaccttgatggacagcctgccctgcgccccatcttccccctagggaagcagggtccctgctgcctccaggaggctggttcctgatgcagcgtcttctcctagagtcctggaggtgggaagagcccccggccctgagtgtgctctgtccaccaaggcttcctggctgagggcaagggcggagcccccaccgcccgactttgctgcctcctcttgaggttggcctcggcagagtgagtgggacctcacccctgtgaagggccccttgccctgtgtggcctgttctgcgttggcctgtggtgtagacctggtgccagctgccctggagactctgtgctgtcctgtggggtctttggcagtagaggaatggcccattttacggagactgccctgtgattttgcttgggaagagaccttgggtctcagttgtgccttgcgggcagcaccgtctcaggggtttccagccgcagggctgtgggagttcacgtttgcctgaggctggatgtaccggctcaggcccccagcacacaacccacatcactcactggctcttgggggatgtgcctcagcacctgacacacaacacctggttctgagtgggctgggtccaggcaccttcgctaagcttcctccaccagcgggacctggttctgggtgggctgggtctgggcaccttcgctaagcttcctccagcaccggggctggcaaggagcgaggcaaaggtgtgtgtggtgccatcctgtaggagccaggctccttggggatggtgtccttcattttgaaaatgtttccttcccatggggagggggcagccagaatgcccactctttaatgcacctgtgccagtggcccacagggacacggtgtcccctccccgcgaccacccctgtgccgcagctgcccttcccagacgcatccgtcgtgagtggctctcgccgtgctgtggctggttgagctgagtgcccagcgctgggcaccctctgaggacacactcgggttctaggaaaggggtttggcaggagaaggacgagggactcctggccaggctgagccgctgtggaaggggagagtgggtcttggtgctccatcccaaacctgctgcagccgtgggtgaggtcacccggaatggcaggacaaggtccactctgttctctcggagatgacttgtccctcagcacagcctccacgtgcctgttgcgcgtggcctaagggcctttatgcaaagtggacttggtctcctggggggtgccctggaatctgccttctgcgccactcagggtcgtttgtggccggagtgcatggggctctgactgccatgtgccagccacggggctggtggagggaccctgccctgggaaccacaggtgccaacaaaacctttcattgatcgcaggtctcctctgagcctccggcctccataagacccaaaacagatgacacctcttcccagtcccccgcgccttccgaaaaggacaagccgtccagctggctgcggaccttggccggctcttccaataaggtgctgtggggcctgtcggggtccttggggtggtgggtactgggcccttctccttgggcagacccagcggctggcagctccacctgcccgctactgagggctggcacccggcgcagcctcagggacatgaagtggcttgtttttctcctggtcactcacacagacaactctttctcgacagagcctgggctgtgttcaccctcgccagcgcctctctgctttccgaccctggtcccccgcagtgtcagcgagtgagaaagagctctccccacacctcccggccctcatccgagacaggtgagtgggcgccattcacaggtgtttctgatcacgggggaggctccacgagggctgtgcatgcggacgcgcccatgtttctgcaggctgggtgcccagacctgccgccttttggtcagggcagtctcggtgttggttcctttggctggcatcagggagagcacacctagagcgttccctgtgttctgggtggagtcgtgggtggagccctgtctgctgggcgcagcttcttgatgtgttggcctgtgtctggccttcgcaagagacccagcaagcagaaaacgcttacgggttcttagggaactgtaagcttgacttgaagattcggagctgggaaagtctttcctgtttaacaccttcagagggggtgtgcgccaggatgtgtctgggtggtgcttggggacagaggcaccttcccgacacccgcctgcccctccagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaatgtacgtgtgagtcgctttctgtgcctcctccctgtgggctgtgggggtggcactggctgaggggggctggtcgccgggggtgcgttggtggccccatgtttcgcaggttcctccgggagcggcgcgtctccctggtgtggagctgccgggcacttccatgactttgtttctgtctctgcttcctcctcagtcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggtgagcggggcgagtggtgctgggaggtccagggcacgggcagtgagcacagcctgcaccaggtgaacgggcacaggtggtgcctcctcccttcctggctgccccatgcgctcctctctgcctccacctcagtgggcctgcctgggaccttgggggtccgtctcccaaaagctgcagccctgggtatggtgagcccctcagtgtccccaggctgatggacatcccaggaggccactacatttggcttgaccacagctttccccatcaggatcacacaccctgcgtggtggccccactgaggaagtagccatgtttctctggtataagggaggccgggctatttttagtggcagaaagagttgggagcagctgcatggagacagttccttgctctgtgtgctccaggagtgggtgttcacgcgctccgccagcaagacctggcgtctgcaaaacacaggcgtgaggggcgtgcttactaatgcctggtgttccagaaggcggctcccgccaggcctcccgagtaggaaggagagggctcggcccgcacagacacacacacacccacctgcacacgctgcttctctgggctctgcctcacggttctcacgctgcagctccggtctcgcgcctccttttacgttgtttaggtttctttctgacatgactgagggaggtgcggttcacaggcagagctgcctggggagagaggtgtgcaggcggcccgttgttcacccggccccggcctcgctaaattcacacctcggcggcgtctggcagcttccgcggcgtgggctttagcacaacacaaccccgtcggccctcagagctgcagggttgccgacgtgccctcctgcgcgtgccagtccctcgccccagcacgtcccccgccactgttgtccttgattctggttggaggtgtgatttcccacatacatattcatgtggtgtgtttgcagcgtggggtgtgagtcacacggatattttaatggggagagtgggggggcttgcggaggcgccgggcggatggacgtgtccatctggctgcgtggggagacccggggccctcagatggtgcgatgtctgaggctgccctcctcacattgatgggagccagggcctacttggcttgctgcccccaaggggaacgtggccctagataccgggggaggccccgccgcagcctcaagtgactgactcaggcccccaggtttagcacagctgccacaggcctggcggaaactccggatgggggtctgaaaagcctttgtggggtcggggcaccacacgggttgggctgatggcgcgctgggggcggggctccagggcacattgtcagatagatgaccccacggggtgggctgaggactgctggtcatggtgaggggtgtgctgggaccggctgggcagtgaccccgagccgcctccggcccccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccaggtatgcgggtggggagactgaggcacgcagcacggtgggcgtggagccgccgtgggccccggtggccagtcctgcccagccggaaaggccttggagcagaagccaggcccgggaccacgttccgtgcgtgcccccccgacgggcacagggtgggtggttgctgggccctgcgtctcgtgagcctgtgtcctagcaggtggaggaggggccggcacgcggcactggggagggacagggagcggcgcaggagcctcgggtgggggaagcagcgtcgggccggggcagggcagcgagcaggcgccgctgaccactcggctccctttcagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaagggtcggttttgttatgcaacacgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaaaatgctttcctgccggggggcaggggagacggagaaacccatgtgcgtttccccatgtgaccccctcctccctgtgggtctgagccccggcccatggcacctggggaggccacagagactggcaccgtctgtctggtccagctgacctcctgggcagagtcccaggaccccttgctctctcggggtggggaggaagatcctggaaggnnnnnnnnnnnnnnnnnnnnggccccccccacctcctcctccctgtgggtccgaaccccggcccccccaccccctcctccctgtgggtccgaaccccggcccccccaccccctcctccctgtgggtccgatccccggccccccccaccccctcctccctgtgggtccgaaccccggccccccccccaccccctcctccctgtgggtccgaaccccgggcccccccacccctccctcagcccaccagggtccagggagatgttcgttctcgctttaagtcaggagtcacaaatgacttttttttttttcaattaaggaaaaagctccatctctacctttaacatcacccagacccccgcccctgcccgtgccccacgctgctgctaacgacagtatgatgcttactctgctactcggaaactatttttatgtaattaatgtatgctttcttgtttataaatgcctgatttaaaaagaaaagagcttggcatatttatctatttcgctgtgtacctgttagtccttccccgaccccgaaacagatgacattgtacaataaaggactttgagaggaccgcgggacagctgtgcgtgcgcccaccacagcccctccccagaccggccacacacgggcggctgggaccccctcgctttcaggccatcgtgggtgggggtgctgtcacaggtcagattgtgggcctcggagtctccgtcgaccccgagggcacgtggggtccaggcggccgccctggcacaactgccctctcacctagtccccgtcccctctgagctgggcaaggccacggtttcctctgcgattcagggagcttgcagtccctgcttgtagcactggatgtggctggagccctggcttgaggccaccgtggccttgggccggctgggaggaagccccacagagtgcagtgccaggacagaagatgggatggggccttcccggctgggcctccacgggggcctctgaggccgcacctgcggttggccaaggtccagctcccgcacggacagacctgtccccaaggggtggatcgccagctccctgaggagctcctgggttacttgcgggggagaggggaggtggcatcagaaccctggaccccagcgagctgccccgagggagacacagaggtcccttctccccacctgacctcacaggggggccttcccagacccctgttctggggattggaggtgccatgccgcatgccaatttcatggaggcacagccccgggtgggctccctggggtgccaggccaccacctctctaggcttccttaggccatcacatccagcatctccagcccatccaggccctcataggtcatctgggttgtggtccgagaaaggcatgggctggtaggggctccagccggcccctccccccagcctcccggcacaatttccaggtccccatctcttctctccacccctcgggaagtgcccccaagcttggggctagagcagacctggccctcccctcactgccacataggggcttccttcttccctgcccagggccccaaagggctcatagagcccccacggagggtacagggcggcctctagaccacacaggcctaccccagcaggcctcaaaacacccactccacatgggcctggcttctccatccaggctaggcccctgggtgttgggggcagtgggcaggggcgtgggccgaggggaacatgggccacagcaggagtgggtgtggactggtcctgggcacgtgcatgttctggggggcagaggatgggcggctccagagtgccgctggcaggaccctgagactgagtcagttgtgagcacagaggaccagcccggggtccagtgcagtggggaggagttggggaagggctgggccgaggtcctgggtgggcctcgaggaccgtccctgtggccacatgggcactctgcctcggagctgagcaccgcagggcttgatgacggccctcccgaccctcccggagactcaaaggcactgcctccagcagccacgtgggggcagggaggggcggtgctctgggctcagttgttccccaagctgccccaggcttctctttggtgtttacctttgggtataaacttagagctttaaagggctctggccacctgctgagctaggccagccgtcacccagggtcagaaccctcttcccaaagctgttccgaagggatccaggggtctcctgagtgctgggggagaggaggcctgggtgggagaagctccctgcctccatgccaggggagggcagaggtggggggagagaaatggccctccccaccctacctctgcttcctcaggctcacgactcccagcattcacacctgcctgggcctctgcagggaccacgggttagccctccagcctcagctccctggaagggcagctcccagtacccctgttcctggcagtgcctgtttccaagcccccaagagctggggtctggggaagatgagctcagggaaggggatgggggctcccccacctccctagtttctgccccaccctgtgccccacccatttctgcctcagtcaccaacagctgtccttaggtctcagctgtgctggtctccccctcctcctggagccacagtcctgccagccttcacccaccagcctgtggtcaagggggccgacaacggctgagcagcctgaccttgtctggggaggcagcggccagcacgtcctaggtggggagtggagactgctgaccagttactgcagccactggttcagccccgcgtgtccggccccagccctaagcctaagcagggacccggctcctccctcacttcacccccaacccgccctcctgccccagcgcagtgctccaagggcatggccaggggcccccaagctggacaccccctcatggctgcatgaggggctctacccattgccccagcccacaggcccagaccccgaccccatcctggcccaggcctggccacccccacgtcccagcacctgctttgactcccccacttccttctggccaggaagaggcagcccccacccactctgttctcgtagcctctgcacagctgctggtcctgctccaggcgacccggcctctgaccccacggagcctccgctggaaggaggtgcggagcccacagggacacccccaggccagggccgcctgccctccagaaatgatggggtcgtgaccctgatgtgttggccccgggggggtcccgaccctccccacagaaactgccctgtctactccacccacagcggaccctggggagggggtgaggacagaacatttggggactggatgcccgcccagccctgccaccccccggtctcagtgacgcacatggccatctgtgcctggcctgtgccaggtgggtgggggcctcaatggctggggcacccagccctggagcaggtggccccgctgcgggtgaggaccggcaggggcagcctggccagcctggcttgtctttgcagtgtcctgtgctgggccaggtgtccagccgggctgggaacggacctttctctcccatggccgggcctggcagctcttactggcaagaagtgcagcccaggctcggcctccatggctcctcctgcaaaggaggcctgttccagaaacttccagggacagggaaccgtggggaggtggggaggtaggggctggaggcaggggctccctgggtcagcccaggcagcagtgtctcccagtctcctgcccctccccgcagctgtcccaaggacactcttaggtataggggtgccaagtgcccaggccccgtggagatacaactggctggcttggaagggtgggctcctggctgcccagctcagcccagaaaccaggattgggtgccatccagatctagaacgagagaccaggggtgtggagggtcgagggccgtctagaggccttggtgggggccgggcaggccaccagccccgaaccctggagggtcccgtgtaccctggccagtgccagctgctgcccccctggcctggccctgccagattctccctgacagccctgtccccctctctgctgtcggaaccttctggcccttcctgcaaggtgggcctggccaggctggggtcttggtggagggcaagcaggaaccagggacagacgatggagctctgcgtgtcctccctcatggagatgcccccagctgggtgaaatgaccctggtcggtgctatgcccaggttaggccaggctaccagttgcagatggacaccgccctgcgccctgctgtgcccaccctggggcaggagctgggcaaggtactgtgtgccctgtggtccagccccactctgccctgcccctggtggggcctgcacccgagggacgtgatgcccatgccccagcttcctgtttctaaggaaaaacagtcctaggaaaaaggctgtagcgtcggaggagctgccctcgccagggcctggggggattgtgggtggggaggctgtcccattctgtgatcccagggatgccaggagggccgtggctggtgtggccggcactgggtcaggtttaggccggggtctctcgggtctcggtgttggcccctccgtgtttagaatcctcccaggccaaaccaaggcggcctccagggtcactcctgcacaggacagtggccggaactccgaaatgaccaccgacctgcgctggccgctgagggtccgacagaccaaggctctgggccccctaccccatcctgcgccccgtgcgcgaagtctgcggggtcactgctgcgcaggacagaaaacccgcagtggggccccggcctgtccccggccctggcgctgtcctggcatccggggaaatcctgtttctggctccaggccagggcctgcccctcaccctggagaggccccgtcggaggccggcctcgcgggggaagggcggtggcggaggaactacccaggaattccagcgccggctccgaaaccttcccaatcccgctccttcgcccgggccggaagccgcgctgggggggtggggaggggtgcacgtcccgggccccgcgccgcgtcctcagggccggggcggcctccccgacgcccgttccgttcccagtccgggggcactgggggccccgagtcaggcggagcgcgccgggccccacttccccacgcggaggggcagccccgcagcctcaggctcccccccgcagcctcagtttcccccccgcccccgccgcctcttccgctaccccaccctccctgccgtccggggcggcgccccccagattcgcggccagcgctggattccggcggggtggggcgggggcttccggcccgggggcggctggtccgagcagcaggcccgggctggggggcgggacgggaggccctgggagcttcctgcagcgtgggggcggctcccgaggtgggaattccgcccccgaaccggcgggctacgtgcgggggtctcagaggctgcggctcctcccgtcggtgggcgcggccgcccccagaggccgctgcgggaagcagggcggcggcaggaagcgccccccccgttcccccttcccccccgtacccctcttcccccgctcgtccccccttccccaccccaggccccgcggaggcggcgcgcgtttcacgggtttcgccgcccgcggcacggtgggggcgggggcgggggcgggggcggcggtgcgacccccagcggtggaagcgggaactgcagctcggccgagctcggggttggggggtccctgccaaccctgccctcccggaaggtcccagcctggcgggttcgggtgcttttctctctggggcgcggcctccctgttctgctcagttgggggtccgttcccgggaagaaccaccacaccccccatcccggcccgcaggccccagccgccaagtcgttgctggggaggtgggcgcaggccgccctctctccgtgagcccactcgccacaacccgcagggacctgggggactcggtggatccaaccacaggagaccatgagacacaggcggtctcgccgaggcctgccgcttagagctgtctctcctcctcacgggccccctggctccctgcaggcctggcctcctatctccctcaggccatcagcccagggacccccagcccaggcaccccacccatgctctgagctgtgggcctgaaacccgccctcctagcagggagcctggctgcgccccaggccgcttctgcttggagctccgtggaaggaaatgccctcaggttcccaggcactgagcctcccctcccgctaaccccatcaggggtatagcagccccgtggtgctcagcctgcctctctctgcctgggcaggaccgtggagcccatgcgtgtcctctctcctgtccccagatggaagccggcaggtggggccctagcaggggacatgctcgacgtgtgggtggatgaggacccggtggggtcaggtctggggcagcgggacagggtctccaggacggggcctggctgcagataggccggagaacggctgctggttccctgaggccactggggagccaagatgcagtccccgaggggtttccagggagcagccactgggctgggcagctgggcgcaggggcagagagagctggggctgagtcctggcctgccccctggggactcctgggctgtaaggcaggggtgggcagggcctggacccttgttgggggcccctccctggctgtggtccacctcaggagccaaggaggctggggggctggtgtgggcagctacctctgttccccacgggtcctcaggaaggcggcgccacagactgaggaggccctgctggccctggagctgtgttcggagcccccacagcctggctcctggctctggttgccgtgggcgggaggtggaagtacaaggagaaggagtgtccagcattttcacgagtgccaccgccagaggccaagctgaggacaagagggcagccaggcaccaccctggccccaggcagactccccagggctcgctgaagggccggcagccctgggcctggcagctccccttgcaagccccagctgggggctctgtcatccgggaggccctgggcctgaccttcgccggctgcccctgggcctggaggcaggacacgaaggggctgatgggtctgtggtcagccccgagcgcactttgctgagctgtggtcttgctgagccagcccacaggcccagcgactcctggcttactcagcccaggcctgaggctcccagggaaggccaggccaggctgtgcaggaacctgcctatggggctgggcacctggccctccaggaaggcctgcctgcgaggagctgctctgcacagcgggtctcgaccctccgctaggcaccaggagcgaagagggagaggctttgggaaggagacacaggtcaggtgggtcctgtctggttcccggctgtggcctggctacgctgtcctctgctaatgccaaaggggcctgggcatggtctggagggtgtcctggctgaggccctgctgaaggggtgaggcaggcatccccccccatccccaccccgtctctctacctctctgtgtgtctctctctgactctctctgtgtctgcctctctctgtgtatctctgtctttctctggctcacagactccatcttccatggcagcaactggcttgatgctctctttcggtgtcatcttcgcttggtaaccatgggtgggaggaaaggaggaatggccactgctcccttgtttggaggtcaaaggaacaggaggggcacagggaggtaggaggggcacagggaggtgggcggagctgggacctggagctctccccaggactcttcctggggcaggagaaggggctggctggggttgggggctccacctccaacacactgtgtttgtgagcttgccagagagccgccacctggtccctggcctcaggttcccaggggtggcaccagtaggccgtggcctgcaggccagaggcagacacagcccctaccatgcccaccaggtccggaggagcccagcagagcccctgcccagcctgggaggaggcctcagcccagctcatgtcccgctgtgttggcagtcagacggtcacgtggcatggccaccctggccccaaagccggtgtgtttccacctccagcaccaagagctgcccgccctccccctgacacgcagaggaggcccgggaagcctgggagaccatggctgccgtgggcggggctggtggccgtcaccacttgctccaggcctttgggaccacatctgt

SEQ ID NO: 1415 - DNA, 3503 bp, Homo sapiens
gcgcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttc

SEQ ID NO: 1416 - protein, 728 aa, Homo sapiens
MEAAAGGRGCFQPHPGLQKTLEQFHLSSMSSLGGPAAFSARWAQEAYKKESAKEAGAAAVPAPVPAATEPPPVLHLPAIQPPPPVLPGPFFMPSDRSTERCETVLEGETISCFVVGGEKRLCLPQILNSVLRDFSLQQINAVCDELHIYCSRCTADQLEILKVMGILPFSAPSCGLITKTDAERLCNALLYGGAYPPPCKKELAASLALGLELSERSVRVYHECFGKCKGLLVPELYSSPSAACIQCLDCRLMYPPHKFVVHSHKALENRTCHWGFDSANWRAYILLSQDYTGKEEQARLGRCLDDVKEKFDYGNKYKRRVPRVSSEPPASIRPKTDDTSSQSPAPSEKDKPSSWLRTLAGSSNKSLGCVHPRQRLSAFRPWSPAVSASEKELSPHLPALIRDSFYSYKSFETAVAPNVALAPPAQQKVVSSPPCAAAVSRAPEPLATCTQPRKRKLTVDTPGAPETLAPVAAPEEDKDSEAEVEVESREEFTSSLSSLSSPSFTSSSSAKDLGSPGARALPSAVPDAAAPADAPSGLEAELEHLRQALEGGLDTKEAKEKFLHEVVKMRVKQEEKLSAALQAKRSLHQELEFLRVAKKEKLREATEAKRNLRKEIERLRAENEKKMKEANESRLRLKRELEQARQARVCDKGCEAGRLRAKYSAQIEDLQVKLQHAEADREQLRADLLREREAREHLEKVVKELQEQLWPRARPEAAGSEGAAELEP

SEQ ID NO: 1417 - DNA, 87311 bp, Mus musculus
  misc_feature (1)...(87311): n = A,T,C or G
agcagttcatgcactgggactccctcgagcatctgctctcttgggcataagctgctttgatcagacagggaggacctccttttactctcccagtgagagagcctactagcatttgcctacacaaggtctttctagaattaagatcagattgcaatatgaatatagtaatgttccttacgtcaaggaatatgtagaaacattagacacttagtttcttcatgctggccttaaacttgcttttcagcccaagcaaagccttgaattttcaatccactctcggcctcccaaggagctgccattgcatgtcttggccaccaagccctgacttgtttaatagtcttcagaattcttcagtcttcttttagcagccagctttaccaatctggggactgtgcatgtcagtgtcatgcaagacctggtttagtaataagcccctagtttagaaataaacttggcaaagcctggtttcaaaataaacccaggttttgggtatggtgtcttaggtttataatcccagtacttaggaagctgagaccggaggattgccatgattttgaggctaacctgggctataatgtaagacactgtttcaaaaaaaaaaaagtaaaactcaaaataaacctgtaaggatgacttccttaaatcacccactctggagacagattcatgtataaagtcaaatcatgtatcaactaaattcaacaataagcaaaatttgatattgttgaaataaatatttcctagtatctttaactgaggcactggttttattggccatacatgatagtatgcctcccagtcatatttctttgggaatgatggaaccacttgccacttacttatggttttgtaagtggttgaatttgccatagactttaagaacaagtactataaatttagtcttatgagtttgattaaaaggagagagccttgtgatattgatgtgagtgattggcctgcactgtgacctgatgccatggtaaagtctgagtctgtgctgctaccgaggttcgaagatcaaggatcctgtccatggtcctgctgcagccatggtctatgctgatgactggcccatgttaacatctgaagccatacagtctgtgctgccacctgaggtctcgttaatgtccttggcctgtgctgctgccaagggctgtgatagtatccatggtctgtgcaggggcagaggacgggctgatgtctatgatctgtactgccacaggagaccaagctgaggtcagtggcacctgctgacactgagaccacgtggatggccatggtccatgctcctgatgactgtaaagggtcaggaagctacttctgccatgtgttgatgactatagactcagagtcgagaaagaaggaaatggtggaaggcttctgtgacaacccctaccccctccccaaaagttacagcctagccagaaagttatcaagagaacttttaaaaattgtgataaggatgctgaagtgtatgtagctctctactcctggagggtgttgcaggtggggaaggactcagttttctttaaggagtgggccactgggagatggaccatgctccagtgagtatatgggcaacacaaattggactttttgtgtatgtgtgtggggtgggggtcccaacggtggggagcagagttgggaggactaggaagtaagagtgctcggggttcatggtgtgaaattcctaaaccaataaaaagatgagagcgcgagtaatcaagtgaacctatggtggaatgcatacctgtcatcctaacatttggaaagaagagacaggaaaataaggaactcacagcctggacttcatgcttgcctctgctgggattgaaggcatatactactatgctaggcttaactttgaattttttgttactcctatgtccacttctgaactctgctacaggtttcatgcagtgctggcaatcaagctctaactctgggccactgcatgctacacaagcactctgccaactgtgggacatgcatggcctcccctccctacccttcttttttggtgggagtttgaaagtcaaacttgggttcatcctgtattgtctacagatgtgtgcctgcatgtttggcactggtgtcctttgtgtctgtgtgtgcaagtgtgcatggagatcagaggtcaatggtggatctcttccttaatcggtctccaccttatgttttaaatggatgtgtatgtattggtaatataggtcttctatatatgtatgtatatgtgtgttgccatatatatgtatatatacacacagaaacaaatatcttttgtaaaatgaaatttatgattttacccttcttatagtattatggtgagattagataaataaaaattatttaactttttaaatatttttttaagccctggctggcctaatactcactatgtagaccagagtagccttgagttcacaaagatctgcctgcctcctgaatgctgggatcaaaaacctatactattacgaccagtgatagtaaaattaaatataattaaataaattaattaaaaataatttaggacagtgtctttgggaaatatggtaagaatacaatgtcagtttattccagtgtatgtacagtatgatttatcactaagttcctaatggtcattatgttgctcccagtcttttcctcttcaatccactctgtaatgtgagatctgtctgagcaggacacccataccatgcttgactttgttagctcaaggctgtagttgggtcaggtttggtgatatacacctttaatcccggcaccttggagtcacagggaggtggatctttgtgagttcaaagcccagcctggtctatatagagagttctagatcagttggaggcctacatagtgagaccctgtttcaaaaaaaaaaatggtagtttggggccagtgagatacgtggctgtcatcaagtctgacaacttgcgttccatccctaagacccccatgtcaactgaaagaactggcccttgaaattgtcgttttacacgcatggtatgcacaggcatgtgtgccacacacatggtaaataaataaatgcaatttaaaaaaacctaaaatcagccagacaaaaacagatggtagttaactgcatgtggtcaaatacatataaacacgtataatcccagcacaggaaacaggacagatcaggagttcaaggtcatcctcagctaaatagagttctgaactacaggagacccatctcacaaggacaacaacaacaacaaaaccaaaaacaggctaagcagaaaaagaacaggttcaagacaaacctagtagaacatggcaacctatgcctgcaatcctagcacttaggtagccaaggcagaagagctgccctgaattccatccagcctgggctgaagagtgaggcccctcaaaagaaaacgaactcaagctagatgggcatttggattctggctcttctacagtttttctctgagagcagagctagccagctaggtgcttttttttttttttttttttttttatttaagattttttatttattattatatgtaagtacactgtagctgtcttcagacacaccagaagagggagtcagttcttgttacggatggttgtgagccaccatgtggttgctgggatttgaactctggaccttcggaagagcagtcgggtgctcttacccactgagccatctcaccagccccagctaggtgctttgtacttagttttttgtgtctcattcatttccaaacattgtgttgagcttctgatcagcaacagttctagcaaacttcctttattcatctgcaggtcctcatacatttgcaccttgaaatctccccaagcttcctgtactcagttaaactgcatcctttattctctctcctcaccacactggtagactgggttaaaaagcctgggctcatgtttcatctcaatgggaatgtcgtgggtggctgcatctcgggctgcaggtgccctcaaatcactgggcagaagtgccaaaggagtagaagtaggtaggaactgtctgtctgtctgtttgtctgtgtccagtggttttttagcatacagctattgccatttctttcttatttggtttattcaatgttattgaaaaaatttactagtggggcaactagttgatcattcatccactgacaacttgcatcttttttttcgctgctacgttaaatatcaggcagactgttttatagatctgtgcactctctggcactaaagagttgtctgaatttgatttacatcacagtggacagatgggtagaagacccttagaatgctggatgagagggagcgtgtctgtcatccagcatttgggcaaccgggatttaaagatagttttgcatctgtggctaaaaagtaagtttgagaacagtctggactatatgagaccctatctcaaaaaaaaaaaaaaaaaagtcaaaaccaatgcaaactggacatgttggtggatacttctaatcccagcactgagagagatgcagaaagatgacggcaggtttgttggtaccaccctagtcttcctagggagctccaggtcagccagggttaccgaggggaactgtcaaaaatgaaaacaaacaacaaagacctttcaactgggtatggctgtttgcacctttaatcccagcactcaggaggcagaggcaggtggatctctgagttcttggccagcttcatctatagagttccatgacaaccaggactacacagagaagccctgtctcaaaccaaaaacagagagagagagagagagagagagagagagagagagagagagagagagagagagagaacttaaagcaggaaaccattgtgatctcatgatattgatacaaattttaccattactgctaatgtttagattataagttaattggttgtataaagaggaatctgtagtataatgattttttttaaagcaccaccttaatagggactgcccttagatcccatagtggcttgccaatgaaacatgtcatctccaattacacctgcagaacatatggctgaagagccacaagaacaaatcactggattctaaattccgtgtttaatctgttctcagcactggggtctgcttgttgctgtcactctcacagtgagccaaagttccagccacacactctggcagaagggaggattatctcttcatctcacactggaagaagcttctatcaattcgtgggcttggtggcctgtgtgtcctgtaatttctgatactgttttattctgctgtctcctcccaactcctcaagttagttctagagcttctacatttgtttaaatgactgtttgttttatttagttatattttggagacaatgtttcaccatgtaaccctggctgccctgggttctatagaccaagttggatttagagatccaccttcctcactttgccttctgactgctgggatcaaaggtatgtaccaccaatgtccatctaaatgactatttaaatacactagtaaagctatactgagccaaaacagtggttgcccttcaaagcagaaatgactggaagggaacaaaataggactttgttaatgtcttaggtgtatattgctgtgaagagacaacatgactaaggcaactcttagaaaggtggagacagagctgagattctacatcttgatccgaaggcatcagaaggagaccgctacaccaggcatagtgtgaacatacatgagactccaaagcccctccccttcccctcacagtgaaacacttcctccaacaaggccacacctactctggcaatgccatatctaatattattgctccctatgggctacacatgagtctatgggggggggctgcttcagattgttcatagctgataactatgatttgtcttatgctctaggaggggcatgatttttggcagctgcagacagttatgcttggaattatggggacttgagaatgtataaatttgagagccctgagagggcctgtgtcggcggctgctgctggtgccttttgctgctattgctagattgctggttgggatactcttgtcaatggagactggcacttgcccctaggaactggatgctcctaatcaacaggaagtagtctaaagagttctatacccctttttcccctctaaccttcttcctctcctacctagtgttgaggggttggaagggtctagcaaggagaagggtggtagatataagaacccaataaaggggactgaaaagtatggctacatatgcatattatttgagtcttgcatttttaaaaagtttaacatgtgtcttagtcagggtttctattcctgcacaaaaatcatgaccaagaagcaagttggggaggaaagggtttattcggcttacatttccatactgctgttggtcaccaaaggatgcaggactggaactcaagcaggtcagaaagcaggagctgatgcagaggccatggagggatgttctttactggcttgcctcccctggcttgctcagcctgctctcttataaaacccaagactaccagcccagagatggtcctacccacaaggggcctttcccccttgatcactaattgagaaaatgccttacagttggatctcatggaggcatttcctcaactgaaggtcctttctctgtgataactccagctgtgtcaagttgacacaaaactagccagtacaattgaccccttgtcaacttgacacacaaaaacatcactagtaagcctcaacccttacattcttattcatccccaaggtctaaataactttaaaagtcccacagcctttacatattcttaaaatttcaatctctttaaaatatccatcttttttaaaatccaaagtctttttacaattaaaagtctcttaactgtgggctccactaaaacagtttcttccttcaagagggaaaatatcagggcacagtcacaatcaaaagcaaaagtcaatctccaactgtccaatgtctgggatccaactcacgatcttctgggctcctccaagggcttgggtcacttctccagccaggccctttgtagcacacacatcatcctctaggctccagatgcctgtaccccactgctgctgctgctcttggtggtcatctcatggtactggcatctccaaaacactgcatgaccccttcagtcctgggccttcaattgcaactgaggctgcaccttcaccaatggccttccatggcctctcacagtaccgagcctcagctgctttgcgtgaccccttcatgccttcaaaaccagtaccacctgggtgaaccttacatattaccaagtcctgctgcagcaggagtacaaccttggccatctctggaacacagcctctttgtgctttcagaaaacacttcccagaagatgtcacctcaatgatgctggtctcttcttaatcaccgctaatttcttagctccagctaaccagcatcaatagtcccagtaatgcaaagtttttgctttggtagttctggtatcttgttaatcacagctgattcttcagccccagctaaccagaactacagaatcttcacaatcaaaacagcaatggccctgaaaagagtctttaattttccctctgaaatttcacaaaccagagctccatcttctgcggtgttctcaacattatcttccaagctcctacacaacatctgacagagctcttaacaacggatggatcttcaagcacaacgttctaaagtccttccacagtcctccccaaaacatggtcagattgtcacaggaataccccactctgctggtaccaatttgtcttagtcagggtttctattcctgcacaaacatcatgaccaagaagcaagttggggaggaaagggtttattcggcttacatttccatactgctgttggtcaccaaaggatgcaggactggaactcaagcaggtcagaaagcaggagctgatgcagaggccatggagggatgttctttactggcttgcctcccctggcttgctcagcctgctctcttataaaacccaagactaccagcccagagatggtcctacccacaaggggcctttcccccttgatcactaattgagaaaatgccttacagttggatctcatggaggcatttcctcaactgaaggtcctttctctgtgataactccagctgtgtcaagttgacacaaaactagccagtacaacatgtatgggtgttttttttttcctgatgtatgtttatacatcacatgctccttaaaagttctatactaccacgtgggtactagaattgaacccagatccactccaaggtcagccagtattcttaaccactgacccatcacgcgagtccctgagtgtcttcattattttacttcctgatacatcttccattatcttatactgtcttattttaactccagtgcatagtgcagtgtctggtgtgcagatagacttgttatagactgtcttccagtttcaatactgaaaccaactcctgagtaggttcctgagttcagcgtagagttcattttactggtggcaaaagacaaactaacatagttgaggggcaaggaggcatggacatgcctttaattccttcactcaagaggcagatctctgtgagttcaaggccagcttggtctacacagccaattttgggacagccaggggtacatagagatcctttctcaaaactctgtctttcctggccccctgaccctccacacacacaaaggaaaaaacttagcagaggtaaccctgaagctgctattgcactggtgccaaaatggagttaagaatatatataatttattttttaaaaagttctccaagatgggcatcaaaacctatagcattttcttttccgaagacccatcccctggttctttctggacttcagtcctggggggactagttgtggcactccgatttcttgaaatccttctagaatacttatctttggtctaacatgataaaaaaaatcacagtaggcccagccctgccttctcaatgctcctatcctgagagacccagactctgctgtttaccctagagtaaaatcatgcatttgcaaaggctgtgggcttcctgaatgaattctgaaacaggatgtctctctctgtctcttcctcactctctctttgtacccgattacaattagctacaatgatgctggactacaggatacattcattgagcaaagaaatgcggcccttgcttatctgtcagatccgaggcatcttggacctcacaggcaacctttcagaccctaccacgaataggtagaagccgcccgtgaataccgggaagggcaccggtcctcgcgcagttttggattcttttaactcccagtcgcgtctccctcccgctcccgtaggggagtcgcctctcgtccccgcagcccctcccccgccgcgccgctccgttccgctcagcctcccctcctcccagctcctctctgtctccccctctcggacaacgtccccgtccggcccggccctccccggctcctgtttgtgaatgagatgctcagtttctcaatggagccgtggggggctcgggcggacgcggcgcaggccgcagcgctggccctgagccgggagggggacgccttttcctcgctcgctcgcgcccgccctccctgtctccgcggcggcttttgaggaactgggccgcgaggccacggagcagttcgcagggcccgcatccccgtggacgcccgggctgggcggtctcgaggcgccggcgagctctgccccgggggttaagcggctcggaaggccgacggcctccaactcccgccaggcgccttcgcggtggctgtaaaagttgtggactcctaaaaaagaaagaaagccaagcagacctcgaactgctgttagttcctcgcccgcactttctcctcctcaggacaggaggggtggcgtgaggaaaggagtgaagcaaacaggaggcatttcctctccgcggggagcgacagcgggctctccccggccagcaggagcggcgttggcagccgccgcgggcgccgggcgctcgcaccatgcgcgagccgaccgagagctgctgaggcgccgggccacagaagcggagcgcgagtgcagcgggttctggcgctcgcccaccagacctgccccggcggcggcgggatggagccggcgaccgcgccccggccggacatggcgccggagctgacccccgaggaggagcaggtaagcgccgctgcagcggtgggtgtgtccgagcctccgaggcctaggccggcctctgttcgccgggctgcgctcctcgccccgggccctcagcggctcctgctcgcatttcaggcctgcgggctggcctccccgggccggagaccgcgccccaggccatcgcccagcccagccccggagccgtgggacccctggctctgagattcttatgcttcgagacttccggggggggggggggtccgtgctgctccatttcaatgaatattaaagttcctcgaactggggcgggctccccactggatgactgcaggacaccttgtcccaggcccttctactctctggaagcgtttgcattttttttttttttctcgagggtccgttgttttcaagggcaaggaaagccatttggggggaggattcctaggtggttgtctccgttcccaagatggggggaggtagcgctggtaaagaggtggcccagattctcaaaggagcccttcaggctttcagactgctgtgacgggcctacttggacagatcctgaaagatctgttccttttctagctccccaagtccctggccttgacctccctattctgctttcccaggctaggctcttaccctcgtccccatttccctgcccccacctcatctgacagtctccatctttctgaagcccacactggagttccattgtccctttttaaagcttgagatcttaaattcccagaaagtagtagcttgcgttatcatttgaggggtttctgtaagcgagaagcctagcgagcgctcttataactttacaccccccccccccatattccagctgtggaaacacggactagatgagattcagaaccccacggattgggctcttgctcttctctccttggcactgctcatatccaaacagaagctgtgctcaaatatggccataatctgcttgtaccttacaaaataaatgaaagaggaaaaggtgagacatgctggtaatgatccgtttcacactctcacgccctagttcacaggcccacatttgctaacacaatctggagtggggagatgtctattttgacaaactaacattggtttaatggtttttttttaaagacctttttatggtttatttatttttattttatttgcattggtgttttgcttgcatatatgtctgtgtgggggtgtcaactcacttggagatggattatggatacctgtgactgccatgtgagtgttgggaattgaacctaggtcctctgaaagagtagccagtgctctctccagccccaagacctgatttttaaaaagcccttgaattttcttttggaaaagtcatgctttctgtggaaatgatgtttttgttttgttttgtttttttaatttcccccagacctatactcttattgactttaaataaactcagcatgagtaaaaaaaaatttttttttaaatttacttattttatgtatatgagtatactgtagctgtcttcagacacaccagaagagggcagacattcagaagagggtagacataccagaagagggcattggatcccattacagatggttgtgagccacggtgtggttgctgggaattgaactcaggacctctggaagagcagtcagtgctcttaacctctgagccatctctccagtaaaaaaaaaaaaatttaagaatacctttttaaaaacaaatttgcaaatagtggtaacagcttggtaactgcaacagtgttttcaaaatgctagtgagacagtgcaagcaggtggccaagggccaaggagccactctgccaggactgggaaaggcctccctactaatgtgttaccttgattttttnnnnnnnnnnnnnnnnnnnnnnnnnnnnnnnnnnnnaacctgcagcatctcaacatgctggcctgggaactcacagaaggatccacctgcctctgcttcctgagtgctgggactaaaggtgtgggtcactactgcaccacaggttgatttatttttatttatttattatacactgggtgactttttttttttaacacattcattatttttctttcattccttaaatgttcttaagatgtgtatgtttctgttgtacactatatataccactttatattaagatgtgtatgtgtcagcggggcagtggtggggcatgcctttaatcccagcacttgggaggcagaggcaggtgaatttctgagttccaggtcagcctggtctatagagtgagttccagggcagccagggctacacagagaaaccctgtctcgaaaaaccaaaaaaaaaaaaaaaaaaaaaaaaaaaaaattaaattaaaaaaaaaaaaaaaagaatactctgatgtggccagctgtagtgatacacacctttgattcccgcactcaggaggcagagggatctgagtttgaggccagcctgtcctacacagcaggttccaggatagttaggggagaacagagaaaccctatcttgaaaaaaggaaaaaagaaggaaagaaagaaagaaagaaagaaagaaagaaagaagaaagaaaaggaacctgtaatccacagaattagtattgtaactggaggtttctttctctaccttataaaagaacaaatagaaattaaataactatgacctaggaaaaaacctcagccaaacaaaaacacacactcaaaccatgtctggtttccaatgccagactttgtagttactccaaaatgttgaaagacaaatataatagtttcttattttagttcaataaaacatttttttagttttctaattaattaattagctaattaattaattaaaagtcgaagtttccctatgtagccttgcctggtgtggaacagcttgtagagcaggctggccttaatttcacagagatccacctgtctgttccttccatgtgctgggattaaagtcatgtaacaccatgcctgactatcagagttttcctgagtgttgggattataggcttgctccactatactgggcataaaaggtcttcctcctcttcctcttcctcttcctcttcctcttcctcttcctcttcctcctcttcttttctttttgtttgtttgtttgtttgtttgtttgtttgtttgagacagagtttcctggctgtcctggaacttgctctgtacattaggctggccttgaagatccccagcttctgcctccagagtgtagtgattaaaggtgtgcgccaccacattggctataaaaggtatgcttaaggtcagtcttggtggcactggggaggcagagttggaagatctctgagtgattttcaggccagtcagggctaaatagtgaaactatgttccaaaaaagaaaaagagtttgaaaaaaaaaaaagaaagaaaaagaaaatcgttaggttagttgggtcttattttgtatgtctacttgtttacttagctctttgtggaaagggggtagaccccagagccttttatgtttgaggaaggcactgtactgttgagctattcttattctctgtcatggaaccctattcggtaatcaattaggagattatactgactagcatataaagggtggagttagtctttttggaatgttcccactgctttatagctactgtggactactctctcctgaagattaaatatgtctttctgtagtcatgccaatcaaaattttggacacttttttttgtttttttgtttttgtttttgtttttggctttttcaagacagggtttctctgtattgccctggctgtcctggaactcactctgtagaccagactgacctcgaactcagaaatccgcttgcctctgcctcccaagtgctgggattaaaggcgtgtgccaccaccaccaggctaattttggacattttattgcccttattccttgtataaaatgtatcatttgtataaaatgtattatcaggctttcttaagtatctctttaatttgtgagcttcaggctgtcaccctgactatgatcacaatcactcttgtctagattagtgttttatcccaataagagtttactttaaaatttttttaatatttgtgtatatgccacagatattacaagtgccatggcaggaatgtagaggtcagagaggacagctttcaggaactggttttctccttccaccaggtgtgatccaaagattgtactgaggtggtcaagcttagcggcaagcatgtttacctgctgagtggaggctctggcctcctgtctgatcctatagcatagttgagaagctaaactcagattgcaaatctggtttcatcttcccttcagcctgtccaccttccaaatcagcgctgctaggaatatttttttgttggagatatcctgactgtggagactggacttgccccaaggaacccaaagcccttaatcagcaggaagtagtctaaagaggtctatgcccccctttccctcaaacttcctctctcctatcaagtgttgggggattggaatggattagggtggaataaatgttggaagggtggtagctgtaagaactcaataaaaagctaaagagaaagtatgcctacagaaagtcatggtggctcacattgtaatctcaacctaggaagttgaagttggaggattgccatgagtttcaggccaatctggactaaagagtgagatcctgtttcacagagaggggacaggggttggggagatagctttttttagtaaattgcttaccttgtaaacgtgaagacttgatttgattcccagaattcacaaagaagttctgggtgttggtggtgaacacttgtaaccaaggagctggggaggtggagacaggaggatcctgggctccctggccagacatcctggcctaattgctgagtacgggacccacaagacacagatacacacacactgaaaaatgaataaaccataaatagtgactcaactagaactggataatgatacttaaattaagtaactatagccttgtaaagtcttacatggttatatggttattccagtagcaattgatggtgtaggacaatatagtaattctcctttttttgtttgtttgtttttttgttttttgagacagggtttctctatatagccctggctgtcctggaactcagtttatagaccaggcaggcctcgaactcagaaatctgcctgcctctgcctcccaagtgctgggattaaagacgtgcgccaccatgctcagcatggtaattctcttaagtacttataattctattcattgccaactaacaatggtttcaataatttatattcttctacataaaaagaaattaatctccagtatgctgataacaagcattatattatattatattagtgctaaggattgaacttaagatccaatgaatgctaaacatatgatctaataatgatctacactactcagtactagtttttttaaaaaaatttttaatgaattacaaattaaaaaaaaatcgagccagtgttctcactatagaccaggttagcctagaacttgctaaataggtcgggctggccttaaactcctattcttctatctgtgcttcctgagtgctgataccaaaagtttgtgctaccattccttgcttggttttttaagacatgatttcattatctggctcagattggccttggaaaatcactgccatgagttatctattaatgtttatttgcaaagcttgtaaagaaaatccttatttcagctctcatagcattgtaaatactaaaaaggactcactggagcacttagtgtgactgtaaacagtcaatcgagctagccactactacattcctttgcatattgaacttttggggatttagttactgaaaacaatcctaaggaggaacaactgtttcaattcaccctgggatctatatacttagtggtttttttaatattattaatatttagtttacttttttgagacagggagaccttttgaccttggctagcctggaacttgctttgtagaccagtagaaagatcactcctggttgataatatatgtgtgtgtgtctgtgtgtctgtgtgtctgtgtattttatttatatgcatatatgtgtgtttgagggtaggtttgtgcatatgagtggagtgtccgaaatatccagaagaggacgttgtatcccctggagctggagttacaggcagttgtgaactggtcctctggaagaccagcacccacttttaactgttgaggcatctctctagtgttctggtgtgtgtgttgctgtggatcaaacttggatttgtgtattctgggcagtttctctactgtgttggcttttatgactgtgagaaaatgagtactttgaatctttatagtattgggtttttttgtttttgtttgtttcttttaaaaaatatttatttatttatttatttatttatttaatgtaagtacactgtagctgtcttcagacactccagaagagagcatcagatttcataatgggtggttgtgaaccaccatgtggtttctgggatttgaactcaggacctttggaagagcagtcggcactcttaactgctgagccatctcaccagccccgtttgtttgtttctttggtttttttctgagacagggtttctctgtgtagccctggctgtcctggaactcgctttgtagaccaggctggcctcgaactcagaaatccacctgcctctgcctcccaagtgctgggattaaaggcgtgcgccaccacgcctggcttctttatagtattgttgtgggaactatttaaaaaaaaacaaaaacaaaaacaaaaaaaaaaacctggcacttcccacgctggcaactctcagccttggtggcctagctggccacactatggtgggcaacggctgacctgttttaccttgtggagactctttggcctggagctcctgaaacagctccacccagttctctaggttcccactggccggtcattgccaagccagccccgtgcttcaaatcccccacagcctttgtggtgcacatctggcaaacccacactttgctgccgtacctttctctcttgaaccctcccagacgagcatgtgaaggaaaacacaacacaaacttagttcagaaacaacggtaactcaatctctgggtgcaacaactaaaatctgatcttgtaagccttattaaaatccagttcctctggtggctaatccttgtggatcctccatgatactggaaaactctagcagctacatcttacccctctgctgtccttgttccctcaacatagtatagctttcaaaaatcaattctaattttatactttgggtttttttttcataatagattcttttaaatatctgttgttgttgttgttattttgactcagggtttctctgtgtagccctagcagctgtcctggaacttgttttgtagaccaggttggccttgaactcacagagatccacttgcctctgcctccctagagctgggattaaaggcatgtattagcaccgcctggctaaagttaaatatttaactgctgtaatgaggacttcaaagatttttggcccttttcccaaggtcagaggtttgtcctttcttgtagctaagaactttcctttcccacagacttccatgtcctgtgctaaatgtcatctgtccccctggaaggaaccagacgtcaaggaccaaatgattcatgatgttaaattgaggcttttccgagacatcgcctatgtagaacacaggaaagaaatggaaggaaaggtgaagaattctcagcctattactgcattactaagtatgtaatcagcaattaggtgagatgttatttgggtttaagtatatttggaaataagagtgaaatatgaattttactcttaaaattttggagcctgagttttggaattaagagttttgtaattattaagcacccacaggtttttttcctagaatgtgacctattatttacagaccttagagcttcagttccaggtgtgagcttccacacctgacaggattagtatattggaataaacttttctaactatggctttatcttcttggaaaatatataggcctgcctcattgtatatcagagagactgtctcattacagtctcaatactctggaactgagccctaactctggtcttttatcagttattttacatttcctattttcatcctgctttaaaactttagatgatagcatattttatttttcttgattaattactagaacattttctctctgcataccttcatataacagctcatcagaaagactgggaggaacttcagagtagcagggcatttgttttgtatgagaaagggctgggtttgaggataacctgggctacatagtgagactcttaaaaaacaaaataaaaccaactctttcagttatttcctaactactggagtaattgctagtttttgttctgcttctttggagtttgggaagaagctcctgtcacactttactaggcctgcacttttctgggctggggacctggaatcagctgtgtctgcttcctgctttagaaagaattcttataagccaactcagtgggttggagatgtggctagagtgctggagtgaatcctgtcatatgctatctatccccagcaccaagttagaaactaaaggttaatgttgggtttattctatttaaggccagagagatggctcagtggttaagagcacccctgctcttctagaggtcctgagttcaattcctagcaaccacatggtggctcacaaccatctgtaataggttctgatatccaattctggtgtgtcctaaagacagtgacagtgtactcacatatataaaatcttaaaaaaaaaaaaaagaaaaaagaaaaagacttgcctacaattcttttttctgtttttgttttttcttctttttcttgtctctagggattgggttttgcactgtagcccaaggatcctgacactcctcttgcctcaccttgccccaggagtgttgggatgactggggaaagctgctacacccaaatgttgtagagttctggactcccatacttcaggccctaagctctgctgagcactagacactttcccctccccctaattgagatagcatcttttttgttgttttattttgtttgtttgtttgttcattcatttgaaacagtgtttctctatgtagtcctgtctgctctggaacttgctttgcataccaggctagcctggagtttatcttgtagaccaagctggccttgaactaagagatctgcctgcctctgctcctcaagtgctgggagtaaaggtgtgtgcatcaccagccccagctgagcattaggttcttaagattggggacaggaataggatgcagaagctgaggagttccatgacctatggggcacattatttgtttattctgggatgtgatattttggtctggactatgagagactgtgacccaaatagtagatgagagattattttttaaatttattttatgtgtatgagtgtttttggatgcatttatgtatgtgtgtcacttgcatgcctggttctcatagagttcagaagaaggctcagattccctgaaactggagttaatggatggagccaccatgtgggtgctgggaacttaaccctggtcctctgtaagagcagccagtgatcttaactccagccctagagatgacttttcttagtttctgtttccatttaggccaggtgtaagtctttacttaacaggtttagcatttattcaagtaagttccctaagggttggctctggccctaacatgatccattactcctgtgttacttactacgatctttaaaaattggccttctggtggtgcatgtttgtaattatagcactcaaagtcgacacaggaggatcagaggaattcaaggccgtcctaaggtatatctcatgttcaaaactagtctgacaaaatgagaccctgcctcggcttaaaaaaaaatatcccaggctggggagaagagcagccagtgctcttaactactgtgccatctctccagcccctccagccctatttaaaaaaatattttaaattatgtgtgtatgtttgtatgtgggtatgttcatgtaagtgcagatgtacaagaggtcaaaggtcaggtccctctggagcttgagttaacaggcagtagagagttgcctgacatggaatgcctgggaataaatttgggttctctgcaagagccttttaactcctgagcccttctctctgtgtactctctcccctttaccttttcattgtctttttccttttgagagagggttcaagtagtctaggctgtcctcaaactagaatttattgtataacagaaaatggcctcatactctggtttattttcttaaacttttaaagcattgcacttctttatggtggtggtggtggtagagtgtgtgtgtgagtgttcattcctgttctctccttccaccacatggttaggattgggtgcttccaggttcttgatctctgacctaaatacttgaacatactggtaaggaaactattcagagcaaaataatagaaaagataagagtgcaatgcaagagagaagcaggacccttgagtgaaagtagttgtcttagtcgctgtttgctttattgctgtaagagaccaaggcaacatttttgttttgtttttgttgttttgtttttttagacagagtttctctgtgtagtcctggctgtcctggaactcactctgtagaccaagctggcctcgaactcagaaatccacctggctctgcctcccaagtcctgggactaaaggcatgggctaccactgctcggcttcaaggcaacttttataaaagaaagtatttaattggcagcttgcttcatgtcaggggcttggtccattatcatgtaggagagcctagtaccagagccagagctacgtcctgatgtgctggatcagacatagaaaactcagagcccaccaccagttatacacgtcctccagcaaggccacacctaatcccctggtcctttcaaacaattccactctctggtgagtagacattcaaataaatgaacctatggggaacatgttttatcaagtcactatggtactatggtacccattattgatttttggtttatttttttctttttgttttttgttttttgttttcatagaaagtttctaagtgtatctttggctgttctggaactcatctatagaccaggctggccttgaattcacagagatttgtttgcctctgtttcctaagtgctgggattaaaggtctgtgccaccattgcctggctagctctgattattgttgtgactttcttttatggagttaagagatgggaaaagggctggagagatggctcagtaattaagaacactgactgctcttctgaaggtcctgagttcaaatcccagcaaccacatgatccgccgtaatgagatctaatgccctcttctggggnnnnnnnnnnnnnnnnnnnnaatgccctcttctggggtgtctgaagacaactacagtgtacttatgtaaaataaataaataaatctttgaaaaaaaaaaaagagatggaagaatgtgggtattaggggtataacgagggtggcttatttgctggattatgtcatgtgtttaatttttctactgcaaatcccttcccacgatgcacctattttaatatgaacaggcatcagatggtaaactctccctgaaagttcacttggagtatacatacagctcgctttagtgtttatttattgtttatatgtaagtacactgtagctgtcttcagacacaccagtagagggtgtcagatgtcactacagatggttgtgagccatcatgtggttgctgggatttgaactcaggacctttggaagaagagttagtgcctttaaccgctgagccatctctccagcccccgctttagtgtttatgtactccatgacccacttagagctgtatcagaccttctgtttttcatacttgttatattagaaatgtacttgaatggaggctacctaaatttcggttggaaaaatggctcagtgataaaaagcatatactgctcttacagagttcaggacctgagttcagtgcagaacatcctcagcaggaggctcaaaactgcctgtaactccagtaacagggggatccagtgccctcttctggactccacaggtacctgcactcacatgtacacacacacacacacacacacacacacacacacacacacgcatatacacttataaaagtaaaatcccttttataatcaagaaaactatctgattgtttctaggcatgaagaaatctatactgttgtgtgtatatgtgtgtgtacacacacatttccatgcatatggaggtaacttaaaccaaatgggatcctaggccaagggaccattgtcatttatgcattcactaactagaatagtgtactcagatatacctgaaattggctattggctaggtggtggtggcggcacacacctttaatcccagcactcatgaggcagaggcaagcggatctctatgaatttgaggcctgcttggtctacagaactaattctaggacatccaaggctagatagcaaaaccttgtctcaaaacaaacaacccaaaatctgtgttgctgcagctcttaccccacagcttagcttgagatctttcttgtatgtgatggcttcccaggtgtcccttcagctgtgtggctcgctcactcactcactcactcactcagccaacagcaatgggtagtgctggaagctgcctgcaggttctgtcctgtgcccagtgagcagtggactttactctttctgaatgttagggagcttcctgttgttcaaatgctgctgcttttatgttatagtctttagtcttataatatctgatatgaattttcttttatgacaatttaaagtttttgttgtcaaattattattattattattattattattattattattattattattttgggagttctttatacttttactctttgctggagaggtttttgtttgtgtgggccttgtgtgttgtaggcaagcactctacctatgggctacagctccaccccttactgcacctcctgattattttacttaaacatttttttgcagcaaggctttctctttaagttgctcgggttggcctacaaaatatgaccctcatgccttagccttttgagtagctgtaattacaaacctataccaccatggctgaattagagaggagtttttaagtctggaaagaaggggcgccacttctgtttagtcaacatcagcaaatgcctctagcaggaaagtgagcatggcacccatgggagagtcctgtctaagactagaggttcaaggcctttggccttgcaatgaagactgccaaaagacagaatcaattggtagaatagttttaaaagaaaaaaaaaatttttccctcaggtgacccagattggccttaaattttctaagtggcttagataaacttgaaccccttatcctcctttattgactccaaatttcgggattataggcttatgccacccactttgcctgacttaatttaaaattagctatgtatgtagcggggaaaggggcagttataagtacatgtagggggagaggttatatgttgggtggcttctattgttttccacattaattttttttaaagatttatttatttaatatatatgagtacactgtcaccatcttcagacagaccagaaatgggcatcagatcccacattacagatggttgtgagccaccatgtggttgctgggaattgaactcaggacctgtgaaagagcagtcggtgccgctgagccatctctccagcccccgcattaatttttgagtcaaagctttatttctgaacctggttgagctaaatttgcttggtaagcccccagaccttctagtctctctaccttccagtgctgggattataaatgcgtgctactatgcttagctttttttgttttttgtttaggggagagggtcttgtttttcaagacagggcttctttgtgtagccttagatgtcccagaacttcaggcctcaaactcacagagatctgcctgtctctgcctcccaagtgctaggcttaaaggcatgcactaccacctcctggactgtgcttggctttttatctgtgtacttggacacaatcctgagtcctcatgtttgtgtagcaatctcctatccattgagctatctcttcaaccccactacactagagggtcacttgaatcagggatttggaagccagagagtaataaaggtgcaggagggaaagaagaaagtgctctccctttcctacctctcccagcggcaacttttcttctgacatagcaagtgttaccatttttgttgttgttgttatatccttccggagtaactgtgtaccaatatagaccctaatatattcttccttatgagatgtatactgtatatcttttagttctcaaagctgctttgtggagtggaaaggctactataaagtttgaaaacatttggattcatgcttacccactgctcttaagtacctgggctaccacacccaactaaacattagttaaatgaccttggacactttgcccctgttctgtgagtctttttttcttcctctctcatttcctcatgtccttttttcattgttctatttaagggttaaacctgggccctggtacaagctaggcaagaagtgttgtcactgagccttcatagttaataatacttcagtttaccattgtgttgagtatgctgaacatacagtttcatgtttgttgtatcttaaatgcttcacaaatggttactaaaaccagcccttctatgtcttcttcagtcaagagtctatgtgactggaaaccagccttgaactaagtgatacagtgtagaggtctggattgagttagttttttttgttttttggggtttttgttttgttttgtttttaagccaacaggaaggacgtttaaaaaaaaaaagatttatttatttattatatgtaagtaccctgtagctgtcttcagacgcaccagaagagggcatcagatctcattacggatggttgtgagccaccatgtggttgctgggatttgaactcgggatgttcagaagagcagtcagtgctcttacccgttgagccatctcgccagcccgagttagttttttcctgacagttaaataattaaaaggcaagaaaatataaacttaaaacaggctctgactcctacagacgagagtagaacctcaagtgtatctcaggtagtagcccgaacaaaaagagaatcagttgttctgccttagagcctcccccacctccccgccccgtctcaggttcattaaaaaaaacattttaagctgtaaatatatatatttcagataagaagcaagcatattaaacactcatatttcttttaatttaaagaatactacctaaattaagagtctttacagtttacaatatgtaaattgggtttaagttcctggactctaggacagaaaacaaaataaaacaaaatggcatttaaaagatctcagaaggtgtttatattagggtatttattttgttagcccttattactctaactgaaaggctcaaaattaaaacaaagcagaacattaaggaaaagaaatcatcttggaggccttatattgcctccttagtttaatttaaaaggatgcagtggtgatcagaaggactaagaacttttatgggtgctgccatccttggtttatgtcatgaggttccaagatggtggccaaataaagtggctgcttccatcttgatgaagtcactagcaaagatggtggtaagccacatggttgtttttttttttttttttttttttctcaaggtgagtccagcccctgtcaggcacaagttccagtaggatccacccaagtcatatgtggacatatgttctcttttctctacacagacactttagttagcctggataaagaaggaagtagtttctagggcctcagcaggtaggccccagttagcaaaataaagaaatcataggaccaaatcgcatagtctctcctcagagtaaccacagtcagtttgaagtctctcagcttttagagagaagaagagaagaaacttagccatcatccagttttagtttgaagtaatagttggtccgtctcactccttagcagagacagaataggaggtataagnnnnnnnnnnnnnnnnnnnnaattttaaaaatttccctaaaaatgtctctttgtcagaccacctggatcaggtttggtttaccctggctagagtgaagccctaggttaataatgtattaatagtgtttacagatctcttctccccccaaccccactcctgtccctcacccccaagcagggtttctctgtatagtcctggctgtcctggaactatctttgtagaccagagtgacctcgagctcagagatcttgcctctgctaagtgttgggattaaaagcatgtactgcatggcaggatcagttttgttttctttgccagttaaagaattaaaagccaggaaagatttgaactgcaggaggtggcgcacgcctttaatcctagcacttgggaggcagaggcaggcagatttctgagttcaaggccagcctggtctacagaatgagttccaggacagccagggcttacagagcaaacctgtcttgaaaaacaaaacaaaaaaacttcccccaaaaacaagaggtggcagcaagaaacttcaggcaccgcaaacagaaccagcaattgaaggaaggtgtttgttgttgtgtaggtgaggaatcacacattgagagacctcagagggggacttgggaagccaagaaatcttgtctcttctcctggtctgggcttttaaagtctctggagagatttcctccctactttagggttggtcacttaaagacaggatgggtgattaatctccaactggtgtgactggtcctgagcagtccttgacttgttgagccagtctaccagcaggggacctactgctggagaaatagctaccaggcctttgtttccagtcaggaggatgaggaaaatggtggcagtcttggaaactgaccacattcatctaactacagcccctctatccgtgtttacctaccagggagtctgtcttccataaggacagaacacattttagtatgtgttagaggtagggaagttgtgtggaggtgggtatttggaattcattttaggactatatgcatgccacaggcactctaccattcatctacacccctagccaaatttagtatttctaagtgaataggtattttctattcgtcaggtggtagagacattgggactttaacacttggatgttggagtgttgataagccttactcccttccactggaaggaagtcattaatactaaagagcttttcgtgtttaatagcctaattaactatggcctttccttattgcatgaagcttagggaagctttgttcagccttgatgtcccattgttcagttctcagtgtgatgtaaatcttctattttttttttttggttcttcaagacagggtttctctgtgtagctctagatgtcctggaattcactgtgtagaccaagctggcctcgaactcagaaatccacctgcttctgcctcccaagtgctgggattaaaggcatgcccggcatgatgtaaatcttttaattgtacttagcttaggttcttgtacagtgtggagtatctgtgagttccaggatagcctgggctatggtgtcatttcccttttttttttttccccaagacagggtttctctatatagtcctggctgtactgaaactcactctatatactaggctggcctcaaactcagaaatctgcctgtctctgcctcccgaattctgggactaaaggtgtgcgccaccactgccatgctatggtgtcatttctttaaaaatctaaagaaaatgggctgtagatatggctcagtggttaagagctctggctgatactctagaaaacatggattctaaagttctctattctagagaaccgccatacccagcctgcaacagatgtaatagaaaaatgtcggtttagtttagaaattagtgaacttgcagcagtgttgcaagtttgtgtgtttgtttagatcctgtttcttcagttacctgggagattgatgtgaactaagagggattaatagacaccaaaagggcaataatttacagtgaacgaaagatggggaaacaggcaggaaatgcatgtaagtgatagtattagttttttggtaggttagatcttttcccaaaggaagagcagtgctgtttgaactgtgaccccttgcaactacttagaagccaagatttattctaaaattgaccttcagctgaaatagtttctaagctgtgactcatcttttggcccactccttttttcaccaggaaatacattaaatattaatttgaagaatttcagttatccatcatgaagaatatgttgcttgtcagagttactaggacatatttttctggcagtcaatagggcaaccagtgattatttgtgtgtatgtatatatatatatatatatatatatatatatatatatatatatatatatatgtgtgtgtgtgtgtgtgtgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattggaaatgtaaatgagctaaatacctaataaaaaatggaaaaaatataaatctgtctagaaagactgtgaatatgagaccacctatttgacttctttcaggggttaatctattttatcagagggatggagatgcaggaggctgaggctgaacagaacaggtggtgtgtctgtgtttgtatctgtaaatatcgcatcactgtttacagtacattggtctctcttcatgcagggccttgtacaaccaaatcaggaggaattgttcctgtacttaaagccaagaacaacatcctgaccagcagggggacagaggtcagcttaagggaactgcaggacattaagaactttggaggaactgagtttggtaaaagaagacaaaatgtggaaaagaacacttgatctcagccaaatggctgagaggctgttagagaagggtcaacactgcatgttctcaagtatttttggaatttcaaaaatccacagtcatataagcagagattaggatggtggccaccagaagtggagaatgaggagaatggagagatggtgtcaaataggaagttacagttaggtctcctttatagggttgtaattatagttaataagaaggtggtgtatacttcaaaattgcaaagaacacattgcaagtctttacatcagaaaaaataattatttcagttaataggtaatttgcttgatttaatcattctacactgtatgagtatgtatgtgtgtgtatgtgtaggaataaaaacatcatactagggctggagagatggctcagtggttaagagcactgactagtcttccaaaggtcctgagttcaattcctagtaaccacatggtggctcacaaccatctgtaatagaatctgatacccttttctggtgtatctgaagacagctaaaatgtactcatataaataaatctttaaacaacaacaacaaaaaaacccacaaaaaaatcatactattccccataaatatatcattcatttttcagtccatatgaaaacaatacaaattaaaaacatgaaagattgtctatgtagtgacttaaaaaaaattgcaccctgggtatactggcttatgcctttaatcccaccactcgagctgagggaggtagatctatatgaattcaatgccaactttgtctacaaagaattccaagccagccaggctgtcctagtgagactatgtctcaaaaaaataagaaaagaaaagggcaagatgtactttgaaggaagtatatgaaagctgtgtgaaactacctctctggctggccttttatttgctatgtggaccaggcttgcctggagcttgtgaaggtacatctttctctgcctcttgaacactagcattacagatgtgaaacattgtatctggctttcttttgtagcagttgcctggaagatcaaatatttcattatagagtggcagttctcaacctgtagtttataacccctttgagctgcatttcagatatcgggcatcatatatttacactataattcataacagtagcaaaattacagctattgaagtagcactgaaataattctatggtgtgggagggtcaccacaacatgaggaactgtattaaaagaaggaactgcattaggaaggatgagaactgctgttctaaagggaggtttcttaaggctcaagaagtttaaagatctaagttgaaacattccttccaggaatgagaagagattcatgagactagggaagtaaacaactcacaagtctcaaaaagttcctgaaactaacaagatacacagaaatgttttccctttttctaccttatagaagtaggaacaggcagttgctagaggtaagacaggaggctgagctgccaggatgaagctttctaacctgttgtgctgcatgaaagtagtacatagagctgtagggatgcagcttttcagtgttataatccaggttgagggtagtacagctgcctttaaattaatttgtctctgctcctgtaactaatcccaataaactaatttgcttaccaaattgaactttgtgtagtcactttcatatgtagttggttacttttctggaataaatagacatttggttgtcatctccatagtaagtctcacctaacaggcttctacagcatgatttatcacaatgaagggtcatcttaccagttgagtatttattgatcatatctccttctggtcattcagatttcttctttctacctgtacaatgttccatgcatgttcatacagctaagcagtgagaaaggtatgttctttttactctagtgttttatttgcaaacaatattagaagtacattgcaaaactagatttaggggctagagagatggctcagtggtaagagcactgactgctcttccagaggtcctgagttcaattcccagcaccacatgatggctcacaactttctgtaatgggatctgaggccctcttctggtgtgtctgaagacagctacagtgtattcatatacaataaataaataaataaataaataaataaataaataaataaatactagattcaaaaggtaatgtgttaaactggatgtggctgcaaatgcatttaatcccagcatttggggtgcagagataggaagatctctgagttccataacagcctggtctacatagtgagtttccagctgccagagctacacagtgagaccctttcaagaaagagtcaaaggtgatgtattcaccaaaaagcataccccatttgagaagttcttgaggaccttcctgactgactggggctttgtttaggcatccgtgcctgcttttattcttttctttctttcctcattctgatgctggccactctacagatagaacacaaatgttcttggggagcattctaagtttgttctgttgtcttctctgagactcagttctgtggtctggcatcagctggttgtgggacagtgtgatctttgaaagcttttcatcatggtctgtttcttgactcttttcggctctgtgcttggttaagtttttctacttctctttctgaagtggtataagttacatttcctcagttgcaaggctcaaaaactcaactgcactccaggccttggactttcccctggtttataaatgtcctttgtgttttcctagaaaattgagtatgaatcaggtgctgtgttgtaaggtaacctgaccctcctgggattctagtttgatagttgtttaaacagtatgtagcaatttgaattagatttgcaagggagaattgttgccaagtctctgaagtaggtcatagcccttagcctttcccccttgttttctttttgtttgtttgacagtgtctcctatgactcagtcctttagagcctaggagagcttcaaacccctgaccctcctgcttcccctccccaaatgctggggaaacaagtatatcccactacacccaactccgtttcttcccctcctttcctctttcttttctccaactttgaaatgggatttctctatgtagttcttagcctggctgtgtagaccagggtgtcttagaacttggggccaattaattcttttgccgttctttgctttgtgaatgatgaaattacaggcatgtataacacttacttttctttctttttttcccccttgaggctgggtctgaattacattatcctgtctatcacacttgatatgtagaacagaacgaccccaaactcctagagatctacctgcctctatgctgggactgtggtgtgtacaatgcatagtccctatttttcaactgaaaaattagtgaagagagatttccccagtccatagtcacatagtagtttgggccttacacctctgaagcagcttcagggtttttgttttgttttgttttgctttggtttggttttggatttttcgagacagggtttctctgtgtagccctggctgtcctggaactcactctgtagaacaggctggccttgaactcagaaatccgcctgcctctgcctcccgagtgctgggattaaaggcgtgcgccaccactgcccagcgcagcttcagttatatatttttccttggcataggttaagaaaaaaatatgcctttctatgagtaaatccatctttttgttgttttattttttgagacagacactcattatgtaaccattgctgtcgtgggactcactatatacaccatgctggcttcaagttcacaagagatcctcctgcctctctttgcctcctgagtgctactatgcccacctgagtagatacttcataactgagttgattgataatatgggtatagttaaaattcagaaatgtcatcattttctggattaataatcaagaaaagtttcaaaatagttagaacagaatagcaatgcagagatcttttaggtactcagaatatacatgcataatatctcaatttaaataattctaaaatgaaaaaaaatagatattttggctgaagtcgggtcctagcagagttctctaatcccacctcctaggaggggtttctcattactccttcatgcatgccaatgctgtgtcctctctctgaactggctgtactttttatcctaagcagtaaagactaagactatataaatgtaacctttatgatagtttatataagtggcactattaggaggtgcagccttgttggagtaggggtgtcactgtaggcgtgggctttaagactcttgtcctagctgcctggaagctggtcttcttctagcagttttcagatgaagacgcagaactctcagctctacctgtactcttcctgtctggacgctgccatgcttccaccttgatgatcatggactgaatctcttaacctgtaaactagccccaaataaatgttctccctgtaagagttgccttggtcatggtgtctattcacagcagtaaaacctaagacaatgtttttaaattaaaatttaaaattacttttatttatttatttgtcggtgtgcatacatacaattccatggcacgtggggttcagaggacagtttgcagggtccgccatatgggacctggcaattgagctagaggcaagtgccttttcctgttgagtcgtctttctagctccccttcttcctcctacttttttttagatggaatttcatatagaccagactggcctaaaacttgatatgtaaaagagtctcatttggggaaaaaaataataatttttgcctgcttgttcctgttatgtttctaaaatatattctctttttactaactgtcctcatttttttttatttaaacaggctaccaagcagtttcttgaagagatcaacaagtggacagtacagtataatgtttctccactctcctggaatgtggctgtcaagttcctcatggccagaaagtttgatgtgctccgtgctgtagagttgttccactgctacagagtgagtggctcagggccagctaagtatttctatttttttcctgctttacgttgtacatggtgattttctacttctctcttattctgttaaagtgggtcaatgtccaccaatcctatgagagctgaggttgggctcctggagacacttgcttaatgtgcacaaagcttgcttgcagaccagcctgctacctgtgagaactgaggcgaagaatgttccttaatgtcatcctgtggccactcctggggttttcctccttgctctcttccctgcctcctggataacctgtttggtatattttatagctgtactttaaggcctcatgaagttgtagaaagctgccattctgatgaactttgagctaaagagctattcaagaaaagattggtgctagtgtcagctaggtcccattcttggcagtgtctttttggtatttgttttgttttgttttgttttgttttgttttgttgagacaggtgtctttgtgtagctagcctctgccttgtgagtgctgggattaaagatgtgagccaccattgcccagctacaattttttttttaattaaaaaaaattttttttaagaatatttattttatgtgagtatacttgctgtcttcacaccagaagagggtgtcagatcccattacagatggttgtgagccaccatgtggttgctgggaattgaactcaggacctctagaagaacggtcattgctcttaaccacagagccacctctccagcccttgttttgtttttttgagacagggttctccatgtagccttgactgactgtcccagaacttgctctgtagaccacgctgcctctgcctcacaagtgctaaaattaagggcataatctaccatagctggctaagattttttttttaaggaagtttaagactgattctgtgttatgtctgctttctgggattgtagcatctttgattgaaatgctgtatgttatgttactttgtggttagaaatttcttctgaagagataccatctatccttaaaaagaaaaagnnnnnnnnnnnnnnnnnnnnnnnnnnnnnnnnnnnnnnnnnnnnnnnnnnnnnnnnnnnctcacacttatcgtacggctcatccagtactcacttatttattccatagatattaatggaatacatactatgttaaccatgccgcagttgttacttaggagagagagtaaacaataaaaaaaaaaaaggatactagccttaaatctgaaggatgagtagggatcaagcactggtgaagtatggctaaagaagataatatgtgggctggagagatggctcagctattaaaggctaggtttataaccaaaagatagaagaaaacaatagttcagatcctcaatggtagaaagtaaaatttagctaagccagaatgttgagtgggagtcaaggcatggcaagagatggagagcacagataaatgaggccagatcattaaggcctgagaaatccattaatgatataagcaatgtgataaatttttccatatttgcattccagaaagattttgacaatatatttttggatagtgtatctcactgattaccttggagccaaaaagatcagtttaaagactgttgtacttaacaaggagagagaatggcagtattattaaacatgtaatgtcaggggagatggagaaaagtagacaaatttagagttcaaatgagtaggagctgcttaagctggtgtgtgaggaaaatgagtgaggcatctgagttgggacttgtatgtcaagatcagtgctggtaacattaattaatttaggagacattgaagtggggtgggttcatgtagaaagaaggtcatgggtttaatttgtccatgtctttgggatacccaaatagacagttcctgtaagcaactggaacctgagtgctggtacagaaaagaaatctgcactgggaatcggtatttctgaatagccaaactcgagctgactcttggaggcatcagaacagatggttggtcctgagaaggtggctgtagacaggaattatggtaacggttagctgccctggaatgctaaggcatgctacaaaggaattcacagttcagttagttgatttctaatgtcccatccctgagatttgatggctacataaaattgttctggatatgtcatattttcatattaattcatgtcttcattgtttcctttttaggaaacaagaagaaaggaaggcattgtgaagctgaaacctcatgaggagcctctccgttctgagatcctcagtgggaagtttactatcttggtaagtctgtggaacccatcttgtgctttgttacatccttttgtggctgttgccttatttggatttttgtgcctaggttccttatcaatacattttgctaaaattgttctaataataattgagttattactaattaaaagtattaataatagttgaattattgagttatggagcagaagacaaagttttttcttcattgatccattaaaaaagttgttggtcagcatgttgggaaaggttgataatgtatcaaagcacatccttacttaatggtaactctccactaattagtgatctcttggcctctcggacacatatgtgataatatgtttaaggtagcatagaagtcattgatctgttcttctccatcctgcctgggaaattagttataaagccagtggagaatcatcctttgattcctctgcagctgaagaaaatgtgacatttttttaaagccacaagaatatggttcaagagaatgctgagagaaccaggcctggggtgatgataacactgctccctttatggaagaatagacacaaactaaggaagttttgttagtagctcttttcttcatgtgtcattatgcaggataataagtctaaaagattcctgtgattgtcttttcacttctcaatattcccggatttatctgttttagaatgttcgagacccaactggagcctccattgccctcttcactgccaggttacaccacccccacaagtctgcccagcacgtggtgctccaagctctgttttatctgctggacagagctgtggacaggtaagcagtaagacgattttgtgggtgtccacctcatttaggaaagtgacagtgtgtgaattgattaaactcagaagtgctgtcaccattgtccctaggacacagcctggacagtctaagtagaaagcaactcctaggatgccgtgctcctttgcgtcaccttgcttattttaggattaataaaagctgagagagataattcataacaattgctaatacactgaggatggtttatttgatggaggaaaggaaccctgttgagtgggtgtggatgggtgtgtgggtgtgtagggcttccacatgctaaggcatatgctctatcattagcttatgtcctatgtatttctttttttccctttaactttgagatgcagtctgacttagttacccatatgaacttagtgttctcctgcctcagcatttcagacagtagagattccaggcccatgtcactaggcttaggtcatctgtttgttagttttgttcatgttaaaattctctgggggctgggtgtgatgaatcatgcctttaatcccaccacttgggaggcagaggtcagtgaatctctgagtgagccagggctacatagaaaaaccctgtcttgaaaacaacaacagcagcagcaacaacaaaaaacctagccagccggccgtggtggcacatgcctttaatcccagcacttgggaggcagaggcaggcagatctctgagttccaggccagcctggtctacaaagtaacagccagggctacagagaaactctgtctcaaaaaaaaaaaaaaaaaaaaaaccaaaaaaccaaaaaaaccaacaacaacaaaacaaacctagccatttgggagttggagaaatggctcagaaattaagagcactggatgctctttgagaggacccaggttcaattcccagcccccccgtggtagctcatagccatctgtaactccagtcttaggagattcaggccctcttctagattccatgggcatcaggcaagtcctccgtgcacatatatacatgtaggcaaaacacttatagacataaaataaaataaaataaaataaaataaacacaataagaaaaaaaaaactctatgggctaacctgggagtatactgggctaggtacttgcctagcatgtgtaagaccccaggttctttttctagtatggaaaacaaaaataaacaagccatgcccagtagtacctgcagtcctagcactcaggagatagaggcaggagtatcaccacaaatttgaggtttgcctggctacataataactttcaggctagccaaggctacatagagaggatctatcttgataaaaactaaagcaaactaaacaaactagtctgggagctgcagttatatggctcagtggtggaaagcttgtctattgccctgtttaatacccaatgctagaagatagatagatagatagatagatagatagatagatagatagatagatagatgatggatgcatgcatgcatgcatagatggatggatggatggatggatggatggatgggtagataggtggcccagtgggttggtacactcttttaatgccagcactctggaggcagaggcaggtgagtctgtgtgagtttgatgctagcttagtctacatagtgagatccaggctatctgaagctatatggtgatttcctgcctcaaaagggaggtggtgtgttgtagtaccagggagatggctcaacaattaaagagtactggctactctttgagagaactagactttttattcccagtacccacatggtggctcacaaccattggcagctccagttccagggtatccaataccctctctaacctctggttaccagacatgtggtgcatatacatacatgcaggctaaattctcacttgtataagaaaaaataaaataacagttggcttgttgtaatcttagtacttaggaagtggggaagatgctatgattttaaagccttcttaagctgtgaggggagactctgtctcaaaaaaagaacacaaaaacaaacaaaaccacaacaaaaaacctgatcacaacttatcgtggtcagacaaaatagtaccttagacaattaaggttgtaggatcatgaatttgaggctcgcttgagctgcatagagaatttcagaatggacttggtttttgttgttggtttggtttggtttggtttggtttggtttggtttggtttggtttggtttttcaagacagggttcctgtgtatagacttggctgtcttggaacttgctctgaagaccatgctggccttgaacttaacagatctccctgcatctgcctctccagtatgggattaaaggcataaaccatcacttcctggcttgttttgtttgttctgaaatagggtgtcatatagctttacctggcctaggttatggacttataattgagagtagccaagagactgtctaaagtgagcctctctgattagttaactacggacagttaacttttgtagcttctgctgttgatgcttaatgggagatacatgtgaatcctacacatactgttattttgcaaatgagaagttgctgaggagtggggaccagtcatttcagtagtattgtactccctaagtagcagtttggaatttctcagcccttcagtcttcagggctactttcaagactgtggatacttttgaaatgctcgcttagtttaggagagtgaaggaaagctacctttttcagaaagtccagtagcgagggaatgctaagatggatgttcacttatcttccaagtgatccaggatctacttgctgctttgattacactttatctacttccttcctttgaagcaaatgtgaagcagagactgtgttttaagctttttggtgtctcctgctgcatgtagctcaagattcaaactcagtaggaagcagttgactcattgtgatacctcatgctatatatccagagagcagcatctattttatatcattccatgtgtattcagaggatgagcaacttcaataggatcatggaacctgggtctttatgccctgtagtttgttttcattatacttctttccctgtgtcactgacttgctttaggccccaatcttttaggaaaaatcctgtaatttttcaaattggccctaagtttagcttgttgagaaaatggaaattctctagacctagataatctacttggtaattgtgcctctttttttctttttcttttttttagtgttttgttttgttttgttttgttttgatttcctttctagacagggtttctctgtattgccctggctgtcctggaactcattctgtagaccaggctggcctcgaactcagaaatccacctgcctctgtctcctgagtgctgggattaaaggcgtgtgccaccactgcctggcagttgtgcctctttgacagtatctttagtcttgaggaacaataatttctgtatagttataaaaagaaggagttaagaataatattaatgcattaggggctagtagaaataaattctgccagaaaaacctctgtgcatttaagaattaaagtttttttttctctttttgaaagttaattcactgaacttgacgtatattagatacacaaaccttaatttatatacttgaactggattttgaagtattttcatacacacataattgacaagaatttgttaattttcatgttaactccttttcagtgcttccctcttagattttgtagaagtgtggtggtatgggggctctcgggaggggatgcaaagatgaggacacggcataagaaccttgatgtggctcatacttataattgtagcactaacaggtgtggagtgtgtcaggaggattaccctgagtttgaagccagcctgagtgtaatgcaaagtgagcacacaggatgcataaaaccctctggaaaacaactaagacaaatacgtgtaaaaccttcctgtctagaaatagtgcaaacaaagacttcatatctgacaggtgagatggctcagtagctcaaagcacaagctatactaacctgagagcctgagcttgatccctgaatttcatggtggaaggaaaggacagagctaacttctgagaattattttctgattttcatacttgctatggcccaaatacatgagcacacacataccaacactatacagatgatgatagtattaattttaataacctttgggtgtgtaaggatctggcttggctttgaatgaaacatttgtattaaattaaatgctttgtttaatgattggtttgcagctttgaaactcaaagaaatggactggtgttcatctatgacatgtgcgggtctaattatgccaactttgagctagatcttggcaagaaagtcctaaacctgctgaaggtaaggttgtaaagagagaatccttttacgtgttcttttttctttttcttttttgggaaaatattatttagaaaaatgtaaacttcagatattatgttcaattttaaaggtcacctatatacaataactaatatctgcttccttataacaaaaagttatcttaaaagtcaagttgaaagatttgagatggcttagtgaagctgggcagtggtggcgcacttgggaggcagaggcaggcggatttctgagttcaaggaagtgagttccaggacagccagggctatacagagaaaccctgtctcaaaagaacaaaaaaccaaccaaccaaacaacagcaacaacaacaaaaaaagatatgagtttagtgactcatgccagtaatgcaagcacttgggaggccagggcaagagaaatgtcatgggtttgagttaggcagaactacacagtaaattctacttcctccttggctaccaagtaagattcagaccagcctgagctatgtaaggggtgaggtccttttacaaagcaatgactataaaactaaaaaggaaataatgaaagtgaaaagccacaggcaaattcttagacataagatgtccctttttggggctggagagatggctcagcggttaagagcactgacttctcttccaaaggtcttgagttcaaatcccagcaacaacaggtggctcacaaccatccgtcataacaaatctgactcctggaatatctgaagatggctacagtgttcttacatataataaataaataaataaataaataaataaataaatctttaaaaaaaaaatttgtcccttctcataagggtgaagactttttaaaaaaagtcccttttttgagttttgtgattattaaaggcctatctatgacaactatgaaaaatgccgtctagccagtgactttctagacatgtagctgaattatagatgaaatttagttttcatttcactttagtgcatgtaaattcatttggtctatttatattcatgtagagttatgcacatatatagatgtgtaaaagttccatacatataacgtcatagttccttatatctctatatcttaggcctagtgacttgttttgtaaattaatgtgtgcatgcatgtgcttgtattcttgtatgtatggaggccagcagacagccttagatgtcattctcaggcaacaccatccacttctttgaaacaaagactgccattggtctgtagttcgccaattagggtagactggatggctaatctgccccagggatccttttgtttctgccccacccctgggattacaaatatatgccaccacatgtagcaattttatattagttctaggtattaaattcaagtccttgtgcttataaggcaagcatattaccaacttagccatcttccccagccataaagttaatttttttttttgaattttaaaagataatcaggtaggctaagaatgtagttcagctggttcaatgctttgtagcattcagagggccctgcatttgattccaagtgcctatcatcaggaggtggaggccggaggattagaaactcaaggcctccttggcttacatagcaagttctatgacagcataggttacttttctgttgctatgacaaaacaccatgaccaggacagtgcatgagaggaagcatttaattgagtttatggtttccaagggttagagtccatgacggtggactaaaagcatggtggcaataacagctgagagctcacatcttgatctacaagctggaaggaagagcatctgaatggtaccaggcttttgtagtctccgtgcttgcccgcagtgacaccccttctctaacaatgccacactttccttcccaaacagttccacttagttggggctaaatattcaaatatatgagcttgtggatccattttattcaaactagaatgggctatctgagaccatatctcaaacaacaaaactcctctcaaaccctgaaaaatgtgctttaaaaaaaaaaaaagatgtatttatttaatgtatatgagtgctctgtctgcataaacatctgtatgccagaagagggcatcagaactcattatagatggttgcaagccaccatatagttcctgggaattgaactcaggacctttgaaagagcatctggtgtcgcatctgctctcgaccagcaagaacgacacgaccaccagttcttctaacagcagtttattcagcaagtttcaatcttcatctctctcgcttcatctttttttctcccgaaccccaggtctctcactcttatatactctcatcccccatccactcacagcaggccatgtcacctcaccaggcatgtagcttcagccaatcaggtcggcaggggcatgtctccaccaaatatggacttgtttatactgccagcatcatggtgcacctgtgcagctctcacatggcagtggcttattttcaggtgtatgaggaagtcaggtgcaagtcataagacttagctgcactcccgggcgccatcttgggactgctgccacaactgctcacaatctggtactcttaactgttgggccatctctccagcccccaaaccatgcttgcttgcttgcttgcttgcttgcttgctttatttatttatttatttggtttttcgagacaaggtttctctgtgtagtctcggctgtcctggaactcacttctgaactggcatcaaactcatatatccacttgcctctgcctcccaagtgctgggattaaaggcgtgcgccatcactgcctggctcaaaacatgctttttaatgtataactatttactctgactagggaagactgaatggaataaaatagattgtgcaagccagttacggtggcacatgtctctaattgtgttcaaggccaccttggactacataatcagatcctttgtctctgaaaacagaaatacaaatatactgtatgaatgaatgtaaatgttcaggaacttggagtgtagctcagtgggagagtgtacatttggaatttgtgaggtttgttgtgatgggattgtaatacttgagaaggtaaggtaggactgccaatattttaagaacagaccagtccaggatgactataggcaagacgctgcctttaactaaggtaaaacatcaaaacaaaaaatgcatttaggcaggtgtcctagcatggggtgagaagtgaagagtgggagtggggttgggggtaggcagcagagccaggtggatctctgtgagttcaaggccagcctagtctatatagcccattccaggccaatcggggcaagatagtgagagagatcctttctaaaaaaaaaaaaaagtcaccgggctgtggtggcgcaggcctttaatcctagcacttgggaggcagaggcaggcagatttctgagttcgaggccaacctggtctacagagtgagttccaggacatccagggctacacagagaaaccctgtctcgaaaaagaaaaaaaaaacgtcatttgtattgctaggatagctttttagaagttgaattgcttaaagggtatatgtacatttcaaagaatatgtaattgggggtagagaaaagtcttagtggtcatgagcactggctgctctttggctgcttacagctgcctgtaactccagttccaggggatacaataccctcacatcaatgaacataaagtagaatagaataaaataaaataagaatatataatggaagatgccttcctatggacactatcaatgggcaggtgttccaaggctgtatgagataacttcttatctctgtttggtcttattaggagacaggatccctaaatagtataggcttgcccagtgcttgctgtgtagaccaggcttgacgcctgctgtcctctgccttactgagaaaaagcgatttctccaaattgatcaagcagttaaaaggggctttgggtatttatactgaaatacagttttgcatctttgaaggaagggaaaaaagtagtttttaagtctgaatgaagaagcctttggagaacttggctgtggatttgtatattctgtgtagggagtgtttgtaaactcctcaaatttagcagagccaagactgagtgggaagaacaaaggctagaaaatgaaactgagattagtttattcaaaatgcaaaaaaatgaaagctacagtgtggcttagtcagttactggggactacttatttatttatttttggatgtatgcattcatgagtgtgcatgtgtacatgtatgtatgtgtaaggccagggatcaactgtaggtgcgtccttaggatctgtcaaccttgttcattgagatagggtcttttcaaggactcagggctacctgactggactaggcctctggccactgagccttaggatccatctctttgtctcacttgtgctgctgacttcatgtgcctactggagattgagctcaggttctctgtacttgtgtgggatgcactttttgagtcatttgagtcatgcaccgattgagtcatccctccagccccctgattccttattacatggtaagcctccctgagaaaggctgggatgttaacaagtggaatgaagccaagtactgtggcttaacagtgatatgctgcactatatgtcttacatacttttgtctttatgtcttatataaacctctttttttctctctaagagtagtttatttacttttctaagacctcatttgtacttgtacacactagatcgtgtgtgggtgtatgtatgtatgcatgcatgcatacatccatttgtgcattttattgtgttggttatcaaatttaagttttgtacatgctaaacacatagttacacctctggcctagattgtatgtattggtttaataaatgaacaaatggaaaaaagattaaaggtagacaatgttatatgtatatatatacacacatacattttgagctagatgaagattataaagtaaaatgtttatcctcaacttattaaaaatctaagttttgggctggagagatggctcagtggttaagagcatggactgtgcttctgaaggtcccgagttcaaatcccagcaaccacatggtggctcacaaccatccataatgagatctgacgccctcttctggtgtatctgaagatagctatataataataaataaataaaaatctaagttttagtaagctgaatttttgtaggctgcaaatatgtgtgctgttgtatgatatgtgcagtataaacagaaacatcagggccacaagatgactcagtgagtatatttgctataagagcctagtgattcaatacccagaatccatccatataaaggcaaaagcaggaaactgatccttgtgtgcacactgtggcacagatgtcaccactcaccaataacaaaaaaataaaagaataatttttgacctataaagtatatgattaacatgaacttaacatcattacttgtaaaggtaagtcagcttctaatttctttatttcttttaatcactttcaacctccctatttttgaattaagctgtcaggcttctctgttgcctatgcatgggggagagtggcaagaactcatactttgggcctgaacagtttcaggtatggctgggctttaactcctcatacattgactccacagggagcatttccagctcgactgaagaaagtgctgattgtaggagcacccatatggttccgagtgccctattcaatcatcagcctgctcttgaaggataaagtccgggaaagggtaaggcaatctcgtcgtttcttattggagctagataatacattccggcctctgctggcaagcttttgccagttagttttctgccttcaaagaatcctccgggctgatctcgcgtggtgtctcctcctttactatacccagtccctctctactcaccagtctgtgacacgatgccttcactgtccacaaacctgtgggtaggaaaaggccacaatttatctgacactttctttactacaccttgagtacaatagtactgaaccatgtgcctcataagtattttaaggattgtatgagttccaaagtttaacttagtgctacataagacactattaatatctaatagtatttgctgtaactcagtgtcaaagtgcttgctcagcatgcccaagggactaggtatagtcctcaacaccctgccccaaaactaaaaccagaatcagcacttaatgtaattatagtagctcaactggtattagatttttttctggggctgagtaagtagctcagtagtagagtacttgcctagcttctgaaaggcccctggagatggatgaattccagcataatttaaaaaagaaaaaaggaagagagagagagaaccttcacaagaaagtcagactggtttatttactgggaagtacagttaagtcccttcaagagacctcagggtggtgaggaaagtctttttttagttttattcttggagacagggatttgctctacagctgaggctgtcctgcagccagctcactgtcactgtgttgtagcccactagacatgttcatggcagtctttagccttagcctttcaaggctgggcgggactggagggaaccaccatgcatatccgtgggcattgttttttcttaaaacagtttctcattgcttctaatttaaagatgaccccatttactctatttctctaagtaatctcttgagtttttccatatctgaaagatcattgtctcagtcagtgattgtagcttttgaaaggagtgacatacaaaacagtggtgtgtagcatgacggtacatgcgtccttactgcctcagcacttgagaggcgctggcgggagaagctggagactcaaggtcattcttggctacacaatgaatttgaagccagtctggacacatgagatcttgtctcaaaaaagaagataaaatgacaaagataataaagattagttttacattgtcattttatttgtttgtttgttttgtatttcaagacagggtgtttctgtgtaatagccctggctgtccttaaagaccaggcatcgtagaccaggctcacttctaactcaaaagaaatctgcctgcctctgcctccctagtactgagatcaaagtcctgcaccaccacccctggctgcattgtcagagttttatggtaatgaaattataaagtaaaattactagtgcaatgtgttactgtgcaagttgtgctagtgcagctttgtaactgaggccagagcagagaaaataaagacatttgatgttaaagaggccactgcttggtaatgactcaaacagagcaggacagctgcttctaaggtagcttttcttttatatggtggttttgttgtgctttgttctgacctcagaaggattactggtctactaggattactggtatttatttgcaaagattcctgccttgtgaggattgtttaagcatggtcttgagtgtgaattgtgggaattatatatgcgtgtataaactcaaaaatgtgtttaacacttcataaagtccagaccctgtgccctgggaattaattaaacactgaatgacttacttacttacccttgagaactccattgttttgttagagaatccagagttctagagcagaggacttaggctatttgggagcagagaggaagtatgaccttgggcattctagaagaagcttcataagagaggtgtgctataagctacaaccttctgttgtgttttcagccgggcagtggtggcgcacacctttaatcccagcactcgggaggcagaggcaggcggatttctgagttcgaggccagtctggtctacagagtgagttccaggacagacagggctacacagagaaaccctgtctcaaataaccaaaaaccaaaaaccaaaaaccaaaaaccaaaaaaaaaaaaaaaaaagagttctgttttcaattttcacatgtgtttctgtgtactatgtgtgtgcctagtgttgtaagaagccagaaaagggcattggatcctttagaactagagttacaacatgtggatgctgggaattgaactgggtctgaactacttaacatctttccaacacctatgagctggttctttaagagctagaagaggaaagggaataactttttaagaggttgaagttgctgtgctagagaggtgcctcagtggttaaggtcatgcactcacattgggtcctcagcacccaagttggttagcttctaagcatagctccagttcttctgcctctcatcatctaaatgtggtatacattctctctctctctctctctctctctctctctctctctcacacacacacacacacacactcacacacacacacacacacacacacacacacacacacacacacacacacacacaaatttaaaaataaacaaaaaagaggcaccagcaagggggaataatcttttaggaatagcattcctgtcccataaagattttaaggagaagtaactaggccattttggcctagcatgtctatatttaagtatgtaacagaatcaaatttgattacttatttaatgtttttcctagattatcatttctaggtgactttgtctttctttcatagagttctgtctttaaggacatccatacaaagctgtgagtaaaatctaacctaagacagtagaatagacagagttagtatgaggttgactaaagtagtcactacctatgcattcttagcttccaacaagaagagttagtgctgaaggtttgtgaacagtgtggagcctttgctcactatccctttgtttcagaagagaaataacttggaccctaattccagcagctcatttgaccaacattctgggcattctaacttagctatctgagaaattcataggattttaaactgaagctgataaaattgagtgtgcttcttttcaaacagtgttttaagcaaatcttatctgattttcgaacctagtagaagcacatttgtttttatcttctttgtatccttgcacaccgacagcccaagtactcaatgttgttctttctttccttgcagattcagatattaaagacatctgaagttacccagcacctgcctagggagtgccttccagaaaatctgggtgggtacgtcaaaattgacctggctacttggaatttccagttcctgccccaagtaaacggccacccagatcccttcgatgagatcatcctgtcttccctacctcctgccttagactgggactcagtacatgttccaggtcctcatgccatgaccatccaagagttggtagactatgttaacaccaggcaaaagcggggcatctatgaggagtatgaagacattcgtcgtgagaaccctgttggcactttccactgttccatgtaagtaggagaggtttgggtcacaatcagttacccagaattttctggcaaatgatgactgcagctgcttcaatacctcagttcctttatagaaggtttccctggtgtcaggaagcttctccggaaggctgagcatggcagtgcatgcctttaatcccaggacttggaaggcagatgaaagtgaatctctgtgagtctacgtaatgagcttcgggccagttggggcaacatttaaaaacaatacataaataaaaaggcttgctgggaagtgggtaagggcacttgctctgcaacatggggatctcagtccaaatctccagcacccatacaaaagaccagcatggctgcacttgtatataaccccaccattgtgggccaggcacagatgggtcctgagagctcactggtccagggaataaggtgatgaacaacaatgaggcgcttgatgtcctgccgtgcttctgcatcacatacataggtgtgtgtattgccacactcaggtgtgcacagtatgtactactaacataccctaaaatcttcacagtcactttatttttttaaaaatgtttatttatttattatatgtaagtacactgtagctgtcttcagacactccagaagagggtgtcagatctcacagatggttgtgagctaccatgtggttactgggatttgaacttgggaccgtcagaagagcagtcagtgctcttacccactgagccatctcaccagccctcagtcactttaatagagttatctcctgttttttatctgagttatctcctgctttggacttgggcttattactgatttttttttgtttgtttgtttttcgagacaggatttctctgtgtagccttggctgtcctggaactcactctgtagaccaggctggcctcgaacttagaaatctgcctgcctctgcctcccaagtgctgggattaaaggtgtgcaccaacactcctggccttattactgatatcttatgctttgaaatttttggtcatctttggttatgaatagggaaactttgtaattatatatacctatatttcctccttccttcttctttttttttttttttttttttttggcttttgttttttgaaacggtatggctggcctaggctggcctggaactcactttgtagaccagactgacctggaccttacattgatcctcctgtctttgcctccaaagtgctgcataggcatgtaccaatatggtattcttaggtattttattgagatgcaaatgctgtttgaaaaagacccggggctggtgagatggctcagtgggtaagagcacccgactgctcttctgaaggtccagagttcaaatcccagcaaccacatggtggctcacaaccatccgtaacaagatctgactccctcttctggtgtgtctgaagacagctacagtgtacttacatatattaataaataaatctttaaaaaaaaaaagaaaaagacccaaagtgtaataaaatgctagattgtgtcaggaagtgtactgtgaatttaaaagaattctatagcaggaacagagaagagttgtttcttaggaatttaaacttttagaactttgcctctacccaagtcctagcatagaatcatctggtttgttcattattgatgcatagagacttaatgcctatggttgcagcatagagtatttctgcccctttgttatagggtgtgtttgtgtatatttgtatctgtatatctgtagaggccaaaatttgatgttgactgttctctctaattgttcttcaccctgtttgtctgtttgcctgcctgtctgcctgcctgcctatctgtctttttaaaataatcaaagttttactttgtttttatttgagacaatatcctactatgtagtcttggctaacccgtaattcaccaaaacagggtgccctcacagagatccctctatctctgcatctctagtgctgctcttaaaggtgtacactaccacacttatctataacttaactgtgtttaatttttttaaatatattttattatattttatgtatgagtgttgcctgaatgtgtgtctgtgcaccacatgcatgcagtgctcagagtggcagtagagggcattggatcccctgagaccagagttacagaagagtgtgagctgccaggtgggttctgtttgactttgggttctctgaaaaagcaactagtgttcttagctatctctccagccctcttacaacattgacattggctgtttttctcctattagtgaactttgtctgttataaattaagcttgctcgcagtgggctattagtttaaattctaagttagctagaggtcccttctgtttgttttttttccttcactctataccttagtttttctgaaatatgtggttggaatatgtgtaatacgtggctattgaatgtttgtcttcttttaaatgttttaggaatccatggttctctgagtacctttttcatctcagaattcttgttcaggttagtcatggtctgaagaaaatgccaaagaaggacaatgatgagttagtaaactgaggcaaggccattgagaaagaagccagtaagtagagcgagaatgtaagactagtgacttggctgagcaggtggaggtgctgccgccaagcctcatgacctgagtcatgagtggggttcctggggcccacgtgggaggagaaaactgactcatggaagttgtcctctgacttctacacaatgcactgtagcatgtgtgcatcctctctttctcccacaaccctatggtaatatcagtaataaataaaaataagtgtaaggttttggggctggagagatggctcagtggtaagagcactgactgctctaccagaggtcctgaattcaaatcccagcaaccacatggtggctcatgaccatctgtaatggaatctgacgccctcttctggggtgtctgaagacagctacagtcagatttaataataataataagtaaataaataaataaatcttttaaaaagtgtaaaagaaggaaaaagaagctagggctgtagtctcatggtcgagcgctgtctggaattgatgaggtcctgggtttgtagagaaacgaaagggaaagcagggcatatattaagaggggaaagctgggcagttgtggcacatgcctttaatcctagtactagggtggcagaagtaggaggatctctgagagttagaggccagcctgacctacaaagctagttccaggatagccagagctgttacatagagaatccttgtcttgaaaaacaaacaaaacaaaaaagagaaagaaatactattttctctaacttctttttctttttatgtgctgaagatctctagatttatatattaaatctgcttccaaggcagaacagttgttccctaactatccttgaacagactttgtatctggctagcctaaaatgatgatcctcctgtctcagtctcttaagtgccgaaccactcttcaaaactaccatgcacaactttccccatagccactgtcacccaccctacaccttttcttcctactccatagggtctcatctagcccagggtgccccctaaaacttgctgtgtagccaaggatgactttgaactaatgatatttctgtctctccctcttgtatgatggaattacaggtatgcaccactatcttcagtttcctcagtaggaattaaggaaataacttgggagcaagaaagaatacacttttgggagctttaagattttgatatgggtactcctgtagttactcgttgcctcaagcaatcatcttgaaagagcgaggttgtctgcttgtaccatttcaatctgctgctattttagaattgagaggacttcatggttgtgcctttgattgaactgtggagctcttgcttgatgatctagaaccataagccttactagctcctggtcttcccttcttcaaccagggtctagtaagactgcctacagagagcaaactgtatctctcttggaattctggattgtgaagtaaatatcagagtttcaattgttcaacgctcccctcaattttttttattttttatttttaaagacagtgtagttaagtgaagtgtggtgtggttcactgctttaatcctagtacccaggaggcagaggcaagcagatctctgtgagtttgaggctatcctgatctacaaagtgaattccaggacagccagggctgctacacatagaaactgtcttgaaacacacctccactcccaccccaccctccccaaaaaaaggagaaagaaaaaacaaacaaacaaaaacccaacccaaccaagcaataaacaaacaatgcacagtgtagctgtctgattgcagacgactccctgggctagtattcgaagactcaaccaagcaataaacaaacaatgcacagtgtagctgtctgattgcagacgacttcctgggctagtactcgaagactcggtgcccagtttgtgggaccactgggaaggattaagaggtatggccttatttgtggaggtgtcactcgggattagctttgaagttcagaagactgtgacattctagtgtgtctctttgccttgcactttgagctgtgagtgctcagtcagtttaccactgtacctttgttccaccatcattgactctattcctctgaaaacataagcccaattaattaaattctttcttttatgagttgtcttggtcatggtattttatcactgcaaaaaaaaaaaaaaaaaaaaaatctgcctgcctctgcctcccgagtgctggggttaaaggtgcttgttatcatgcccagcttttgatagaactttggaagagggaaaataatgtgttagtaaatgagaagaggcaattttctccttttatttgtgtttgtgtgtgtgtgtgtgtgtgtgtgtgtgtgtgtttggttacatattatataatacaatattatatattattatcttagttaggcttttactgctgtgaacaaacaccataaccaaggcaactcttataaggacaacatttaattggggctggcttataggttcagaggttcagtccattatcatcaaggcaggaacatagcagaatccagacaggcatggtataggaagtactaggagttctacatcttcatctgaaggctgctagcaatatactgacttccaggcagctaggaggagagtcttataacccacacccacaatgacacacctactccaacaaggccacaccttcaaaattgtgccattccctgggttgagcatatacaaaccaccacaattataaatatatgtaatattacattttttgagattttatttttattgtatgtgtatggttatttttgtgtatgtttgactaccatgtgtgtagtgcccttggacaccaaaagagggctatggagcctcaaggactagagttacagcttgttgtcagcagtcaaatgggagtcagaaatccagcctgggtcctcttgaaaagcagtctctgtgtgttcttgattactgagccatctcatcatccctaactgtcctactgtcctttaattatagtatacctggctttaacccctctccatctctctctacccctccctctctctctccctctccctctctctctctctctctctctctctctctctctctctctctctctctctctctctctcccccctctctctccaggttttgtttgtttaagacagggtttctctgtgtgtgtagccctgactgctgtcctggaacttgtctgtagaccaggctggccttgaattcatagagatctgtctgtctctgcctcctgagtactgggattaaaggtatgtgccaccattgcctgtctacatttttttttttttttttagttaaaaagaaaaacacaaagtcaaaattcacacctggaaaatgatttttacaaatatttataagtggtactttataaataataaaacctttgcttcacaagaagctttgttgaaaagatgaaaagatgccgggcactggtgttgcaagcctttaatcccaacacgtgggcagctgaggcaggtagatctctgagcttgaggacagcctgatctaatagtgagttccaggacagccagggctacatagagaaaccctgtcttgaaaaacagaaaagaaaaaaaaaagatgaaaaagcatttttttaaatttatgagtatatgtgtgtctctgtgtgtataagttatgggtacagatttcacagaggtattagatcccccctagagttggcattacaggcagttctaagtgttcttaactaccaagctatcgttctagcctcaaagagtttttaagatgtagaaaagagggagctgtagagatagctcagtgactaagagcactgcctgctcttccagaggtcctgagttcaattcccaggaactacattgttgtctcacaaccatctgtaatgggatctgatgccctcttctggtgtgtctgaagacagcgacagtgtactcacaaatataaaataagtaaatctttaaaaaaaaaaaaaaaaagtagaaatgagccaggtatagtagctcaagagtgtgaggctgacctgagctgtggtgtgagagcctggcccagaacaacaaaccattcaccaatgaagggctttgtgcataaacactttgctgctaagccaaggacctgagtttggtccttggaactcatttagtagagagaactaacttctgtgattcctgatttctacatgtacctccgacaccaagtagataaatgacattttaattaaaaagattaaataaaaaatgtatgtagaaaagtccaaagtataaaaatctccaggaatcctgtgattagagggatacttgtttctgttttgtggtgtttgtttttttctttattatgtaaaagaattcattatgaagctgaaatggctcccagccctcacccttagttctctctgatacacaataggtcttagatacacagatacacaaataagcagatacatatataggtcctagaatgaagacagtgtatttccagccagtttgctcataccattatgtatacatattctatagtatagaatacctttgagacagggtctcaaactctatatgtagtaagtttgatgttgaacctctggtcttcctggctctacaacctgagggcttgccttacaggtgtttactacaacaccagcttatgcagcaactgaagagccaacccagtgttttgtgcatgttaagcaagtgctattccaactgagctgcaccccagctctccaacaatataagatattattatttgttgatggttaagtttttagtttttaatcaataatatatctaaacaaaaaatttttcagagtcaaacagcttaaagcaaaagcagtgagcgttgaggctctgcaagtactcttccactggttcagcccccttagagaagggatcttgtatagtcctggctgtcctgaagctctgcatgtagctaagatcctcacacttccccttggtttaacttgcctcttaattttcttcaggtctccaggaaacctagaaaaaaacagatatggagatgtaccctgcctagaccaaacccgagtgaagctgacaaaacggagtggccacactcaggtagatagataaatgccgtgaaatggacccaacaccagagagatgacatttgagttctgattttgatgtgtattctatggcttgagacagtccttaaatactcatgttgccacactaaagagaatcaatcaattttgttgtaaatgctgacagtctggtatattatgagggtttttgttgttgtttgtttgtttgttttcttttttttttaattttaactcagtgtctcactatatatagtcttgcatggcctggaacttgcagtatagaccactctgacctttttttttttttggtttttcgagacagggtttctctgtgtagccctggctgtcctggaactcactttgtagatcaggctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggggtgcacgcctttaatcccagcactcgggaggcagaggcaggcggatttctgagttcgaggccagcctggtctacaaagtgagctccaggacagccagagctatacagagaaaccctgtcttgaaaaaacaaaaacaacaacaacaacaaaaaccaaacaaagaaatatgtttgagtgaatcccagtgtagccgatttttctagtcatccaataataatctgacgattagcatctggtttatttgcaggtaatgggaatatatttgtggatgagtatattcacaaatagttgtaaatgagtagagccaattataacaggagatgattctaatcattctgtagttaatcttaagttcattacctgacttttaattccattgctacaaacaatgccagagactgttttcacagtaaatggacatttaggtccctgcccttgaattttttttttttttttttgaagttggatgttgttatacaaccagtctggccacctgtcttactttctagaatttttggttcagaggcatttaccacaatatgagctttgtttattatttgtttactgacagggtctcatgtaggccaaactggcctcaaacatactatgcactccaggatgaccttgacctctgaccctcctgcctttctctacaagtgctaggatcatatgagtacagcaccatgcccagttttgtgtttgtttgttttgagatgctgaggtttgagcccagggctccatgcttgctaggcaaactcttgaatcactgagtcatagatgcagcctagatttacatttttgaaaattatgtctcctttttagttttagtgatgtgtttgtttgttcttatcttctgttgctatgataaacactgactgaaagcagtttgaggaggagagagtttatattgcttacatgtacatgctacagtccatcatcacaggaagccaaggtggggatgcaggttcagaactgaagcagaccatgcaggagtgctgcttactgacctgttccactgtggcttgcccagttttttctttctctttctctctctctttcttcttcttcttcttctttttttgttttgttttgttttttttgtttttttgttttttttttcaagacagggtttctctgtgtagccctggctgtactggaattcactctgtagaccaggctggcctcgaactcagaaatcctcctgcctctgcctcccaagtgctgggattaaaggtgtgagccaccactacctggcttgcccagtttcttttgtctgagagtttatcttaacgtttttctttgggtctttattttattttgaggtattttgttttcctttataagttttcttttctctttctttctttctttctttctttctttctttctttctttctttctttctttctttctttctttcttttggtttttcgagacagggtttctctatagccctggctgtcctggaactcattttgtagaccaggattcagaaatccgcctgcctctgcctcccaagtgctgggattaaaggcatgcgccaccatgcccggctaagttttcatttttaagaagaagatctcaatatattggtttagaatttactattgtagacaaggttggccttgaacttgaagtgatcctctagcctctgccccttgagtgctaggattacaggatttaaatgcatggtacggtaaaagggccgttgtgaaatctatccatctatccatccatccatccactcatccatccatccatccatccatccatccatccatccatccatccatccagttgtcctagtacatttgccaaagtgaagcaagtgacccacagaaacactcttctacccggctatgtccctgcctcctctttactccgtttcattaccaataaaaatatctcaagatccacctccatgctaaattgggcctgtaacttttcattttctgtttgataggaagagaatatccataccttgaattgaatttacccatcacatacatcattttgtgagtcaaatggcatatgcatgttcttgtaataatgtcttccttttattattagacagattacatcaatgccagtttcatggatggttacaagcagaagaatgcttatattggtacacaaggtaagctgttttagccttacctgttgattttgtggctcctgtgtgtggttcctcatttcaggtgatttcttaattttaattaattatatgtgtacgagtgtttggtctgcatgtaagtctgtataccataaacctggtgtatgtagaaaccagaagagggtgtcagatcttctggagttatggatggttgtaagctgccatgtgggtactgggagtcaaacctgtgtccttgataaaggcagcaagtgctctttaccactgagctatctctccagcccctatcttcaggttttgtgtaagtgctaaaatccaaaatatctagtcctcagattgagcagtaagcattcttaactgttgaggcaactttccaggatctagataacgtgcgtgtgtgtgtgtgtgtgtgtgtgtgtgtgtgtgtgtgtgtgtgtgtgtgtttcactgtgtagccctgactgtcctggaatttgctttgtagaccaggctgtccttgaactcagagatccacatctgcctctgcctccccagtgttagtattaatggtgcaactatatcaatcagatgtcatcatttttaaaggaaaaaaaattttttttcaggacagggtttctctgtatagccttggctgtcctggaactcactttgtagaccaggctggcctggaactcagaaatccgcctgtctctgcatctcaagtgctgggattaaaggcgtgtgccaccacctcccggcttaaaggaaatttgttctgaccactaaaatcctggtttttataaagtttggtagctgaagaggacagataagtttcaagtttcaattccagaagtgcatagaaactcaatacacagagaaaaaaaagcaatgtaaacctataaagttactgattgccagcgagggttttggactgtgatttagtctagtaatccaagagtatagcgaatcagaactgactcaggctgggaatgtaatttagtgatacagcacatgccgaaaagtttgcgttagatctctaccatctcaagaaaacagtaataacaatcaaaagaaatctgaatctagttattgagtaacaaatcagtcaaatccagattgtttagacaggacgagaaaactagctcaggctaggcatatgggtacatacatgcttgtaatcccatgacccagaggagcccaagttcaaagcttgcctattctgagtagttaattggaggcaagcctggggttacacagcaaaactctatcttgaaaagaaaaaaaaaagtaagtaacttaaactctttaatgttattgtcatgacaaaagaaaaaggaagagaactgttatagataactaaagaaataactaaaggtaagtggaccttatgatgtatcctccatagggagaaagtggtattaaggacaaattactgggacagttgtagacattctatctgtaaggttatactggtgttccattgggtgctactgcaataatatatagtgatatattcaaggaatgaatagtatgcatgtgcacatatatgtgtacacacacatggcaggggtctcatctactttaggctctttgatactggttgtgtagtgaaggatgtctatgaactcctggtccttctgcctctcccttccaattgctgggattacatgtaggagctaccatacactactctagtgtctgatgtttacatagatctacatatatagtattaatgtttttaatgtttaatgtcatctgtaagagtatgtattatatttcaagagcataatttctgattattaaatacgaaagtaggtttttttgagacaaggtttctctgtgttgccctggctgtcctggaactcactctgtcgaccaggctggccccaaactcagaaattcacctgcctctgcctcccaagtgctgggattaaaggcgtgtgtcgtcactgcccggctgaaagtaggtttttaaattttatttgtgtgtgtgtgtgtgtgtgtttagtttagttaagaaaactgaaaccagctgggcgtggtggcgcacgcctttgatcgcagcacttgggaggcagaggcaggtagatttctgagtttgaggccagcaagaaaactgaaacccaattggttaggtgaccttgaacacatagctaggaacagaactagaatttgaatccatttctgctacagaagttctctcaagtcaactcagtggattggttcttctgtgtcaaagtaagcagtcactttacatctatagatgtccagttatatgtatgtggtatggtatatgctcacacagacatgtgcacacacatgtacacatgcatacacacacagacatacatatgtgtgtgtgttaatttgtgtgtgggcagatctagaggagagcgtcaggcgtcctgttctgtcactccccgctttgttcttttgagacagggtctctcactgaacctggagctaggctggtggtaatcaagccctagagagccatcctttccccgagtgctagagttataagtatgcctacctttctatgtgtgtccctgggatttcattgaggttttcatggttgtgtagcaagaatttttacccaatgagccatttctcccagcttctttccttgtttttattttcagacagcccatgttggtttggagcttgctgagtatggtgttacacatctgtgatgctagcagaggcatggggctaggaagttgttgggtactagggatcacatgcaggtcctcacgaagtacgcacattgccaaccatgaagccccacagcctctggtgtatttgctgttgtttgttttgagatagtgcctcagactatagtctgggctggcttgaaactcacaatggtccttcttcacaagcctctcaagtgtagagaatatagggatgaaccatcatactcagcttcaccaacatcttttattttgatcttgtgttttgaaaagaggtttcatgtaactcaggctggcccagaactctctttacagttgaggatgaatttgaattcctgatgttgttgctgccttctcctcccaagtactgggattataggcatgaccagcttgcactcacatcgtatgatattagaatatcttctttgtggaagcagatactgatgaagatattcaaggttttagaatgaattgaaatacctaagaacattatatgtattaaactatattcaaaattcacacatccaacaaatgtagttgtaagagctacactttaaaacaattttattttatgcaaatgggtgttttgcttatatatatgtcgatgtgacatgtgtatgtctggtgccagtagaggctagatgagtgagtgttggatctcctgaagctgtggttacaggtagttgtgagcctcatatggttgatgggaatcaaccccggctcgatggaagagcagccagtactcataactgctgaggtatctctgcagtctcaagagttgtagtttttgccatggacagctacataacaaatatgctggaaaacgtttacactgtttcaggatcttggagttagtgaatgatttttatcttcattttccttttttgcttttattttttgagacagggtttctctgtgtaatcctggctgtcccggaactctttttgtaggtcaggttggtgtcttacccagagatctagctgcctctgcctcccaagtgctgggattaaaggggtatgccaccattttatcttcattttctaaataaatcgcaacagttaagcattacccatatatgaacatcgagaaggcaatacaagcacttgtctgcatctttaagctccgtcctcatccagactccactttgtgcttctcacactttattactagatcctagatctgctgctcaaacccagggccttgcacagcaaacgcgtgtttgaccactgacccacaccccattttactttccatattcaaaccattagcaatggctaagtgtgaataatacttgctgacgacagaaactgtaggatcatatattcaagaccagcctctgctacacattgagaccctgtttcaaaagacctcccccctcctcaaaactattgttagatttgggacagctaagcagtcagaatatctgaatatctgataaaccagatacaaaagaggtggagagagggatttaacttcctaagtggtacaagagaaagatttagaagaaacatatatgtttcccaaattaggatctcccctcacagtttggaatttgggaattgaacccagagctttgggcatgctaagcatgagctttaccactaagctatactgcctcttcccagtcctgagataagaccatttacattttctccttgtttttactttatgtatataggtattttgcctacattgaagtctctgtaccacatacatgcattgcctacagaagtcagaagagggcatcagatcctctggattagagtggttgtgggctcttatgtggttaccaggaactgaacctgggtcctctgaaagaacagctactgctcttaaccactcagccatttctctcactctgaaataagatcctttattctgtctttccatgtctgtctgtctgcctgtctttgatgtgatgtgatggaacctagctttgcagactaggatgtcactcctcctacttcttgtctttatttttgtttctaaaatttaccttttgttttgtatgtataattgttttcactgcatgcatgtatgcagtgaccatgggggctagaagacagtgtcaaaccccatggaacaggatgatggtgagctgtcatggggtgctagtgtcagggaggcagagataggaggatccctccagttcaggtctatccagtgtaactactaggcagataccaggttccagtgagagaccccatctcaaaacaaaacaaaaataccattaaatgcaaaccaaggcaggtggccttgaccacggcttccgcatgtatagtagagaggctgttcctacatatgcacacacacaatgttagtggttactaaagactttaacaaaaataatgggaccattggtctttcaggtctcaattaacccttgatattaccctgcttctctgaatatagagaggggaaaacactgggaaaacaaagaattatcccgaggagttatcacaaagacattttttggagagtgctcatcgtgcaggttcaaattattattattttttaaaatatttatttgtttgtttattatatgtaagtacactgtagctgtcttcagacacaccagaaaaggttgtcagatctcattacggatggttgtgagccaccatgtggttgctgggaattgaactcaggacctccggaagagcagtcaaatgctcttttttttttttttttttggtttttcgagacaggatttctctgtgtagccctggctgtcctggcactcactttgtagaccaggctggcctcgaactcagaaatccgcctgtctctgcctcccgagtgctgggattaaaggcgtgtgccaccacgcctggctgtcaatgctcttcttaaccgctgagccatctcaccagcccctaggttcaaattataatggacagttttgcaaatggcatttatccttcacatctatttactgaaatggggattttctttactgtccaatgtaatatgctataatttaaatggttgaaatatttaggaccagccttgccatccagagcttatgggagagaaagtcctttgagtgtcctggtcaataagagcctagaggaagactgggcacttaaaaatagacagaaggcctggagagatgcctcagcatttactgctcttccagaggaccagagttcagtttccaggggtcactggggagcttgtaatgcttgtaacccgaggcccagcgagtctgacctctgcaggtgcccacacacatctgccaagcactcctacatccaaacacacatatacaaaaataagtcttagccgggtgtggtggtgcacgcctttaatcccagcacctgggaggcagaggcaggtggatttctgagttcgaggtcaacctggtctacagagtgagttccaggagcaccacgtggtggctcaccaccatctgtaatgagatccggtgccctcttccagtgtgtctgaagagaactacagtgtactcacatacatataataaataaatacatcttttaaaaaaaagttggaatcccttgggaggtggggaatgacatatgcccttaatcccagcacaacctaggctacagagtgaattctaggatagtcagggctgacagagaaaccctgtctcggaaaaaaaaaagaaaagaaaaaacaagtcttaaacaatggagtggtattacagatgagggagacaatataatgaatggaacagagtcagagaaatacattgtgtctgtactgtattttttttttagtattaaactgtaagggggaagaaatattcagaaaaatacattagaatagtattagtaacttaggttaaaaatgataaatttctcatcgtactgaaacattgtattaaaaacaggggagagggcagatgtaggaaagacacttaatttcaagggcaaaacattttgcttgataacttctgggagaagatgcaaatgggtgatgggtgtgttaaagttgacttcacaaaccaaccccccccttttttttcttttcaagatacggtttctctgtgtagccctggctgtactggaacttagagatccatctgtctctgcctcccaagtgtcaccatctgtcaccatcaatggcttttacccctcttcccctctttagtgtgagtgtgctgttgttattccaggaatttctcccttcccctccagacagggtttctctgtcagccctgactgtcctagaattcactctgtagcctaggttgtgctgggattaaaggcatatgtcattccccacctcccaagggattccaacttttttttaaaagatgtatttatttattatatgtatgtgagtacactgtagttctcttcagacaccgggaagaaggcaccagatctcattacagaccaccacatggttgctgggaattgaactcaggacctctagaagagcagtcattgatcttaaccgctgagccatctttctagcccctcatttactcttgtaaaatgtgggagtcagggctggaaagatggctccaccatgtaaggtggaggagaaaacaatcctaaaacacaagtccttagcaatcaggtcctttcaaggctgcatgtgccctatggcaggcctgccacctcatcacaccccagcacttactaacaaaacaacagtgacaataataattttaaccaagaatactagaagtcctattattagagataagaaagttgagaaagaaaacttggcatgatggcacatgcctatatttggatcacaagtttgaggcctctctgagttacacagtaagatcccatctcacaacaggaaaagggggcgagggagagaaagtacataagtaagtgaaagaattctgaagactaggtctctgttcagactatgggatttgagacagtgggggccagaagtaacctggtttagtagttactgtattatgaggctgagggctactgaggtagaaacagacaggtaggtatagacttgacccttgctaccgtacatgatgagccacagagcctcaggcgctacatatgttcctacatacggctcacctggaatctttggaatctgaacacttaatttcttttatttttggtacagtgtaatttatctttaaatttttattcatttattagttagtttgttttgagacagggtttctctgtgtagccctggctgttgtcctggaactcactctgtagaccaggctggcctcgaactcagaaatctgcctgcctctgcctcccaagtgctgggattaaaggcctacgccaccactgcccggcttttatttattttatatatgtgagtacactgtagctgtcttcagacataccagaaaagggcctcagatcccattacagatggttgtaaaccaccatgtggttgctgagacttgaactcaggatttctagaagagcagtcattgctcttaactgctgagccatctccccagccttttattttatgtaataggtgttttgtctatgcactacatacatgcagtgctcagagagtccagaagagggcattaactcctctagaaccatagttataaaatactcacccatacagagatgatatggttggtttgaggaccttgctgaataaggagagctaagacaaggctcatatgaatacttgtaatcttagtacttgggcggtggagacagagttcaaggacaggctggactatagtgagtctgagtctatatgagtgagatcctgtttcagtctgtacttcagagatcctatttggaagacaagtagaggaagacagacatgcttctaaaggcccgctctccctcctgtcctttcattccaggtcctttggagaacacctatcgtgacttctggcttatggtttgggagcaaaaagttttggtgattgtcatgactacccggtgagttagtcttcttttaaccatagattccatgaccctaagcttgaatgattaagaaagctatgccacatctatagttaacatggtaggacacagtggagatagtgttagccttgcagaaatatttaatccgtaactgtagggacccagggctagtgcgctaaagcctatcctggggttctggccttattcacaaaaggacgtgctgggaaatgccagcagcacaccttgaagctgcctcttgtctacagaggaaaggtgccttcctggccactgcattaccagttccctttgctctccatttcctccttcttttgatggctcttctgttcattaatatctctacctgtaagggaacagaaagatggttgaaacataaggcaggaagttctgaataaaggattgtttttgaaatttggcaattctgccaaatgtaaggaatttcatagtttattagtttcatcattaattataacctttttcagatagggaagaaaagcgatgctccctcagttcccgtcctcagagcattgtcaacagccacctgtagttgggagaattgtcttccccactcctgtgtcagccaagggcccttcgtcgaaagaaactgagcagtggccaaggtctaggcctcagtgtggatttgctactatatgtaggaaatacaaccaagtatcaggaaggagacagatgatacagtgaatgtacaatgcatgtctgctaaatgtatacatgtaagaatgttagctgttttaacacttgtttagaaggaagagatgtcatttttctgccaagaatcagtgcagacttcagaagcagtgcagatcacattgctgcctaggagctcagcagttgtggtgggaagcggcttacagctagttgaagagagaaggcttaacttgctctgtatgtcttcagctttgaggaaggcggcaggagaaaatgtggccagtactggcctttagaaaaagactcccggatccgatttggcttcctcacggtgactaatctaggagtggaaaacatgaaccattataagaaaacaactctagaaattcacaacacagaggtaaatgcaggtttctattttctcttttgaaattaggggagctcctttaagagattctcattgagggtggtgatgcacacctttaatctcagcactcagtaagaagaggtggatatctgtgaggtcaaggtcggtctggtatgtgtatggagttccaataaaacaaacacacaaaaaagaaaatgtctagagggaataggcaggactttagggaggtaataaacagatgatcaactgataagccagttatgtagtgtccatctttaatcccagcactccagacagaggcaagttgatatctataaattcaaggtcagcttggtctatataataagctccaaatagagatacctcccattaaccgcctttcaaaaaacaaacaaacaaaaaaaaccctcaactcagaactaatgaagttatcgcctcaatataagagtggcattaagaggctggagagatggttagtggttaagagcactgattgctcttgagtagatcctgagttcaaatcacagcagccatatggtggctcacaaccatctataatgggatctgatggcctcttctgggtgtgtctgaagacagctacagtgtactcacatacataaaataaataaataactctttttttattttaaaagagtggcattaaagagaagtaaaaaatttcaacattgggactctgtatgctaagccatgcttcttatccttctgcagaggaggctgaggcaggattacaaggtggaaaatagcttggactgcacagtacgaatcttgtctcagaaaaactacattgagggactggagagatgatggttcagctgttagagtactttatactcaatcatgaggacgagtgttcagactgtagcgcccatgcatccagctggggggccatttatgcctgtcatcagatctaatggaggcagaggcaagagacttactaggctttctgcttatggcctagttgaggatccctggctccaagttcagggggaccctgcttcagaagagtgggcagcatgtgttagagaggacacctgatgcccttctctggcctgtctgtgtactcctaacatagatgcctaggcacttacaattaactaagtcaataagtaaataaataaggtactgttttatttcgagacagtgtctctcagtatgtagccttggctgacctggatctcatgatagaggtagactagcctgggctcaaatgcatagagatccatctgcccaccactccttcctgaattttgtggtatagagttgtgctccatgatgcctgacaataaatttttctaaggaagattttgtttgtttggttggttttttggttcttttttgagacagggtttctctgtttagccctggctgtcctggaactcactttgtagaccaggctggccttgaactcagaaatccacctgcctctgcctcccaagtagtttttttttttttgatcttataactttattataacatatttcctttcctttttttcctctccaaaccctatctgctctttcaaatgtataatctctatttttactaattgttattgcatgtatttacatattttcacacacacacacatatatatacatatatatagttgtaaatataatctgttgtatccatataaatgcttgtattatgttctagagctgactgtttggactggacaattagttggtgtgtcctttcctgtggaggaccacttctggctcattttttgtcttgtttttaataataaaataatacaataataataacttattaatagcaataataaacaagaaatatggatcctataatatagcaatttgccttcccaaacatatagccattcctttgggtttgaagtagaaaatcaattgtgaagaaagttgacagcagaagacaggatcttctaaagtcttaagaacctggaaagccaagggtagacagcagacaggaatgacattaactcttgcttctttttcacgtaaggagcggcagaaacgccaggttacccacttccagttcctaagctggccagattatggtgtcccttcctcagctgcttcccttattgacttcctgagagtggtcagaaaccagcagagtatggctgtaggcaacctgggagctcgctccaaagggcagtgccctgagccacccattgtggtccactgcagtgctggcatcggcaggacaggtactgtgcctcttagactggtgatgtgcccagaggcggtgggggtagggaggaggagctaaatgcttagggcatgtctgtgtttagaggagaaactcactcatccccttggtggcaaactgctatgataatcactttttaaggtccttttgtattcctatgctagagatgctgcttgccaaaatgtatgctttataaaccaagttcttggggttgttaatcatcatggtcttcttttgaccttgtgaactctgtcatcaacatgattgtggtccccagagagattagctggccctctcttagaggtttcttctcctggtgctagtcttgtcccctgacacccgttgtttgtgtttatgagaccaggtcttactatgaagtccaatctgacctggaattctcagcaatcttattttagcctcccaaataatgggattatcagtttgtgctatcttgcttggcttctgtgttcttcattatgtgtgctgtatgagctgctggctttactagttcagaggtccctttgggagaataatcaggagaactgtatttgtgttagacctctagagagttataagctatggaaattgggtgtagaagtacagctgcactgtctggtattgaagaagcaggatattcttcctgtgtcacctgcctgcttattcttctgatactctcgtgtatgcccagagagacaggagaccctcatttgtctggcctttagcatgccctttgatactccttagaagtctctttaggtttaagtcctcctgccattagaccctgtgcctttgaattcttgtacccagccttgcgtggtgatttggtaaaaggaagaagataggtgaggtacattcatatgatcatttccttccttcttcaggtaccttctgctcactggacatctgcctggcacagctggaggagcttggcacccttaatgtgttccagacggtgtcacgcatgaggacccaaagggccttcagtatccagacccctgagcagtactacttttgctacaaggcaattctggagtttgcagagagggaaggcatggttccctctggtcacagcctgttggccatggacggtcaataactgctccacaagtttccacctgctggtcagccttccttaaactaccctggacactgctgagcctataggttgccatcagttatgctgaagccatggatcaacctctttcctgtgtctcccagcgcacatgtgcacgcaaggcagcctttccctttggctagataaatgtggtgaacttgccactagaaagggccagcagcaatgtgttcttaattcctagcacctgctatcgaactgtgccttatcaaaaccaaattgtggctattgatttttgccagggtccctgaggtaagtgggggaaaggacccctccccccacccccatctcccagttcctctggacatctcctccttccctttgctatgatttgacagggaggtctggtgagcattcaccttcctacccagaaagcttgaccaagttacatattctagagaatgtcccgagtgccaagcacgtttatacatagggcgtgtattccagtcttttctgtcattctgtgtgtgtgtgtgtgtacgtatgtgcacttacgtgtatggatccatatgtatgtgtgtacataatatatactctgtgataattatggccgtatactataaatacatatacacacagatactctttgtagaagtctctggggatttatgttgcagttcagcattccttgcttcttggaccctgctgattattctggactggctggggttagggatcatggctcatgttgtcagacagcagagtgatagaagaaaacacatacttttttcctgggccacaggtcttcttccttaatgaaaattttccctctggactctatgcttgttggagccaaaaatactgacttatggtaacactggttcaatttagcatgggtgtctttcatctaacaaattctctgttgtctttgctgatttggggaacagacctccactgtgattccagactctgtcttatgaccccattgatggggaccaaggctagaaataaatttacagagctgccagagtccaaagtaatcggtacgaagttttaaaaggaataaaggagagcccagagtgaacaagaggaacctaccatgaaatccccttcttgggaggacaaactggggcctctttttcttgtgttggaagacacctttctttatgcaactcttccttgtctactgaatgcccagctctccctgcctgctagcctgccagatcctagactgcaaactgggtgggcctatgtctttataaaacataaactgggtgggtctatgtctttatgaagcataatccctttggctgcatgagtccgttccttggaatcactggtccactgcccgtacaacttgttcctgtcttttcccagtctgattcgccaggaatggaatcaagagttcccaacactgtgttcccacaaaaccctacagaacccctaaaccttcccttactccacacgatgaggttggcagctggtcagagctcaataattttatactgtaataagatctttgaatgtgtatattcttattttttacaatcatttcattttgtatttaacatcaatggactgagtcaagattcagtaaataattgtaatgttcatatgcgatatcttatagtggtacaattttgtatttacctataaatataccaacatgattaaacccttttagtttcatcaatttgacagtctggggtcgggaaggtgaggagggagtccaggagttggctctggacagatggggaggtatggggtggaggagatccacaacttcagtatctgagacttaagttctgagcggcacctgtttgtgtactgtgtaggctgtgacaggctgagtgctaggtgctttgtctcttatgtcacttcattgaaactgcacagttctaatgaatatcctctgtcctttctattacatctgcctcccaattctccagtgctgaaattacagacatgtgcccccatactgggcatctttcacctaattctgtataaacgagaaaggtgaggtccaggggaaaaacagtgatttgtcctactgtaacccaagttgatctgcttatcaagtctgcagactcttagcagcatcagaaaatggaatggtgctttggagactcttagggcttttcttgttgttgctgctgttctcctgttagaggacagttggttttgaaattctaggatggttcatggtttttttgttttggtttggtttggtttggtttttttttttttttttttatgttttgtttgtttctttgcttgagacaggatttactacatagcctaggctgtccttgtactcacagccattctatctcagtctcccaggggctgcttctcccagcttaggtaaactaacattgagcccttgttccttgtagtagactagagagaccacaggattggtgacattctcccaaaaggaaatctcatgttctagcctcaggtttgcatagttccagagggtttatgcttctagagaaaccccacaaatagtgtcctgctagtttttctatctgagtggaatcagcattggccttgaagggatattcttcacatcacatggcttctatctgttagccagtgacaagctgccccattggagtggcttggcctacaatatgcaaatattagtatgttgtaaataatagtaatagcaaacatttaatggaaattcacattctaggtccttttcaggatactcttataaatatgaactcattcactctcaacaactgctcaaaactaggtactgatagaagaaaatatttgaaacttgctgtggctgtggctctatataccagagaacctaaggatctgtttcctcacttgccagcacattattcttgatgttcttaccttacccaaagactaaactgctggatgtactggaatctcagtattagaaaggaagaggcaggaggatcaggagttcaaggccaatgttggctatatcagtagtaggagcccagcctgggctacttgagacactgtctgaaggaaaaaaaacatggtagcagattaagacagaatctctgaaatttgagtcagagagattatgctgtaatttgaaattagattacagaaatacttagggttggtgaaatagataggaaacagcattaacaatttaaaaagcctggcaggggtcattcaggactgttacttgttcaaacatgctgtacctttgccctgtagattgctcaattcaaagttgcgcaccagttcttaggtgcaaactcctaggccaacccactgggtggttgagtgaacacagggtgatccaggcattcatatggctatttaactcatatctccagttcggggcacagccagtgatagctcctggacattcagtaaaaccctgggttttttaaaaagggttccatagtttccccccaactgccattatacagtgctatctttattagtttaaaaatgtttttaaattttggtggctttaagttttttattatttattcattgggttttctacagggcttctctacataggcctagctgtcttggaactttctctgtgtaccaggctggcttcaaactcatagaaatctgcctgcctctgcctcataagtgaattaaaagctggaactaaaggcatgcaaccaccacggtccagctaaattctttaattttttcttttcttttcttttcttttcttttcttttcttttcttttttttttttttttttttttttttttttgaaacagggtttctctgtgtagtcctggctggctaaattttttaatttttaaaaacctatttagtacatgcatgtacatgggtacccatctgcctcggtgcacttgtgggggtcagaggataacttttgagagtccattcttgccttccaccttgttgaggaaggctgtgccatgctgcatattctaggcaaagcttactggctgacttctaggggattctcctttctctacttcccacatctcccataggagtgctggtgttataggtgcaggttggcattttacataggttccagggatcaaactgagatggtcagatttcctaggctagtgtctttacccattgagccatctcccttgcttaattaattttttaaaaattttattttctaagaaattatgaaaatcctcctggctcagccttctgagtgctgagatcacagatgcgtacaactgtgcctgttatttttagactgagttgcaccaagttacctccattggtctcaaatttctgggttcccattgtctgaacttcctatgtagctgggactgaaacagagacttgtcaccatacctggatgtttgtagcttttttttgccagtgcaagcctacctgtagtttttgattttgaagttgtttgtttgaaacagggtttctctgtataggccacgctggcctggaactcaaatccatttgcctgcctcccaagtgctaggattaaaggagtgtgcaacacacttggcttggtaatgggcattaaaggtgtctaaggaagagaagcgcagagtgttcaaagatgtgagggtcatcacacaagagacatcgaataaagttaaggaaaaagtgttcagtgagtgaagaacattgtggtaccatgcagacttctgcttcagattgcctccctacacacacacacacacacacacacacacacacacacacacacacacgaacaaaggaaaacctctctgttctctgttccctcctacagctaggacatcctgtgaagagatcccccagcatcttgagtctaggagaactgtcattgccagtgcctgttataatgtcctagtcaatggaagaataagatagtggggatagaacgtgctggggtgcttgtagcaggtggactatgtggtatcaggatcccaggaagaactggctcttgctcgtaaaaggttgagtctctggggcagccccaagggcaggacctggactttattattagagtgctctgagggaggtgagctgtgaggctcaggtggaggcactggctagaagtagagctttttctagaatgactgaggtcgttagtggttggttttaacctagccaacccaaccaagtcctagcttctttcagtaaaaggggctacttttttttttctttttttttctttttttttttttttttgatttttcgagacagggtttctctgtgtagccctggctgtcctggaactcactttgtagaccaggctggcctcgaactcagacatttgcctgcctctgcctcccaagtgctgtgatcaaaggcatgcgccaccaccgcccagccaaaggggctacttttaagcaatcatatattatgggtccactgaccctaaaggtctagtttgttggaattatcaggcccttccttaggctggatcaactcctactttagctccccaatttcctattttcaaagactgccccctttttttctccagactgttgcttttccttaatattccctcagttagttgctacttggcccccaagttggatagaaagtaggttaggagccaactatggtagtatagatctttaatcctaatacaggaaggcagaggcaggtggattgctttgagtttgaggtcactttagtttacatagcaagttctaggacagagagaccctgtctcaaaaacccaaatgtaacaaaagaggaagtagaggaggaaaaggaaagaaatgacccccatcagtctttttgtcttctctatggtacaagagatatctgaaaactaaagagtgaacttagcaagcctcctgggactcctaatttatgtcttagatttgtcttgggcctgggtccactggccacagttaggcaggagtagaaggtacaccagccaggaggtcaggcttagccctcaaacagggttttccactgttttgcacttgggatgttgtttagtctccctctacttttacccacagccttcatagtgcctttctcctagttcagttaaacttggcattaggctaaggccttggaggtcctagctaacttcaatagactctcactaggaatgataggtacagggtgggagctatggagccttcctaaccatttaaggtagttaatatgttcccgatggcttctgggactaaaggccccccactttagactgactgctctgtacctgtaaccatactgaagtctagtggttttctaagccactgcagagttttgttttaaaaccttcaggtccattcagatgcagagcagagcagaggtcaacagtttcatcttgtggagtctcttcattgctttcctgacttaagtacataccctacaggggctgctgggaaaaggcttgagtgaacccaaactatacctctatctcttccatagtgggcttctcattcagattttatttgaacaggggaacctgttattacaattaccactggtctgtaaaacaataccagagaaactggaggaatatactattcttacatcttttttccttacttagaatagtgaccctgaggggtcaactggtgttcagtgaggagaagacatttccaggtactgtaaccccagtcttcaaacccactaaaaaaatcccaactttccaataagaaataatgcaggagctgggcgtggtggcgcacacctttaatcccagcactcagaggcagaggcaggcagatttctgagtttgaggccagcttggtctacaaagtgagttccaggacagccagggctatacagagaaactctgtctcaaaaaaaaaaaaaaaaaaaaaaaaaaaaggaaaggaaaaagaaataatgcagtacatgccattgagggtaggatgtctgcagtgccagggactttctttgaatttaaatggccaagaaagaagtatggtaactttgagaaaggaagaaaaagtgaaggattcttaactgtattctagacatatttattttaaaatttccagcagtccaatgtaatacagaatcttactaatcaacagataaacaatttacttaaataatctagctaggaagtggttaaacaaacagactctgatcaatagtttccagggttcccctcctcctagcttgaatctaggggatagacagaaggatcaaaagttcaaggtcatctttgcctagttctaggccagcatagggcttgagagggctattctcaaaaccctcaccgcctaggagtcagggtgagagctcagtctcctcctgggtagtgctgagctgggggtggtaatcagctctgacagcagtcaccgagtaaaagccctaactgaatcttaaggcaagaagagcacaagcagagggggctcaaagtccacaaggtaactagcaagatcctgcttcaaaattttgtaaaagttaaaaagagctaagtacaatgttcatatttgcattactactactggggactcaggagcctgggaaagatcatcatgaacgcctggccagcctggtgcatgtgaaacctggtccaaaccaaatcagaccagaccagaccagaccagaccagaccaaaccattttttgccacacaaaatgaagacctgagtttgacttccagcccccatagaagtcgatatgggtggcagatgcttacctccagcagtgggaaagagaagatgggcaagaggcattgtcctgtgagtgagtgcctttttgtgaatgagagtgtgcatatctcatgtccatgaaatagactgaaggttctggggatgacagtttcaagtatatacattgtgagttaaagactggtgtctctgtgtggctggtagacaaatcctgtttctttgagtacacttttgctagaactacctgatgacaaactgctgttagaattaggtaggtaaggtgtgtgcttcaggaaggaaggctcagtattttctccaaagtcttcgacttggatcgtagcctgagtgtatgcagaaacagcatatgggagatgaaacaatttcaggacttggacttagataaacgtagcttggctacttcatgtaggtaagcccctccacggtctgtggcctcagactcgcagggtatttcacacacaggcatgtcggtttcccaaggagaatgctcacccagatccattcaattgtactttcactagtgggccagtaagaaatgttgagtgtccatataacactgagtcagaaacagttactgggttccccctggtgccccttgaatacagagaccccaaagtcaaattaggtatagtcgatgttcttaagatctcaatctaaagagtgttcagaaaagtctaagcatcagccatatctttctccataatgagggtggagacatagctcagtgggtaagaactcttgttgctcaagcatgaagacccaagttaaactctccagctcccacataaaaagaccagtatggtttttttacatacatgcctgtaacccaagagctggggagtagcagatggggaggcaagagaatcaatggaacttgctgaccaacagcctagctccagattcaggaaagaccttctctcaagggaacaaggcaggggttggtagcaggacacttaacatccttcaactatgcattggtgcacacaatactgtatgggtgcacacacaggtacacatatgcatgcatgtgcattcatgctcatatgtgcacacacaaaataagtaactttatctacagcatgtgccacttgctgtttaggataatagtcaaatgcctcagcttctggcctccactgagattcagaaactgtataaggtaataattgtattggcctcaaaacagggaaagagttattatccttagagaaggctgagccacaggtgagggtggactaaatgggagccaacataaatggggctcagcatttctgactagtgttctctctgtagtaccactgtgcctcacctcagtaacgcagtatctatttatgccttcagctaaaagttgatcctcattctagagaggatgaacactgactttcacggctgtgtcaggcctcacactgaacccactgtcctcatcacctggcctttgccactacacagttctttccagctaccacagacattctagctcctgtataccaggtggaatgccattgcccttcctaagtctgtacttctcacctgtcctgtctccctcagtgacagctttccacatggactccagtcagggaaggatcctaacactatctttaaggaccccttctctgtagacccatgctctccctcatttttctgggaactgaagccctgaactaggaagagatttacctgaacacaacactggctatgccaaccctctttcatctagtaaccacagaaggccactggctacctcttctgttatctacactgagccagctgcctcctcttccttgggattattctcaagtagactctctttaaacgagatgagatccactctgtagcctaggctggctttggactcaaggtcttattccctttgcctcccaaatgatgagatgacaggcatttatttatcaccatataaagcattgtaaagttcttataaataactaggttgttggcatagtcatccagctgccagagaatcctttcctgttcatatcctacctgatacccaagctaactccctttcttcaatgacctccaaaataagtggttcttgggggctgggctgtaactaaatgggaagagtgcttgcctagcatgtatgaagtactaggtctgatttccagaaccacataaagctgatatggtcatgcacagctagaatccaagtacttggggaggttgaagcaggagaaaatgccatctgctatgagtttgagatcagtctgggctacatgacatcctgtctccaaaacaaaacaagcaaaaggatggaacaacaacaacaaaacagtttcttgctcaaaccacgtgctttctgctcagctcttttgaacaaatatgttactgataaatagcaaatgaggcagttaagagcttcatctgagggctgctcaaaatgaggagacttttctggactaggtgatgaataggggacaaatttgccattgcttttcccaatctattccccaatccaagatgcacctttgttgccagtaaactcaccagtccaacagcctctgtgcctgctatgtgtgtgtggcactctttgttcagactgctagctaaacagaattactcatgttgaaatgactgtggatctacttagagagagagagagagagagagagagagagagagagagagagagagagagagagagagagagagagagatagggttgggaaagacttcgccttacttcctgcagcaagcatctgagtgtttggaggatatcgtgaatattccagccagtttaaaattgcactagatagcagacagagtgaaatacctgattcacaccccatagcggctcagacaagtgccagttttccaggttttcggaattcatggctgaaaggcaccttacaatgtagactggacacacgtttaacagccaggaaagtctagacgttgcagccaatcgctacttacctctaatccaaccaaatgctagccaggccggactctgtttagcttctgagatatgatgcgtccaagtggtagggccatagactgttacaggtttctccagacccagctccaaatgggttgtgtgtgaaggaaaccggggccgtgtagttaagatgcacctcctttagcttccaccctgcggaactccaaatcccaaaaggcctaagtccgaagtcctcgaaaaactccaagtggcggtgtgagagatgtaagagcctctgctttggaggcgactcttactcgtggatagtttaattatttatttttatttcggtggaggcaaggggcgatcaatgaaggggaaggggcggggagagagaggaggcggacccattgggactgacgtatacgcaggaaagccaatagatactggggggcgttccctctcattcaggactcctcgcctggttccggaggtatgttaaacagctgcttttaatttggtctccccaatttcggtattttgggggtctagttctttggtcgcttgctttggctgcacaaagtctgtgtgggtgctgcagtccccaagacagagctacggggaggctcggagtcccgcggttgaggtaggctaggggcaggccaggaaggagagcgcttggcgccgcccgctcgtagtgtgtttccaagcagggctggaacggtggggagggggctggcccggcctgggtcgccctcgcgccggccgcgccgcccaatttattttaccaagcagtcggtttcgataggtttaggaagctcattggggaatgggccagcagaagaccaactgctcttgtaaatgctttaaaaatattttaaaaaataattataaagaagaaaaagagggaagagggccctggttgcggcgagcggcctcggcagggggcggcggccgcagcctggccagtcgggcccaccgagctcacggtgtccggagttggtcgaccgctggagtttaagagcaagccgggccccacggtctttctccgctaaccacgctgggcgagtgcagtggccgccctgagcgtttgcttctgccggcaaacttggaagggtcgtgggcgcgctctggggaggcgcgggcaccgtgggcccgcggttgttaaggactctgggggcgggggcaatggctgtat

SEQ ID NO: 1418 - DNA, 3521 bp, Mus musculus
gaccgagagctgctgaggcgccgggccacagaagcggagcgcgagtgcagcgggttctggcgctcgcccaccagacctgccccggcggcggcgggatggagccggcgaccgcgccccggccggacatggcgccggagctgacccccgaggaggagcaggctaccaagcagtttcttgaagagatcaacaagtggacagtacagtataatgtttctccactctcctggaatgtggctgtcaagttcctcatggccagaaagtttgatgtgctccgtgctgtagagttgttccactgctacagagaaacaagaagaaaggaaggcattgtgaagctgaaacctcatgaggagcctctccgttctgagatcctcagtgggaagtttactatcttgaatgttcgagacccaactggagcctccattgccctcttcactgccaggttacaccacccccacaagtctgcccagcacgtggtgctccaagctctgttttatctgctggacagagctgtggacagctttgaaactcaaagaaatggactggtgttcatctatgacatgtgcgggtctaattatgccaactttgagctagatcttggcaagaaagtcctaaacctgctgaagggagcatttccagctcgactgaagaaagtgctgattgtaggagcacccatatggttccgagtgccctattcaatcatcagcctgctcttgaaggataaagtccgggaaaggattcagatattaaagacatctgaagttacccagcacctgcctagggagtgccttccagaaaatctgggtgggtacgtcaaaattgacctggctacttggaatttccagttcctgccccaagtaaacggccacccagatcccttcgatgagatcatcctgtcttccctacctcctgccttagactgggactcagtacatgttccaggtcctcatgccatgaccatccaagagttggtagactatgttaacaccaggcaaaagcggggcatctatgaggagtatgaagacattcgtcgtgagaaccctgttggcactttccactgttccatgtctccaggaaacctagaaaaaaacagatatggagatgtaccctgcctagaccaaacccgagtgaagctgacaaaacggagtggccacactcagacagattacatcaatgccagtttcatggatggttacaagcagaagaatgcttatattggtacacaaggtcctttggagaacacctatcgtgacttctggcttatggtttgggagcaaaaagttttggtgattgtcatgactacccgctttgaggaaggcggcaggagaaaatgtggccagtactggcctttagaaaaagactcccggatccgatttggcttcctcacggtgactaatctaggagtggaaaacatgaaccattataagaaaacaactctagaaattcacaacacagaggagcggcagaaacgccaggttacccacttccagttcctaagctggccagattatggtgtcccttcctcagctgcttcccttattgacttcctgagagtggtcagaaaccagcagagtatggctgtaggcaacctgggagctcgctccaaagggcagtgccctgagccacccattgtggtccactgcagtgctggcatcggcaggacaggtaccttctgctcactggacatctgcctggcacagctggaggagcttggcacccttaatgtgttccagacggtgtcacgcatgaggacccaaagggccttcagtatccagacccctgagcagtactacttttgctacaaggcaattctggagtttgcagagagggaaggcatggttccctctggtcacagcctgttggccatggacggtcaataactgctccacaagtttccacctgctggtcagccttccttaaactaccctggacactgctgagcctataggttgccatcagttatgctgaagccatggatcaacctctttcctgtgtctcccagcgcacatgtgcacgcaaggcagcctttccctttggctagataaatgtggtgaacttgccactagaaagggccagcagcaatgtgttcttaattcctagcacctgctatcgaactgtgccttatcaaaaccaaattgtggctattgatttttgccagggtccctgaggtaagtgggggaaaggacccctccccccacccccatctcccagttcctctggacatctcctccttccctttgctatgatttgacagggaggtctggtgagcattcaccttcctacccagaaagcttgaccaagttacatattctagagaatgtcccgagtgccaagcacgtttatacatagggcgtgtattccagtcttttctgtcattctgtgtgtgtgtgtgtgtacgtatgtgcacttacgtgtatggatccatatgtatgtgtgtacataatatatactctgtgataattatggccgtatactataaatacatatacacacagatactctttgtagaagtctctggggatttatgttgcagttcagcattccttgcttcttggaccctgctgattattctggactggctggggttagggatcatggctcatgttgtcagacagcagagtgatagaagaaaacacatacttttttcctgggccacaggtcttcttccttaatgaaaattttccctctggactctatgcttgttggagccaaaaatactgacttatggtaacactggttcaatttagcatgggtgtctttcatctaacaaattctctgttgtctttgctgatttggggaacagacctccactgtgattccagactctgtcttatgaccccattgatggggaccaaggctagaaataaatttacagagctgccagagtccaaagtaatcggtacgaagttttaaaaggaataaaggagagcccagagtgaacaagaggaacctaccatgaaatccccttcttgggaggacaaactggggcctctttttcttgtgttggaagacacctttctttatgcaactcttccttgtctactgaatgcccagctctccctgcctgctagcctgccagatcctagactgcaaactgggtgggcctatgtctttataaaacataaactgggtgggtctatgtctttatgaagcataatccctttggctgcatgagtccgttccttggaatcactggtccactgcccgtacaacttgttcctgtcttttcccagtctgattcgccaggaatggaatcaagagttcccaacactgtgttcccacaaaaccctacagaacccctaaaccttcccttactccacacgatgaggttggcagctggtcagagctcaataattttatactgtaataagatctttgaatgtgtatattcttattttttacaatcatttcattttgtatttaacatcaatggactgagtcaagattcagtaaataattgtaatgttcatatgcgatatcttatagtggtacaattttgtatttacctataaatataccaacat

SEQ ID NO: 1419 - protein, 624 aa, Mus musculus
PRAAEAPGHRSGARVQRVLALAHQTCPGGGGMEPATAPRPDMAPELTPEEEQATKQFLEEINKWTVQYNVSPLSWNVAVKFLMARKFDVLRAVELFHCYRETRRKEGIVKLKPHEEPLRSEILSGKFTILNVRDPTGASIALFTARLHHPHKSAQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILSSLPPALDWDSVHVPGPHAMTIQELVDYVNTRQKRGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEERQKRQVTHFQFLSWPDYGVPSSAASLIDFLRVVRNQQSMAVGNLGARSKGQCPEPPIVVHCSAGIGRTGTFCSLDICLAQLEELGTLNVFQTVSRMRTQRAFSIQTPEQYYFCYKAILEFAEREGMVPSGHSLLAMDGQ

SEQ ID NO: 1420 - DNA, 23715 bp, Homo sapiens
  misc_feature (1)...(23715): n = A,T,C or G
nnnnnnnnnnnnnnnnnnnnnnnnnnnnnnnnnnnnnnnnnnnnnnnnnnnnnnnnnnncccgcggggcccgtccgctcctccatccgctgcctcgcgggcggcgctcgccggcgcggcggcaaagactgagacagctccgctgcccgctgaactccatcctcccggctgtggggcggcggtggctgcggtcggtcgcggcagcggctccgcttcatatctgcagctggggcccgcgggcgtcagcgccgcgactgtcccggctccgcactgccccaggccgcagcgcagccgcgccaaccaccacccgcggccaccatggccggacgggctccctaagccaccgaccccagcccgcggcgccttcgagccttctggggcctccggcgccgcgacctcctctgcgctcctcacggaagagaccttttttgtatttttagtagagacagggtttcgccgtgttagccaggatggtctcgatctcctgacctcgtgatccaccctcctcggcctcccaaagtgctgggattacaggcgtgagccaccgcgcctggcataagtttttaattttaatatagtccaatttatctcttttcttttgtcacttacgcctttggtatcatatctgtgaaagctttgcctaacccaaggtcacaaagatttactcttatattttattctgagagttttaatagttttaatcccttacatttggtctgtgatacattttgagtcagttttacagtgtgaggaaggagtcagcttgatttttatgcatgtagatatctacttgtcccagcaccatttattgaagtgagggtttgagctggccatttcactcctcattttctgctcaacaagaagagaatattcacaccttgggttttacttactgagtacatcattttatgacccaaatggtgtattctgtgtagctatagtgatgtctcctttttatcattagacagattacatcaatgccagtttcatggatggctacaagcagaagaatgcttacattggcacacaaggtaagctggtccgtccctcccatgttgattttgtgccatctacttatgattccttgtgccaaatgatagcataatttttaaacgaatggtaacttgagtggaggttttggccactagatcctggccttttataaagatgggtggtggttgagaaaagcaaataagtagtttggggtttctgtaccaggtgtgcctggaaactcaccgcatagagataaactggagatttaaacacataacactactgcctgcaagttttggggctatttcttagtattggcaagggtgtagggcatcagaatgcatcagccagtgagctcttcatgctcttcctgtctagtgagaggccaagaatagcagtggacttcccagagattgagtccaatctaggaatgagtattgctgtcctaataggcctaggctggttcctataccatcacagagcactccagcaaatgttctgacatagatagtatgtgctaataagtctgacagtggaatactgagctctaggaggatttctcatttttttttctcctttgaaatggaggcttgctgtgtcgcccaggctattgtgcagtggtacgacctccactcactgcaacctccacctcccgggttcaagtgattctcctgcctcagcctcctgagtatctgggactacaggtgtgtgccaccacgcccggctaatttttgtatttttagtagagactgggtttcaccatgttggacaggctggtctcgaactcctgacctcgtgatctgcccgcttcggcctcccaaagtgttgggattacaggcgtgagccaccatgcccagcctctaggaggatttcaggtggagtttctataaatgttcctatgatcctagtactcttcctgacctggcctctccatctcaagaatatcatgtcactttcaaagatggtaggaggaaatcataatacagaaagacaacagaccatcagatgggcgtaaggccctttgaccactgcagagcaagatacggtggatacctccttaatcaagtgatcaaacttagtatcaccagtaaaggacaaagggacattatgtacacctcctgatatgatgcattgagaaatgaatatcacctgcattgtgtattgccagttttaaaatctgaatctagtcatgggaaacaatccagattgtgggacatactataagaaaactggctcagactctccaaagttaatgccataaaaaacaaaaaggcagagaactgttctagattaaagggagactaaagagaaccatggccaggcacagtggctcacgcctgtaactccagtactttgggaggctgaggggggagtatcacttgagcccaggaagcagaggttgctctgagccgagatcgtgccactgcactccagcctggctgacacagcaagatcctgtctcaaaaataaataaattaaagggccagtcacaatggctcacacctgtaatcccagcactttgggaggccgaggcaggtggataaactgaggttggaagttcgagaccagcctgaccaacatggagaaaccacgtttctactaaacatacaaaattagccgggcgtggtggcacatgcctgtaatcccagctacttgggaggctgaggcaggagaatcgcttgaacccaggaggcggaggttgcagcgagcagagattgcgctcaaaaagaaaaaaaaaaagaggatcggccaggcgtggtggttcatgcctgtaatcccagcactttgggaggccgaggcaggcggatcacaaggtcaggagttccaaaccagcctggccaatatggtgaaacaccgtctctactaaaaatacaaaaattagctaggtgtggtggtgggtgcctgtagtcccaactattcgggaggctgaggcaggagaattgcttgaacctgggaggcagaggttgcagtggactgcgactgcgccattgcactccagcctgggcgacagaggaaggctctgtctcaaaaaaaaaaaaaaaaaaaaaaaaagagtatctgattagatcctcaactgggagaaaaaaatactattgaagacaaactattgagacaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatccacaacccgggtatggtggagatgaatagatctaacttgttaaagctttaatccctggctctggcaaccctgtgccagttataccctattttgaggtcctggccttatccactaaaggaagttctgggaaacatgggacaattctccttttatctgttccctatttccagaggggtgctgccttcctgactcctgaattaccagattccctttgctctccatttgttgctactttttttttttttcttctgagatggagtctcactctgccaccaggctggagtgcagtgtggcacgatcttggctcactgtaacttccgtctcccaggttcaagcaattctcctgcctcagcctcccgaatagctaggattacgggcatgtgccaccacgcctggctaatatcttttttttttttttttttggagatggtgtcttgctctgtcacccaggtgggagtacaatggctcgatctcagttcaccgcaacccttgcctcctgggttcaagtgattctcctgagtagctgagattataggaacgtgccaccatgcccagctaatttttggatttttagtagagatggggttttaccatgttggtcaggctggtcttgaactcctgacctcgtgatctgttgcctcagcctcccaaagtgctgggattacaagcgtgggccactgcgcctggccaggaagattttattttatttttattttattttattttattttattttatttttgagacggagtctcactgtcgcccaggctggagtgcagtggcgcaatctcagctcactacaggctctgcccccaccggggttcacgccattctcctgcctcagcctcccgagtagctgggacttcaggcgcccgccacctcgcccggctaattttttgtatttttagtagagaaggggtttcaccgtgttagccaggatgggctcgatctcctgacctcgtgatccgcctgcctcggcctcccaaagtgctgggattacaggcgtgagccaccgcgcctggccggaagattttaatgaaaggaatatttttgaaattttggtctacaaatctggcaaatttaaggaataacctatttcagatgaggaaggaaaaaaatgaatgtgaatgttaaattcccttccttagcactgttataaccaccacttatttggagaggaggtagtgggagaagttctatcttggaatactttggggccactggagggtggcaaggtagatttaggccttttttttttgagacaagagtctcactctattgtgcaggctggagttaagtggtgcgatctcagctcactgcaaccttaagtggtgcgatctcagctcactgcaacctccgcctcccaggttgaagctattctgcctcagcctcccaagtagctgggattacaggtgcccaccaccatgcctggctaatttttgtatttttagtagagatggggtttcaccgtgttggccaggctagtctcgaactcctgacctcaggtgatccgccaccttggcctcctaaagtgctggaattacaggcatgagtcactgcgcctggcctaggcctttttttttttttttttttcttttttgagacagagtctcactttgtcatccaggctggagtgcagtggtgccatctcagctcactgcagtctcaacctcctggattcaagcaatcctcctacctcagcctcctaagtagctgggactacaggtacccaccaccatgcctgactaatttttgtatttttagtagagatagggtttccatgttgcctgggctgggacttcaggcttttacacaaacctcctgctaacataccagtagatgtgtgtttatcagtttatcagagagttctctctgacctatcatattttcatattttctctactctttttttttctttttctttttcttttttgagatggagtctcatgatgttacccaggctggtctcaaactcctggtcttaggtgattctcctgcctaaacctcccaagtagctgggattacaggcatgcaccactatacccagctactatactgtttttgtctctgttcacccagtatttatcccacatatgtgagacgtactattgcgtattaggaaaaagaccaaatgctgtagtaagtgctcagtaactgtctgctatatgagtacatgcagaaactttagctgtgagtacatttgtttagaatgaagaggtttcctttcctttctgctgagaatcaatggtgtaagttagaagcaatgcaagagatgatattgctgcctgggggtatatcaggtctttggggaagccaggttactgctgtggagaggaacgatggaaggcttaccttgctctgtgtgtcttcagctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggtaaatccaggtttcttttttctcaccttgttgaaacagggggagaataattactgtaatgaaaatctccagagggaataggtaggataccagggaagttatgagttgcttctgtttttctagggacaggatgaggatatttaactcacagccaatatagccatattactgcagcacgataggaacattaaataggagtaaagcttataattttagaaatctggggctgggtgcaatggcttaggcctataatcccagcactctgggaggcagaggtggaaggatcacttgagcccaggagttcaagataatctaggcaacacagtgagatcctgtctctacaaaacatagaacaaattagctgggcatggtggcacaagcctgtgaggtcaaggcagcagtaagtttgatcatgccactgcactccaacctgggcaacagagtgagatcctgtctcaaaaaaaattctggatcttacagtataggaattctgccttttccaaacaattaaccaacccttcctttgggtttgtagtaaagaagcaattatgggaaaagttgacagtggtggataggagccttggtggtagggataaccagggtgttgagaatctggaaaagccagaggtagctaggggcaggcagaaataaccttgttaacgtttacttcttttcttatctaaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaacgcacctaatgcagctcttggtgtctgcaggggcagtaggggtggacgaggaaaaacaaagctcttagcccacatctgtgattggagaaggaactcacttgctcccttggtggtgaattgctgtgaaaaatccctcatctaatgtccttttggtggaccaagtgatggccagaatatatatttcacaagccaagtcctctaggggttgatgttttatacaccccatcataacgctgactctgtcacctgttagaactgtcactgcaggtatcccagagagctcagctgggctgctgcttccttcccatccagccctccctggagggactccccaccctgtgctgtgttctccattctggagccagttagcagcttttgccttaagggcatgtacatggtaggaaatgttggcctttctatttcaaaggtccctttgggagaaagttgagaataggtttttgttaggcctctgaaaaacttgtggactctggaaattaggtgtgggagtgctgtcagtctgtctgtctgggattgaagcaggaagttcccctgtgtcaccttcccatttccacttcctgttaccccaagtgtatgtcctgagaaataagaggccttctcatttctctggcctccaacactccctgtgacctccttcttgagtcctttcaggcctaaggccacctggccttctgccatgaggcactttgcctgtgaagtcattcattcagttctgcctgggttatttggtagagggaggaagagaagagaggtaaaccagatgtgatcacttccttccttcttcaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaacccttttagcttcatcaatttagcagcctgggacatgagggagggggtccaggagctggtctgggagggatgagggaggcagggagggacccaagccttcagtatctgagactttgagttctgacactatgagttcaccttgtctgtaggccatggccctatctctggacagagggaccagcaccagttcagtgcttgagatgtgctaagcactatgctaggtgcttttcccccaccctgcctcattcaaacctcacaacaattcagtgagatattatcttctctcccttctcctgtgcacccctttctcatttctatatagatgaggaaggtgaggtccagagggttacagtgatttgctctaaaacgagctcaagttggtctgcttacaaagcctgtggtctcttcactgcatggaagatggagatcttgtgtttggagaacagaggtttgtttagctctcctttcagagtaaaaaaagttcttaaattccaggttgttgttcttgtgcccatgcttcatgtagtagacgcgaagggtgacagggttggtgactgactgtcctagctaggacctcctgatgtagggtcctcatgtctgcagcgtaccaaaggggttatcattctccccaggagactccatatctatgggtacatggtctttgtgagaagatcttgagtcatttgcatttatctcttagaaagaaaggaaccagaagctttgtacatggaagaccactccccatatcatacctgttggctgttgatggcctgcccagttggggcagttgtggctgggaaatattggggtgttcttaataatagtcatagcagccaatttactggatgctcactctattccaggcactgttcagagtaatttctaggtatcatctcattcaccctcaacaaccttttgaggtaggtattgacagaagaaaaaaattgagagacaggaatgttaatttgctacagccaggatcccagaccatctgactccaaagtatcttctttcacctcttacactagacttcctctaaggatccatcttctgatctgccaataaatttttatcgagtttcttaccataatcaggagctcaagtgtagagcagaagattaatctagttccttctccagatgagcctccattctcttgggagtgcacaaacataagaagtgaacagagattcttggaaatctgagaaaccagagaggtcaggggtttggtggaacatgtaagaaatgggattaatgataaacggcctggaggaggtaactttaaattgtcatttatttgaagaggctgtaacccgactgccctgtgaatttaaggttatgcatgagttcctcattgcatatctgaagactggtgaggttatctatcacttcagctccataaaatgctgatttctgggcccatccagtaggttgttagtgagtgacaggattatccaggtttgggaaccatagatttagttcatgtttctgaccctatagagagttaacaaattgatgtctcctaaattttcagtaaaactcagaggaactcctcccactgccattgtttgtagcttttaccagcgtgaacctacctgtgttaggtgttaaaggaggaggtaaaggaaagggaaggcagagacgcaacccagaatctgtttggcaagtcagggttctcatacaggagacttagtgaacaaagcaagagaaaatgctcagggtccaagtgcagtggctttatgcctgtaatcccagtactttggaaggccgaggtgggcagatcacctgaggtcaggagtttgagaccagcctgaccaatatgatgaaaccccatctctactaaaaatataaaaattacccgggtgtggtggtatgtgcttgtaatcccagctactcgggaggctgaaatgggagaatcacttgaatctgggaggcagaggttgcaatgagccgagatcgcgccattgcactctagcctgggcaacaagagtaaaactccatctcaaaaaaaataaataaataaaaaagaaagacagtgttcaggaaagaagaaaacactgagctaaagcaggcttctgcttctgatttgatggctgtttgtttcacctttctctaacattcccatgctatataatttttcaaacatgagataatccctgtgtcctttttcccattgctcccttcatcttgcccatcctcattggctaggatgggactcctgagacgaagggtgccccagcatcctcagcctcggaggcccacccttatcagtcttcatgtgacagtatgcaggtaaatgacagagtaggacttgttcttgggagaatggactatttagcatcatagccctagggaaatttggttccttccctgaaaggaatgcttcctgtctcttgggacagacagacacacatacaaaaacttttataaatcagagacctagagggaattgggccaagaggcattggccaagtagaaaagcttctctagagtgacccagctcttttgtggttttgaggtcttaccactgaaccaaacccaagtcctaggttccctctgtaaaagaaggggctacactagatgatcctaccatgggtcctctgactgtcagggtccagttctttgttagacagtgcaaacacccatagaggagctattaggcctttacttgggttgagttggctcccactagcactccccacttttcattttttttactttcagagacagagtctcactctgttgcctaggttagaggggagtggcatgatcatggctcactgcagtctcaacaactgggctcaagcaggaacccagctttttttttttttctctctctctctctagagacaggatctcactatgttgcccaggctggtctcgaactccagcctcaagcaatcctcctgcctcggcctcccaaagtgagaggattacaggcatgggccaccacacccagcctctccagttttagtgtgttttcagagtctcttctttcaagctgctgctacttccctagcttccctcagttctcttcccccttggccttccaattggaggaaaagcaggtcaggtctctgtcatctccaagaccagcctataggcctttaaagtttccctgtttcttaatgtggggtctacagggtttctcagaggcaaagcatgaacagaccaagggtcctatagctcccaacctagtccttagatttctctctggccttggttactcccacaaaccactgtgagcctaccaagggcaggaatggaaatgcccatcagcctgggaaccatctttttctcttaggaggtatccgccctatagttacctttacacaacacttgtgaatatcaagtgttctagactgcactgttcataattgactacagagaagactaggatcttctccacaaatagaaatatatcacttttacttggagatgttttcttgggggaaaaaaaatctagcaccttgaaacctgttacaatgtttaaatctcccttctttaccttggctgtcataaaatcctcctgtttgagctaaatgtggcctgctgaagtcttaaatgcccatatttttcaggctaaggccatggtggacatagctaactccactagaatcctagctgggggtgttggaaaaaacggtacagtgcccctctcagactccaggctcacgtccgtctcccctccccgcacattataatctactacttctctaatgctgctgcgtagtttgtcttaaagcctcaagactggccagatgtgcacctgagtaaaggtcagccatttcatctgggggctctttcttgacttctaatgaattttcttctgtgaaaaaatgtatttttaataaaaaattttctgtggccagcatccagtggaagtctggagtctgatgtgcagggcagatactggtctggagatgtcagtttaggacttagttagacagaagcaatgagccttgaagtgagaatgaggaaggcaagagaggagatacatttggatgtcaccaacatttaggtaatgggcggaggaagaaaagctgctgaaggatactaatgaacaggcagaggtaactgagcacaaagccaggctgctttgtcacaggctgctgagaggtaggtagtggctgggacgaatgaacaagatctgaaatgtgggttcattagaagtcttcgaagggactatgtggctgttagggaggctgcatgagagagatgtgaaggaatagactgcagtgcccaggctgtcctcacttaaaccaaaacaaggcccaccttgatctcttacacattaggcttctgaataagattttctttgaacaaaggaccttgctgggtgcagtggctcaggcctgtaatcccagtgctttggggggctaaggtgggaggatcacttgaggccaggagtttcagaccaacctgagcaacatggcaaaaccccgtctctaaaaaaataaataaaaataataaattctcaaatggcaagctattctatttttaaaaagcagtaacaaaggaactcgttgctttaaaaaaaaaaaaaaaaacgtcaggccaggcgcagtggctcacacctgtaatcccagcaccttgggaggccaaggcgggtggatcacttgaggtcgggagtttgagaccagcctgaccaacacagagaaaccccatctctcctaaaaatacaaaattagccgggtatggtggcgcaagcctgtaatcctagctactggggaggttgaggcagaagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccggctaatttttttgtatttttagtagagacggggtttcactgtgttagcccaggatagtcttgatctgacttcgtgatccaaagtgttgggattacaggcgtgagccaccacgcccggcaggcatacttaattttaaatctcacatcttcccaccgaagtaggtattctgattcttagattacagataaagaaactgaaaagataaatgatttgccaaaatcatcttgccttgaacctagaagatgctttgggttgtgggtccctggggagccagcctcatatcctccttacctggatattactgagagtcttagccctcagagcttgtgtggatagggtgctggcactgatatccttggcagagtcactgaagtgcaggccctaaatgtctctcagtcaccacctaccataagtgccctaaagaactttgaatgagtcctttttgtgaaagagagagggtgtatgtgagacacctgtgagattgagggtgtcaggaggtgtgatagatttgagtttatgtgttgcgagtttaggtcttctgtgtatgtatgtatgtatgtgcatcagacaaatgttgcttttctggataattttctggaaacggccagaaatcatttagaattgtctgaggataaactgatctttaagttagggaggtgaggagtgtggagcaacaggggagtcaggctgtttttctccaggccccaacctgggtcactggccggagtgcacaaagacagcgtgtgggagtggaggcaaagcttagactttggacccagacttcccttaagctatttgacttgagcaagtcactctactgctgttagcctcagtttgctcatctataactaaggataataatccctaactcacaaactctacaagaatttgttgttgttgttgtttgagacagggtcttgctctgtctcccaggctcaagtgcagcggtgtgattacagctaacagcagtctcaacctcccaggctcaggtgaccttcctgcctcagcctcttgagtagctgggaccacagggacatgccaccatgcccaactaaatttgtttttattttttgtagagacagtctcactgtgttgcccaggctggtctatgagacttttcacataaaacgggcctccaggaatcagaacctgacctaccagtgtgatttctcctaggagggcccttacccaaatccacttaattttattttaattattatcattattattatttttacctataccagttggttcacaaagtccacttagttttgtcttcactgatagggtagtcaggggagtagcatggatgtaatccctcagtgcagctggcagctggagggacaatgtcaccaaatcaagcgttctctttcccaaagaatgtgggacttgccgtgctgtccaggtgtcaacatactgagtgagaaaccatcactggaccccttccaaagggccccctgtatctgactgcagtgagctctggggactcagaggtgcatcgaagtgtctgtcctcaagaaactcagtctgccaagtgttcaggaggaggtctccaccagggtggcacacataggaccatgggcagtgtcagcaaagcctggttctctgagtggaggtaactgttgcagttgcaaatcctccatgagtaactgcatccacagcacaacacgtgctgcctagtatcactgtcaaatgctgggtctttggcttccacagcagctcagaaccttaccaggtgataaagcacactttatcatcacatttgatcctcataacagggcaaggattgctatgttatcctcttatataggagaggaagctgatccacagataagaagggactaagtgggaaccaggggactcaacttccagactagttctttctgctccaccaatctgcctcatctcactttgacacagtatctgttatgccttcagctagagccccttaagaaattaagaaatagagcaggaatttgagatgggggatccagccatcagggggattggttctttttttttttttttttctttgagatggagtttcactcttccccacccaggctggagtgagatggcatgatctcggctcattgcaacttctgcctcccgggttcaagtgattctcctgcctcagcctcctgagtagctgggattataggcgcccactaccacgcccagctaatttttctatttttagtagagacggggttttgccatgttagccaggctggtcttggactcctgacctcaggtgatccaaccacctgggcctcccaaagtactaggattacaggtgtgaggcactgcacccgactgggttctttttgagactctgtctcaaaaaaaactctcaaagagtttcactcttctgcccaggctggagtgaagtggcgcgatctaggctcactgcaacctccgcctcccaggttcaaacaattctcctgcctcagcctcccaactagctgggactgtaggcatgttgccaccatggacagctaatttttttttttttttgagacaaagttttgctcttgtcacccaggctggagtgcagtgatgtgatctcggttcactgcaacctccacctcccaggatcaagcgattctcctgcctcagcctcccgagtagctcggactgtaggcacatgcaaccacacacagctaattttttttttttgagatggagtttcactcttatcgcccaggctggagtgcagtggtgcaatctcagctcactacaacctccacctcctgggttcaagtgattctcctgcctcagcctcccgagtagctgggattacaggtgcccaccaccatgccctgctaatttttttgtatttttagtagagatggggtttcttcatgttggccaggctagtctcgaactcctggcctcaggtgatccgccttcaggtgatcctgacctcaggtgattggcctcccaaagtcttgggattacaggcacgagccacagcgcccagcccacgcacagctaatttttaaatattttgtagagacagggtcttgctctgttgcccagctgggatctctgttctgaagaaaaacttggtcctcaccctagggaggatgaacctcaaactccatggctctgccagggtgggcctcctgctgaacacatagtccttatctcctggcctttccctctccatacttttcacccagtgattcaattgactgagctactgcctattttccagtctccagactccagttggggtgacccactgcccttccaaaatcagtagttcttcccacctaccctgtctcctcagtggtaagcttcccccacctggatcctatgtgaggtccttagagtctatctttttttcttttttctttttcttttttttttttttgagacggagtctgtctctgacgcccaggctggagtgcagtggcgtgatcttggctcactgcaagctccgcctcccaagttcacgctattctcctgcctcagcctcccaagtagctgggactacaggcgcccaccaccacgcctggctaattttttgtattttttagtagagacagggtttcactgtgttagccaggatggtcttgatctcctaaccttgtgatccgcccaccttggcctcccaaagtgctgggattacaggtgtgagccaccacgtccagccgagtctatctttctattccaatttccaaccccatttcacagggaaactgaggctcagagggaggaagagacttgcctaagactataacaccagttgctgaccatgctaagtgcagaactcagattacctaactagtagcctcaagctctatcaactcttcacacagcaggccacaggctacttctttccctctactacccacactgaatcactcacctactccccttgagtctttctcaaatacaggctctccttcaatattcttctcaccggctgggcgcggtggctcacgcctataatctcagcactttgggaggcagaggcgggtggatcacaaggtcaggagttggagaccaacctggccaacatagtgaaaccccatctgtactaaaaatacaaaaattagccgggtgtggtggcacacgcctgtagcctgtagtcccagctactcgggaggctgaggcgggagaatcgcttgaacctgggaggcggaggttgcagtcagccgagaccatgctattgcactccagcctgggtgagagagtgagactttgtctcaaaaaaaaataaaattcttttcacccactgtcactgttctggtcaatcctcctttcgtgtctcctgaattattgggaaagacttcccaataatttcctaactggcagcaggccctcattctgcccattggatgcccaagggtccttcacattc

SEQ ID NO: 1421 - DNA, 2223 bp, Homo sapiens
gctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaacc

SEQ ID NO: 1422 - protein, 190 aa, Homo sapiens
FEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 1423 - DNA, 39790 bp, Mus musculus
  misc_feature (1)...(39790): n = A,T,C or G
ccttccgttggaccacagggcatcctcggtcctgcagaacgaccccagcaacactcactgtctccaggaaaacaaagcaaacaaggatacctatggagacacgctaagaaggaattacgcgaatcggctcaaaagttatggtggccaagaagtgatacagggtgtcatatgcaaattagcaaacaggaaaggcggcaatattcaaaccagagaccctgggcatcggtgtagccagtctgaaggcctgagccaggagcgctgtgtgggttgcctgtctcaggtcgttgtcatttgccctccctccaattttgcttcccacccccaccactctactgaaagaagagagcaacagaggtgaggacctgctcttctctagttccagatcctgatgctaattaatctcctccaggacaccacagtccttgccctaccacaccacaagtatttgggggctcagccctgcccggttaagttgacatatcaagttaacccactgaagggcttcaggtttcattttttaatcttctcaaaaaccagaaaaaaaaaatcagaaaagtgttctcaggttcaccttacgtcctgcctacaactcccgagtggcttttggtagtaactaccctgtgtacccattaacaaagccaactatgtcctctctccagaatgcccacccctactgtggccacatcatgcccagtgtccccccaggtaggagcagatacagtgcagaccaggcccctcagtcctcatggtcaagtccttttgttgctctcatcccctccccctgccccaccatgtgcccctggctgcccttatccgcccaaaccaaaggctgagagggggaggcctgtgtccttccagcttcattgcacatggtccccctcctgcaaccaggctacctgaagacctttatggaggtgaaagggaaactaaattgttccctggattccaggagatggtcggcacagatggtcgtcacgtgggacctggaattggagacactgcagcgagcagctagaaagcctcttgtgttcctggcacctcctggcacttatcttgggaatgcctgcatgaggaaggagaacgacctgccctgagggtcagtgctcagcccagccctccactgttggtggcaaccgtgggacacctcattccctaccccaaacgggccttttaattgtcctggtcacttgtattggttacagagcctctcagcgatggctacaccacccttctcaccctgcctccatccccaaatctcaagcaacacaatcagcgggtactacctgtggcccccaactcctgtcacactggctattggtggtgactactttctcaagccctggctcccccaagacagtctttcctaactgcctccctacttggagtagtcacatactcaagtgcacaccacagcccgaggtggagacctgggccacacccttcccctcctgacatctttagtttggagcacacagaggaaatagaacctaaacacatgcccagaagtcctggttcaaaagctttactatggagcctgcatatgaagccacctctggcttctacagaaggaggccctggctgctccagcttgggtggagcctactgaaatgtggaaactgtgtatcttatagagcctcctctcgtcctactcatccctcagcagaaaaatgtgggcctaaaatgagttgtgtcactcagcaaacatttcctgagtacctactatataccaaacttatagaaagactaactagggaacaacaaggccacaaacaagccacctggcacagcagccttctactcatccactgcatgacccggaggctaggagagcctgggcttcctccttgcggtggggccagcctgcaaagggccactgacctggcaagcatttacttctacttcaccaaagatgcccagagtgatgggtcagcccttctgctcaagcaggccgtgcctggctggtgccattcagaccgaggccgaaggacttgtgaacaaaagcacagagatggctcagtggttaggagcactgactccttttccgtaggtcctgagttcaaatcccagtaaccacatggtggctgacaaccacccgtaatgagatctgatgccctcttctgttgctgtctgaagacagctacagtatacttacatgtaataaataaataaataaataaataaataaataaataaataaatctttaggaaaaaatctgcaaggtaccagatggaggattcggggtcaaggtgatgtggctggcatagcctgtgctctcccccagcaccttatttagacagccccccaacagtagtaggccctctgctggctgcagcctccccagcctgcacccagacatgccagtgcacagggcttggttggaagctctgagagaccaaataacatgcccaaaatgaagagtgaggagctggagtagttagggttgactttggtggcagcccacctttcctaacacacattcagagaaaggatagacttggcatctcttgggtaggagtcagggcccatccagaccagtcaccatccagccatgcactgtcatcatcacccataatgcctgcaaaggcctagcggtcctcagccctgcacatgagagaggcacagagtctgtcagcacaaacaggaagcagctgggcttttaagcagatctgtcagaaaccacaagctatgccaaggtcagagccacgggcatctagaaggcatccactctgctcaagagacggatgcactcctgcgccccggtcttcggcctggaccccacacgttcatagtctgtccagacactgggtggcggtcctaatgcacagtgaccaatatccacataacctcatttgccttccagatgttcagatagtcaaagcttctctctaccttgttttccctcaatgcatgtaattaaacacttgtggaaatcgctttaacaataaacaggaaatgagcctaagtattgttcatttcttatttcctttagagtttatgactgaggggatggaaaaaagccaacgcaatccagaaaagaaagaaagggaggagggagggaggaaggaaagcagggcaggggggggggggcggtggtcttgaaattttgatgcactagtacaaccgtacaaccaaataaattccaggagaatatattcctggtcttgtgatgggaaagatttcttaaaaatttttttggtaaagattttatttttaactacgtgctcgtgtgtgtgtgtgtgtgtgtgtgtgtgtgtgtgtctgtgtgtgtgtgtctgtgtgtgtctgtgtcttgtctgtctgtctgtctgtctgcatcatgcgcacataacaacactgctgtcagaggccagaagagatggtatctgaaatcctggagctggagttacacatgatgcgggtactgggaactgaactcaggtccttggcatgaccaggacatcctcattgagctatgaacccccgcctgaaagatctctttctatgctctgtgttagttcctgtctgtcttcggttctcaacctgtggcttacacccccttcaggggttgcatatcagatacttagcattacaattcaaaacagagtcaaaattagttatgaagtagcaaggaaataattctatggttgagggggtcaccacagcatgaggaactgtattaaaaaggttgtgtgataggaaggttgagagctactgctctatataatttatcttgatcatatccaggccccttcaagtccccttttgccccatatagcatatcttcctctcaatttcatgtctccattgcatatgtatgtatgtatgaatgaatgaatgtatgaatgtatgtatgcatgcatgcatacatgcattatgtatcccatttgagtccaattaatgctacctgtatgtacatgtgtatgggaccatctactgggacatgggcaacccacaagtgaccatacctaaagagaagtagctttcttctccccagcagccaataactgccagtagctcctgagctaacggctcccctcccccatccatgatagacatttaactggcttgatctagtacagataaccagagctgctataagcctgtgtgtgcaatagccaagttggtgcatacagcaggtgggtttgggtgtacagtagccatgccatacgcagaagacataatttcacagctctcctcttcatcctctggctcttacattctctccatgcccacttcctctggtgttccctgaaccttgatggtgggggaggggaggagtcccatctgtggctgagcactcaacagtcactcccctcagccctgagtctctgtattaaccgtagctgctgcagaaagcagctcactaaggccgagaacagcccaaagctctcgggataaacacaaaatatccaggtggtttgacaatgggtaccacagcaaagccagtcttgaaaaaagaaaaggggtctgggctgggagatggctcagtagggaaagtgtctgcccaacaggagtgagaccagccctcgggtcaccatgtatgcatgcatgtttcctataaattcgaacccctgcatcaaggcctacctgtgatcccagtccttgggacttggagacacagggatccctagtgcgagtggctggctgcttgcaagtgcttgcaaggcactgggtcaaagcgtgtgtgcatccacacatgtatggaaacacacacaattatacacatgtatgaaaacacacacaactatacatataatacatatgcaaaaaaggaaataggaaaacaaaggtttcataacataacattttttttcaaatttcaaaaccaaagagtatgtaattcaatgaaacatacaatcttgtttgataagagaacttttttcccccatacagggtttctgggtgtatccctggctgtccttgctctgtagaccaggctggtttcgaacacaagagatctgtctgcctctgccacgtgaatgctgggattcaaggtgtgagctaccactacctggctggaattttattttattttttttaagtacatggaactgcgagctgagcagaaaagtgacaagggccctccgtagagagcagcaggatgaacttctgcagcgagaggtcagtgttgggggaactcaggggtgagcacagagattagcagggaagctggagaagatggatggcaagagctctcagcgaaggccccgtgtagccatgagggcgtcctctgtaaggaaagtgaggcagagtaacagactcagtctcaagaggccaaggcttacttaatgggacaggcgaagggtcccaagctttctgagggatgaaggctgagaaggtaggagaagttaaagtaactccatcaagatggttagaaggtttctattgtagatatgagagcctagccagaggcatctggaagagtccagagtagccatggctacctctgggggagagggaccaggaggggagtagactagccaccagccagagctatctctccatctctctggagcagaggggaaagcggttcggagctaccttgccagagaggagcagctgtggaggcgggaggggaggtgaggagggggtagaggaaggagctggagcagcctgggaactagcaccatttgggcaatgagaagggtcaagatctagtgtgagagagtcatattcacgagatatgtgttactgggagcagaggagcctttgggaaagagcatggtcaatgatatggaaccacagatacagccaaaggcaagggaagttcactcaagtggctctttttgacaggcagaaatctgtttttgaataatgctgccagcaacccttctatagtcactgacataacagtgcagaggggctaggacacacacacacacacacacgcgcacacacacacatacacacacacacacacacacacacacacacacacacacacacgcacacacacacaacttaccaggaagctaaagctacttttgcgatttgactaggagcagggtaggttgtttcttgatacctgggcctgttggttctgcaggtggaacagaatagccaggctgagacaattctttatggccggaggctatcacctaatgtgacctgactccattcctcatgaccggaggccatgagttcccatcgaggtgttctgtcaccacataggcccaaggcagcagggccaggagaccatggtctgaatcactgtcaatataaaccaaactaaatgaagtgtggcttggaccttatttgatatgcttaagtcctaattttattctcacccttacttttcatttggctaaccatagataaagaataaatatataagtggatgctcacagtcatctattgaatggaacacagggcctccaatggaggagctagagaaagtacccaaggaactgaaggggtctgcaaccctataggaggagcagcaatatgacttacccgtaccccctcagctcgtgtctctaactacatatgtagcagaagatggcctagttggccatcattgggaagagagacccttggtcttacgaagattatataccatagtacagggaaatgccagggccaggaatcgggagtggatgggttgggagcagggcagggggagggtatagggactttcggaatagcatttgaaatgtaaatgaagaaaatatctaataaaaaattgtttaaaaaaaagaataaatagggctggtgagctggctcagtggttaagagcgctgactgctcttccaaaggtcctgagttcaaatcccagcaaccacatggtgactcacaaccatccgtaacgaaatctgatgttctcttctggaatgaagacacactacagtgtacttacatataataaataaataaataaataaatattttaaaaattaaaaaataaaaaagaataaatatatatacacatgtaatatattaatctattatgcactaattatataacataaagttgtatactatatatggtatatataatatgtataaattatgtgtaataatatataatatcagcataataaactcagcaattgataatgagtcagttgaacacaaatctcattccctttttttttttttttttttttttttttttttttcggtttttcgagacagggtttctctgtgtagccctggctgtcctggaacacannnnnnnnnnnnnnnnnnnnatgtccacctattgttaaagtttcctgtgtgtggcagatgtgaggcggacgctactgttgctcagagttttaaaagcactctttcacacactttattctttgtctcacagtttctgtgttacactgcagcaagagctggccaaggtaacaaaatttcccatggccttggtcagtaaacctcatactaagcaagaaagcaaacaggagggggaaaaaaaaagatatgcgtatgatacaaaatgcatggcctctctgaagagggaaggagacagcaagggcttattctgttcatacagacacaaggacagttagatgtatttgctgaacatgactcaggggactgttaccaggaatggaaattgtgatacctcctttctcagtcagagatctggcaggacaaaacaaaacagaaaagaattttaaaattagaggcgaatcaaaccaatttttacagctcccagacctgatgccatgattccattcaggcctgctacaactcagcacagagacagcaccaccagtcgacacaaaaacaaagaccagagttttgtcaaagtccatagttatgggaaagcctctatatgtaccaaccttgctttttggctagaagttctgcttctggctagctgtccatgctaactgaaatgtgtcaacccagcatatggtttatgtgcttaaaaactcgtcctgagaaaggccagggactggactactctatgatcctgaactgttaataaagttttttttttgtttgtttgtttgtttgttttttttagcttaaacctttgtctgagcagtcttctctggcagatatcccaaaacgcaataacctgggaatgagaacagactagaaccagcagcattcaaaaatcatagtccaagcctggctgtggtggcacaggcctttaatcccagaatttaagaggcagaagcaggcagatctctgagttagaggctggtctagtcttcagagaaagttccaggatgaccaaggctacacagagaaaccctgtttcaaaaaagccagatagatagatagatagatagatagatagataggccgaccgactgactgataaataaataccatagtctagtcaagtgtagtggctcacaacttgattcccaacacttgggaggcagaggcaaatggatctcttgtgagttccaggccaacttgctctacatagtgagtttcaagacagctagggctatatagtgagacactgccagggtaaaaaaaaaaaaaaaaaaaaaaaaaaaaaaagtccaaagtgccttaagcctgaataaagtctgaatacaaatcgattcaatttgctaggtaaaactgagggaggtttttctaggatccagaaagaggccgctgctgtttcctagcccatggtggccccctgcccttggggtggaggcaaacagccaacactaggctatctaactagagcaccagggttagtgatacttgccagtcaccagggacagggatggaatcttctaaaattgtgctttattcatagagtcagcaatcggagaaggcagcattagatccttaaagggggctggagaggttgctcagtggttaagggcactggctgctctcacagagtactgggattcagttcctagcatccatatctgttctcaaacatccataactccagttccaggtgatctagaacacccagaacttctcctaacctctgctgttgtaaggtaattccaccagagaatacacacagactctctgaaagctgaagagagtctgtgttgctggctggaagctgcttggcgaacttcccaaaatcacccagccccgtcctcacagtttctctctcttatgcaaggatattcaaaccatcacatacatctattgaaaaaaattttaaactaccctctatctcatctccatctagcaaattatatgatgaaatgatccatgcagtcattgattgattgttgagggcttgtgggtatatgagtccatgcatacagggagggagtgtgccatgtgcaagtggaggctaaaagaagatattgggtatcctcatctgcctttctctgcttaatttcttgagacagagtctttctctgaatttagggctctcttttcctcgatagacaggaagcaagaaagcggctggaggtggtaacttatgcctttaatcccaacacttgggaggcagaggcaagctgatctctgcacttgtggaataacccttttgatggcacaccaagttatcacaacctttgaattcaacaaggcattccaaggactgagaaggctcctccaatccctagaaagatctgtccacctttgagatataactaggatccccacacgctggtgtctcccaatgcttgacaggtggagggaggaagggttcaaggccagccttcgaaacaaagtgagtttcttggtcagattagtctgagctgaatgtgaccctgtggcaatatgatgatgataaccaagccctagcaaatggctcagtggtaaagcatttgccatgcaatcttaatgacttgcgtttgataaaaatggaaagagaacagactctacaatgttttgttctttgctttccacaagtgcgctgtgacacacacacaaacacacacacacacacacacaccaaaacaaaataaaacaaaacaagtctgggaaaatggcttagtagttaactgctcttgcagatgacccggtttggatcccagcaccccatgtgtaattccagttccaagggacctgacgcagtctcctaaccttcatgagccatatatgcacttacatacacactcatacacgtaaaataaaagcactcacacacgtaaaataaaaaaataaaaattttaaactaaaattaaaaaaaaaattcaggcgaaacaagattgcaaccagcgcaagggggagcaccttctgcctcttcccgaccccctccccatctcagcttcaccggctccttgaggacaatctctcctgattctgactctctggggcttctaagcagcgttcccagaatccctcgcggcagtcctgggatgaatggagaagacacgcccccagcgcgcgtgcgcactcttggaacctcgcaacccaggacgcaggcgcgtgcgcgccgtccgcttaaatcctgcggtgggcggcgccgtgctcttccgagcactatggagatccagtccgggccgcagcctggcagtcccggccgcgccgagaggctgaacgcgcggctgctggacgagttcgtgtcgctgcacggccctacgctgcgcgcctcgggagtcccagagcgactatggggccgccttctgcacaagctggagcacgaggtacgagatggcacgggctgcgggcaggctatgcggtcgagtggggagcacagctcagcagctctgaaggggagccacttataagttcaggagcaggatgtacctgggagtcagaagggtacaggccgagagatgcgcctgtgccgccatcctgcagggttatgggcccgccgaggatgcgcagggacctgcaaaccggcatgcgcttggctcgcagcatcccaacgcctcggttgatatattaagagtagaactcgcgactccacttacggatgaggaaactgaggctccggcggatgcaggagctcctgttagattcaagctacaccggcatcatttcagtcagctctgtgcagctctgcttagtccgtagaactctgtggagttgtttcccacggcgtgagtagcaggtctccctttgtacactaaagagaatggaggccctgagacatggagacgacgctaagagagggtttagaaggtctcccccatcttttgagagaatggctccatccttcacctgagctaggcttccacggggtgcccggcttcttccgtcggagaacagagtttgggtgatgaagacagcagctgctaggctgggcggagggtcttttgcgaagcaagagcttggtttttcacaggacaccacctcctatctgagacccactaagccttcaggtgactgggagagtccaaaagctaggattccccggtgcctctcaatggggtaggcttaccctctttgatctagttccacactgtgtatgggccagatatttcctggttaagcctatacgtagggctgtactgcagctcactatagcatgctggcggttgggaggcgcctcaatccttagccctgtgggacagtaaaagaggaggagccagccttgtgctagtgttacattgttgatggtcctgggcaataccgtgaggttataactggccgtcagccccagggcaagcagctgtagtgaccggtttggtaggtggagtattaagtgatttctctacttcagtctgattatcagatattactacatcattggtcgaggctcatctgtcagtggcacctccttacagagggttacttactccctgtcactaagttctctgctcacgtggtgttgggccctcctccgcactgctactttctgcagacttgccttgatctcaggccagtgctgaggtagaactggacccccatttattagtgacgataagagggtacccaagatgctgcaagggctgggcttctttgtttgtttgtttgtttgtttttggaatgccctgggaccccactcaggggcactctccctggtcaggtgactccccacctaagctgtctgatttggaaagcaggcatggagaaacaccagcacctggctccctgagggggtgcagaagataatgacaggcgactgcactccaccagtgtcctgtcccttctcacttgggctgctgtggcctagtcagggatacccatttttttttttccccaggccctcctgagccattccagacaaagctgagtcaccacagtgagacctgccacaaggcccagagggaatgcttagcaggactgcgtccctgcctgtagagagccaccctcccccaccaagcaggcaatcagctctggttccttacctcagagggctccacagaaaagactgggggtgttttcacactctctcccactttcaggaacatccactggggtcacctccctaggggtttacagcttgacaggtgggggttggtccctccatgccaaagcagaggaacaaccaagccaggcttcaggttgggcctgcttgtcccccagaagacctggggtgaaaggctgggggtgtggaagacctgaggcctcccctcactcagggatcaagaaagaacttggctgagactctgcactccttctacctaagtaagagctttccccagagcaccagctttcccttatcttctgtttggcctgccggcctccaccctggagtgtggtaaactccctgctccccacacacattttttttttcatagaattatcaagtgtgtgtgcgcgtgagtttatgcatttgtggagatcagaggacaactttcaggagttggttctctcattccaccttgggaaacctgtgaccaaacttaggtcatcaagcttggtcccagggccgttgcctttaccctgtgagcctctcaccatgccaccctcccctgtgcctttctttcctccccaccggtggctagttccctccacactccagaactgcaggcctgaatctttccctctgggtgctccctcctggaggagccaggtctagtccttgctgagctggaagtcccctgaagagcctctttcctccagcctcacaaagcttacctgtgcctgagtaggtagggggtcgttgctgccccagggtgggagaggtctcagggagaactcgcctgtttagtcccgtgttatctgattcctgcagctgtcctgcagggtgggtgaaggaactgagtttcaaatgtgtgatactggagcctggcttggaagagcctttactatatagcccaagccccattctgtgcctgactttgtattggttaaatgtcccagcaaccccagaccttcctgtagtacagatggggaaaccaagtcacagagggtttgagtcatgactttgctacctatataagatgtggcaaattcaagattcaaacctcacaattgggccttagattccagaggtcccccccccccacgctcccccctcttctggctcgtgacaggcctggggtccctacgggatgaaaactgggagagcccgtgggagaagagaaagacttgttgcttctcaggctgtccttgactcccaatcattcctggcctgggagatccaagcccacattttacagttcccggctgccctgagggttgccccagaggccacactttctgctgcacgagtgtgggaaggtacctgtgggctgcctcagctgtcctggtgtcagctgtcctgggatagctctagtaaaaaggaagtcagggtgcgccacccccaccctggaccaactaccatcctgagcccaaatccacctccaatgccatagagccaccctctgcctttgggcctcatttcccttgtaaagcaagggatgtagacatgattctcgagtggataccttttctgcctttgccaacatgtggtgtcttgagaacagtggcctaggagaccctggcataaattacgaatgaccccaagatgtgcctatcgaggcctcagttcttcagttaggtgttgctaagaggctgtttagtaactaggacttgctccttggaggtggagggctcgggagtgcagttccctatccacacccctgattgactgtgctttggctgtaggttttcgatgccggggagatgtttgggataatgcaggtggaggaggtggaggaggctgaggacgaggccgccagggaggctcagaagaagcagcccaaccctgggggcgagctgtgctacaaggtcattgtgaccagtgagagcggcgtccgggctgacgaccccaacaggtaggatcggggtctgggcattggtttttagagaggtttcacctagaccctgtttccctgtgacatgtgtggccagtggtgtccccacaggctttggggctgtttctaacctatgctgttgacaggttcatcgggaccaggaattgaacttgacgccccacaagagcgcatccctgtgacttcacagtgctatagctcctggttttgctaagggcgaccaaacccagggaaggaaggacttgcatggggtcagtaggctaaggatatggctgctgaacccagcaagacctaacagagcctggctttgccgaggacctttgtcccctgtccctgaaccatgctgactcagtcctggagaaggttcccaggaagcaggaagacctgagacctgacacaggcctgcctagtgttacccagagactcagccctttccatctcccagggacctgggtaggcctgtggctctctctgcaagaggctttgttgaagcctaaggaaggaacttcttgagtttccctggcatccctgattccaagcttttatcttccccttccccaggcctaggaagctatagggatcaccccaactgagggtgttaacctataagtgacttaggcactgccccaggtgcttgagtctcactaagctcaatgctgtcctacacctcagcactctacggagtggctggggaaggacccacaaacaaactggacagaacttatctaagtaacctcttctgtgataaaatacaccagccggtcagctaagggaggcagggcttatccttgtaagatacagcccatcatgaagggtggggctgggtgcaggagggtcccccagcaagaacttgaagcaggctgtatgacaggcaggggtgggcacagggggatccagtagcaggaatcggaagtagtctttcctgttatatctgcaacctggaaaccgaacagtgagtgtcttgttggtactcagctggttctctgcactttacacagtccgggaccccctaaccagggaatggttcctccacaaccaagatgtgtcttcccacatcagttaacataatcaatccaggcagcccctcacaggcgtgccatctcccaggtgaccgcgctgaccctcacagagcacaggtggccttttcagtcccttctgccctaaggactttgtccctctgagttattcacatttgccaggccctggaagttctcagtcctctttaccccacacctgcctgggtatgagtattgtcatacttcatggtcaccctctggggtatgtctctgtgtcacacgctgcgttgtgcaggaataaacctgcctttccttcaggatatgcaaacagacaaggaaaataagagcatagtgataaattcctgaacttgaccttgacgaatgaggtcaaggggctatgtgctcagggaaggggctgccttgtcccttggacacctgtgtgtatgggtccccctaattcggcaaagcttgctggggccaggagtagaaggacaggccctgggggctggagagatggctcagcaataaagagcactgactgctcttccaaaggtcttaagttcaaatcccagcaaccacatggtggctcacaaccatccgtaatgaggtctgatcccctcttctggggtttctgaagacagctacagtgtgcttacaaataataaataaataaatctttgggccagagtgagttgggctggagaaagaagaaaaagtgacaacagctgcagtacttatgtataataaataaaataaatcttaaaaaaaaaaaaggacaggcccggcccctctcataggaagttcttggtgcttttaggtcctagggtatgtgactgtgtgtgttgtgcttcagttctgtcacttgcctgctggtatcacaggtgcttccagtctgtagaaccttcaagtggtgaatgcctgtcactgctaagtctgcagtggcagagtggcagcaggagccttcgccctgtaccggcagtcagcgtgaccatatttgttccacgtgatgctcatgtccgtcttggggtgggcagtggggactcccattgtcctgctctagaccttagagagagccacactgagtggggtcagagtagtggccttgggctggagctccatgactgaggtgctggggagagcaagtctcagaggggttgtgtcagagcctgtgtcttctctttccctctgttccttttcctctttcctttcctttttttttttggtttttcaagacagggtttctctgtgtagccctgggtgtcctggaactcactctgtagaccaggctggcctcgaactcagaaatccgcctgcctctgcctcccaagtgctgggttaaaagtgtgcatcaccactgcccagctcccctctccgttcttgccctgattgcttagtgcagtggttctcaacctgtaaatctcgacccctttggggcagggggagggggttggattatcctttcacaggggtcacctaagactaccaggaaacacatatatttacatcacaattcatgacagtagcaaaattacaggtatgaagtagtaacgaaacagttttatgtctgtggtcactatgacgtgagggattgtattaaagggttgccgcagtgttgggaaggttgaaaaccgctggcagtagctcacggatagcttgtgcccgcagcatcttcctcatcgaccatgcctggacgtgccgtgtggagcatgcacgcaaacagctgcagcaggtacctggactcctgcaccggatggccaacctcatgggcatcgagttccatggggaagtgcccagcccagaggttgtggccctagtgctggaggagatgtggaaattcaaccagacctatcagctggcccatggggtgagtagattcactttctctcagtgctggtagaagcccacttggtccctgtgcctttatcagaagtatgtcaccacctggacatggtggtgcacgcctttaatctcagcacttgaggcagaggcaggtagatctctgaatctaaggctaacctggtctacaaagtaagttccaggacagccgagactacacagagactgtcttttaaaaaaattaaaaggatattaccaactataacaccagctagtgtggtggcacacccctttagtcccaatatttgacaggtagagacaggtggatctttgagttggggaccaggatgttctacaaagcaagttccaggacagctaaggctgttacatagagaaaccctgtctcaaaaaaccaaaataatgggggctgatgagatggctcagcgggtaagagcacccgactgctcttccgaaggtcctgagttcaaatcccagcaaccacatggtggctcacaaccatccgtagtgagatctgactccctcttctggggtgtctgaagacagctatggtgtacttacatagaataaataaataaataaatctttttttaaaaaaaaaccaaaataataaaaatatcaatcaaaacaatagttataaccagtcatggaggtcacccctttaatctcagtactcaggaggaagaggctggtagatctctgagttcaaggctaacttagtctctagctagttttaacccagccaggactacatacaagaccttatcttggtacctgggaccaaccaaccaaggctggggagcaaggtactctgcctttgtacttatgggatataagcctccctaagaactctaatcccaggcaccagtgactcagctgccccttctaaacatgttgccctctgtggttcttgccacccttgagagaggacagcagactgctttgattcaccttcaggccttcaccgcccccccacccccaccccctgctcgccaagcttctaggctccctccctctagactctatcccctggccactctcagttggggaaaaccatgctcatttcttctgggctagctccttgagcctccctacctcagcatactaattatgccaccgagggccttatttccacaggcctgggatggttattaggattcggggaacctccaagctcagcagtgggcagagatgagcagtggttgttaggtacatatgtgagagacacagcgggtggatggacacacggctgaacattgctgtattcttcccacagacagccgaagagaaggtgccagtgtggtacatcatggacgagtttggctcgaggatccagcactcagacatgcccagcttcgccactgctcccttcttctacatgccccagcaggtggcatacacgctgctgtggcccctaagggacctagacacaggcggtaagtcgggtgccttgcataccccagaggatgggccgtgggagggccttccatcacccccactgatgggcatgcgtgtcttggcgcagaggaggtgacccgggactttgcctacggagaggcagaccctctgatccggaaatgcatgctgctgccctgggcccccgccgacatgctggacctcagcttctctacgcctgagcctcctgccaagtactaccaggtgtggccctgcgcctgcaaccttgggcctagtgtttggtgctttttggaatgttctctatccatttaccaagtgttaagtgtcagctggattccaggctcaggctagctgctctgggatggaggaggcttaccgtgcaccagctcctgtagccacacagggtggctgtctgtcttggtctagatcccaggtagtctgggtttgggaagaagaggtctgtgcagttagatctggctgtatgcactactctcaccttctaatggtgctccctattctcttctaatggtgctccctcataggggacaagaagacactaattgttcctcggtgtctgtgggggtgagttgtaaggctgaatggatactaaaatctgtgggtactcaggtctctcatgtaaaactctcagcactgcctcagtatccctcgtcttccctggatagtctgtaattctctgtacagtggaggtgtgctgtagacagtcatctggtttgggaatagtgacaagcacacaatccctacagaggactttttccctccccaaaatacttgtgacctactactgttggttgactctgaagcagtagagcctgaggctctgagggccgaccgtattgtacatcgtacagcacagcaggccatcagggagtcctcgctgtcacctggaagcctgtaggtcaggaccctgcagtttcactcagaagtgcctggctgtgatgagttcacacaaaggccttgataccaatcaggaggacagcctctaatatctagagagattacgtagtggtacaagcattgactgcagccacagaagagctttgttcggttcccagcacccaggttaggtggttgacaaccatcaatagctcaagttcatggtatctagcaccctctctggcccccgtgggcattgcacccatgtttccaaatgcatgtgcaggtaaacactcgacacataaatataagtctttaaggggtaggaatgaaaccaggccccttcaagaaaggtctgcctcccttgtcctcaattccatacacacaggagcctatgcctggcacctcatagatgggctgttctatattcacagttgtgttgatggtaagcacactggggtataaagaagtagagatcaaaaccaagggtctgcagtgactcggcagaggctgcacacctcaccctactggtttgagtctaccctggcattgcagacttctgatgcccactgagttgtggaaggttgtagatgggttagacaagttgacatgggtgatagtggaagctctacgaattgcaagagacagacaatccttacttgaaacctgttggcacagaatcatgggtccaggctgtgatctggccttggggtgacctgtgctggtgagaaattgctctagcagcttaggacagtaaatatttattgcctcccacagttttggatggggacaggaactggagacagtgctcagcaagtggttctggttgagggtttcctgggtgcacagattcccccaaagctgaggagtcagagccttcctgaagctgaagtgttcgtatgtagcactcaggggagaggactcagcatctccacacaggtgcctctctgtgggcttctgagtgtccctgagacatggcaggtggcttttattcgagccagtgatccaggagcaagccagagggagttaagcctgtgatctgggctcagatctcgcttcctctctgctgctcatttagaaatagctccttgggtcctgtgatgaactacactctgcctttcaagggagtgtcagagtctggacatgttttaaactgttaaccagtttaggacaggaacagccctcaggggctcccctcagaccaagcggctcctcccagcacaggtttggcaccccttgccacctgtgtctggaagaatgagaacaatgtgtgtcttgttctttgcccagcctggattcttggggatttgagaggcctgagtccagagcatcaggtcaggtagccctgggctgcctcggagagaggcaaggatgtgaggggtggggcctggcgcacaggagaagctcaggatcagttatttgcttcttccttcattgaggtctgtttccgcctctctccgattctaggccattttggaggagaacaaggagaaactgccgctcgccattagcccagtggcacgtccccagggccacgtcttcaggtacatagccctgttctctgctgtcactgagacttgacttctatggctgccattcccaggtcccagaacaagacttttctgggccccaggtcagtggctgtgtcctggagtcttggaacctagccgtgctggcaatgatagcagagcacttcgaatcacagaggagtgtgagaaagcaggcaagactgcctgcaggaggcggctgttaaacttgccctggaaaaattagaaacagccaggctcagtgtcattcctataaatctcaacatgagcgatggaggcagggaggttatcacaagttctcagccatcctgggctacagggtgagaccctatctcaataaaggaaaagggcatctatattgccaggaaaaccagtcccaggagtctgagggtataggcagtgatggggaaaaggcacagctctacctccatgccacggggcctgaatacaaagccatatctacccagtgctgagcagggtttctgcctttccaggggccctccctacaggcccccaggtgccatacctatggctactcaaacttggtacagctagaattgggctgtgtgctccattccgtccaggtctaccaggtcctggggtctgcctccctactgggtcctcctcttgcctgaagccagagccccagccaagcaaagggtgtgtcctgagacacagataagactgcaaaccccacacccacacacacctctattccctctggaacggactagttaggggcccagtaagtcccggttgcagctgtggttcacactcattttagactcaggcaagttaacagcccggtgccagccccatcccagcaggctaggcctccttttgagccctcacactgcagcatccttccaagctgccacctacctcacctttatgctctgagtcctctttgcttcccacttaataacctcagaagtacagccacctctaggccctgtcctcacttctgtgctggctttgaagtatgacctaagacctgtcccagggcacaggagccctgcagattcaggagagtcctctggggggcactagctcgcctcataggctgagatcaagcaggattgggaggttgctggtgtcagcagttttaagcctcttattggagaatgaaataaaagggccagcgagatggctcggccagtaaaggcaactgcctcccgcaagttgtcttctgatctctgtgcacacacacacacatacacacaaatgaatgtaagaagaaagttcacacagatcgtagagtagcagggaaacttattgaaaacaaagagtcagtagaaattagaaaggaatggccccagactagagataacttgtgtcccagttactgtctggggtttccttgtacagggttcaagagaaagttagttcctcggggtataacttgggtggtcttgttgatgattatgttgtcatttgagacagggtttctctctgtagccctggctattcgggaacttgctccatagaccaggctggccttgtattagaggcacacctgcctctgcctctctagtgctgggatgaaggccagcaccactacagctggcttctccgttttcactaagaggcttagatctcttagcccttcactcactgtgagtgtctattcccataatacatctgaccttgatcagatctgttgccaattatgcaggaacgtaagatggtaaataaaggaaggattctccctaaaagtcctctgggggacaggtatggcttattgcccttgcaccctaagccagttcaggccagactgaccctcctccaggatgtagttttgaatagaaactgttcgagtttggtgtcattacggggaggagaaatttgcctcattgtttgttgttcagagtggagtgtgtggagtcccagatactaagctctccctatgcttgcctgactcctacccatccattctcatatgagaaaccagcatctacgaacatctaagccatcctgctgtcctgatggcagatgtgaggcaagctctgtggtcccagctcctatagggaacctgggaatatgaatgtcttcctacagctgggtagaggagatgggtctaggctcagactgccaacaccgagtattccttggggcttgcagacacaggagaggggtgggcagaagcacctgcccgcaattgggccgctgctcactccagtctctccacagagtccactgcgacgtgcagcaggtgctcggccaccttacccaccctcgcttcaccttcactgatagcgaggctgatgccgacatcttcttccacttctcacacttcaaggactacatgtaggtacctcgaagccccgtacagcatacccagtgcctctgatgactgccaccctccccgggatgctaagctgacctctctggccatacctgtctccacccacaggaaactcagccaagagagcccacaggtgctactcaaccagttcccctgtgagaatctgctgactgttaaggactgtctggcctccatcgctcgccgggctgggggtcctgagggtcccccctggctaccccgaaccttcaacctgcgcactgagctgccccagtttgtcagctatttccagcaccgggagaggcggtaagtcccctaggcttcaggcaaggcgaacagatactgctggtcagttccattatagtgctgcagctctgtccccatccttagcccatgcccagcctctccttagctgagcacctaccagcttctcttgttgctagttccaccctgtaaccttcccttaggttccattacactcctaacccaaagacacgggctggccagtctacctctagaacctcaggacacattgtctgaaaggcaggtatggctcaactgtcttcccgtaggggtgaagacaaccactggatctgcaagccctggaacctggcccgcagcctggacactcacgtcaccaacaacctccacagtatcattcggcaccgagagagcacccccaaggtaggcacacagctccccagcctagctgctccagatacaggcagagactctaaggagagtcagctgtgactcggggtcactcagcttgtggagatcaagtcacagcacacagcacacggctcaccgcccatggaacccccaggtctgtggaagtgatcctacagaggcgggacttcctatggctgtttgagacgctgtgtgtgtcagattctcctcagccgtggctacagtgctggttacacattcatggcacgagctgaaggaagtaaactttgagggctgtcagtcatggttggagacttgagacagcaggagggaatggatggaactattgctgagagcccctccttttaaaacctgaaaactagggcccaggagagagctcagccggtaaagaaagtgctcgctttgcaagcatgagaacaggagttcagtcccatacccacgtaaagggggggaggggagccaagcatggccagtctagcctgcttgtcacaccccaggccagtgagagaccctggctttaagaaaactccgagctaacgcccgaggaacggcactcaaaggcggctctggcttacatgtgtgtgcatccccacatgctgaggctcgatggcatgcttttcctttaactagaaagggttggagggatggatcggggttacgaacacttggtgttccagccgaggacccaggtcctgttctcagcatccacatgttggctcatagctgcctgtggcctctgcgtgcctgtgaacgaggacaagcactcttacacataaataaatctttttaaagtacaaaatcggggtgagcataaagaatctgccatgccctagctagagtctgaagtgcaggaggaggagggagcagccatagctggccaaggtggcgtcacatgtggagtccttttgcggacacaggtgaagccatcaggggtctcgctcggcttgcaggagctcccgggtgctctgtcctgacgggtgagctgggagctgctggcaagtccccatctgtcctccaggttgtgtccaagtacatcgaaagtcccgtcttgttcctccgagaagatgtggggaacgtcaagtttgacatccgctacattgtgctgctgcgctcagtgaggccgctgaggttgtttgcttacgatgtgttttggctacgcttctccaatcggtgagtgggtcaggtggaggctgagtgccaagagctggatcgggcaacccctcattccctgtggggcatcccccaccacatcacagagcccacggcttctcaagtgttcagttacgtcattgctgtagtaactgtgacactcctgtatatcagcaaagaatcataatgacatactatgctttacagagtatctccacagtgcatcactttgtcctcactcaaaattcaggctgaggggctgtcccagtccacagacaaggggagcaatgtatcccagccccagcaatgtgtggctgatctccatggggcttgggaacccatgcttgtctgtcctcttgtctcacaggcccttcgccctcgatgacctagacgactatgagaagcatttcaccgtcatgaactatgacccggatgtggtgctgaagcaggtagggcctggtggggcccaagagcaaggttctggctatcacagttgggttttggagaggcagggttctctggccccaagacgagtgcgtggaatgaggtctctatagggggcactgccactcctgccacaggagtacagtgagatctgcatgccagggctaaaggcaacaaggctgacatcaggccagcagtgcgtctaggacaatagggtgcaagccccaggtcctaactctgggcatgggttggaaaggggcgctaggctgttagatttgttacatcaaagtcctctgtcctggctaaggagtgtaagcccataacacctgaccctgtctgacaggagaccaggagagccccatgctgtctcctaccaccccccttcctaaaatgtgtgattttttttttcctctgtgggcacactctagttctttttttttttttttttaatttcagttttttttttcaacatttttgagacgtgggctcatgggacccaggctagccttgaactcccagctctcctgcctcagcctcacaagtggatactgaatgcagaggctggtggacctcacagcaacccatttcccatggctaacggctgtctgaggtgcctctctgtgccccgcccaagcatcttctaagtaggtttgtaagaaaggagctacgacagcagagtggctgtgctgacccagattctccgtggggctaagtggccctgttgcttcttggccctcttacttttgattggattgaaagccaggacccagattacccaccgaggcccctggcatggttggagggcagcccaaggaacgctgagttcttttcttctgcctggtgattgtgttacctgagaagccccttggtacaggaactggtgtcccatgggacatgcacacgggacctctgcaggggcctgtgctggcttatcgttctctgggagaaatctcagcttccttattcagatgttttgataaaatcttggtccagggatcttgtcctgggttgcctgtgagggcccctacagagtgggtctggactctgctgccagtgggctgtgctgagctaggcatggtggccgtgcctgaaaacctcctgagccctgaaccttaagttcccagcttaagccttgcagcagcccagcagtcagtaggctgagcagggagtgctactcttttcatagaagggaaaactgaggctcggaatggtgagtctgcctgcctagagcctaaccttggtctcctagcctcctgagtaccctgaggaccagagctggaccgaatcctgtgctatgggattaatgtcctgctttattctagaggcagttgttgccacggtaactggctctcatctattgcaggtgcactataatgagttcatccctcagtttgagaagcagtacccagagtttccctggagtgatgttcaggtgagtcttgggctctgccaggttggagctatgaaagccacgcccttcctttataggcagggcggggtcatcttcctgctgagacaggcagagatgtctgggctcaggccatcctctcccatgcactctggacctgtgtgtggcaggtctgggggctctttagaatattctaaagaggaagggaagagccgggcggtggtagcgcacgcctttaatcccagcacttgggaggcagaggcaggcagatctctgagttcaaggccagcctggtctacaaagtgagtttcaggacagccagtgctacacagagaaaccctgcctcgggaaaaaaaaaaaaaaaggaggaagggaagaaatttgtagcatcatgaggtagcctaagagcagtaggctccaacaactccaggaatccaatctcattggtaccagggcagggagggtgctgttcttaggacagaaaattggcagatttgctggaggttagagccctgcactggagcatggcttagtgatgggtgtttacctagaatgcttgaagcactgggctccttccttaatacaaagcagaaatggactccaggagggtgaggacaggctgacatggccgtttggccaagcctagagacaaaggatgtaggagggatgatctggtccatcttcaggacagggttcaggcaaggatagtgggccttgttagtcccaaagtcagggttgagaacaccgtgtgacagagcattgcttgtccctaggctgagatcttcaaggccttcacggagctgttccaagtggcatgtgccaagccaccgcccatgggcctctgtgactacccctcatcccgggccatgtatgccattgatctcatgctcaactgggacaaccacccagatggtaagggggctctccacaccagaaccacccaccccggccaccggggcccacaccagcagcacctgggacagccctggctgcggtagggttttgatgtggcttggtttgctttggtttggtttggttgttttatgtatttgagagttcagtatgtgtgtgcgtagaggacccaagaccccctagaactggagtcaggaatggttgtaagccgccttgtggattctaggaactcaatccaggccctctgcaaagacagcaagtgcctttacctactgaactatctctctaacccatgattatcatttcactggataattagccaggtggtccaggttgggtatcctggcctgatccctgaaggaaacacctgcatcagttcagggggaaaggcagccaactagggccaagagaactcacgggactggaaagctggagccaccctgccagccctgcatgccactccctctgaccaaactagccatcgaagcctgaagcaatgtgccctcgtagccccaggggtaggggtagcttcagcctttctttggggagcaggtctcaagctagggaatgtacgttctaggtcacaccctgtgcgcacacactgggaattagggcctaagtctgtacccatcacagtcccagcctgtcctcccaaccctgctaccacagagccttcccaactcttgtttcattatcaggaaagcgggtgatgcagccccaaatcctggaggtgaacttcaaccccgactgcgagcgagcctgcagataccacccctcattcttcaatgatgtcttcagcactttgtttctggacgagactgacaactgccatgtcacccgcatcatctaggtgcccagagttctgcctgttctcatagccagttccagccggttccagccggtccagcctctgctcacagaactgcctttgcagtcccaggcttctccctccctccctctctcccctccttccttcctcagccagagccttggcctaagttatactcaaccctcctgagccgtgttcctgcttcatatgtgggatatcaggtccatgtgtggcagagctggacagtgagtggtgtcccaagggctgggctccgaccagctgtacctggtctctgtacctcttaacgccctctcttctctgaagagtctgcagctcagctaagggcttttctcctggcatccagaaagttcgcagaccaagaaatgttctgcagaaacagggttcgacgagggaagtgtttgggaacccggtatccacaagggccagggagtactctcagaatctctgccctcctgtcccatggctgctgcaagcagggtacgggaaccctgtgttgcacccacaggccccagaacagccaaggggaaacatttgccaacccggccttatgcctcggcatcctccgccagagccttcaccagcagacttctcagccatgcctaccctgggtgtttcccttctgggaagctgggctatgcagagtcccatggtctctgcatgttggtacctcaccaagtcccactgtgctcttgtggtagacagggtgctaggttgctctagggctgtgacatttcatggcagaatccaagcaggagtggctgtggaaatgccagagcggctaagatggctctggagagaacttcatgtgggaatcaggctgcctcttgccaaagttcagagtcctagtgttaaggttttgggtttggttttccttcaacctgcaggaaagacaatgttacgtggagttcctaattttgttgctggaatttgaagtcagccaccattgcttctgtaactgctgggcgctgggatcctgcccccaggaagttagagtgggcaggagctccttccagatgtcctactgttcgggtgggacactgtggtggctgttgtacttgtgaaggtaaaagtgaccttctcttagcatgactggacatggttcttcctgctcatctctgggcttgtaggccacctgttagggagcctgcccccgccaccatcagggtcagggtagagacacttgtggtggtcgcacccctggaaagcggctggcatctgcccttttatactgcagtaaaatacgcctcctttccacctggtcttttctctttggggccctagaggcctgggctgggctggcagggcggctgtgtccctccaaggttgcaagcagacccaacatgtcaccacgtgtgctttgagaaatgagaaggaaaagaaagacctccgagctccctaaggcagtctagcttcctagttagagtcccagttccaagctggagaagagatctgacctgaccagtccacactaccaacccaagggggcgttgggggccgcagggtctgaggcttggtcccacctggtggccttgagaaatagcattctctatgttacctccttgttctggagtggggatgagaggccataattcatgaggtagtcaagaggctctgggggctggcagaggaccagcaagacagctcaccgagtaaaaatgcctgctgccaagcctgaagacttccctgggagctacaggagagagaaccaactcccacgggttgtcctctgacctccatgtgtataccatgggacatgtgactggacaggcatgtacacacaaaaatataatttaaaagtcttctaaagaagtcaggtacttcacatgcaccagctggcccagcatcaggcttggccaccagccagttgtagagacagtggttatacctctgacaaatcctcctggtattcatccacaccctggtcgctctctccacttaaggggtcatcaaaggccagcacgtgctcaaggtgggcatgtgcagcaggctggagagcctaggtagccacagcggtgttgctgaagaaggaagtaggcagctgagctctgtaggccctggcctggccgcctgggagatgccagtggctgaccacaaactcaagtgtttctagcaccctctaatcctaaatcaacatggcttccatgctgacagttggctggggtaaaagtttaaggcctgtgctgtgggaataagcacaagccagagaccagtctaaaccagtaggccaagtgcccttctcattaaaggctgcagaaagccattgtcatctgagctggtgacagcatagaagagaaggtgcctccagtggtgggcaagggaagcacatttgtaggtggcgcgtgacccccatttcagatcactagggagttgctggagcgctatgaagagcactgccaagaagcccttcccaagtcttgggtgcactacccatcaaaatgtccaacatggttgcctgtgatacctgatgggtcatttgtgccctgtatacccatgaggcctatggaagcaggctgaagcaggtgaaagggtgctggaatttaccctcttcctgccagttgggtcaccctaggtggagaacctgggtggtaccagcccagacaggcccagcctcagcagcagaaccatcctgcttagctgccacccaccatctgcctgtccaacaggccagatgttccactaagtacagagtctgttacacatgaagttagagactttatttagctttaaaacaccatgctctaagggcatgcctggagcagtgcagaaaggcaggtataactgtgtctgcaggagactcggcactgaccaccctaacctacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagagcccgtgtggctggcttccttcctgggaaccctgcccttagaggtttgccagccttacgccccacagtagtacctctttccctcttgccatggctttgaaggagaaagtgctctcatgacagctatgcgccaggggtggggggatggggggcattctctgtgtctgggaagttcttaaacaggaccaaccaatgtttcagagtccatcaagtctcccattatagtgtggtggctgtcccaaagacataccataaggacaggatctagggacaggacactggaccccaggtttctactcccaccctctagccgccctggaaggcaagactatctttatgctctgcttcactaaggggatcaaagggagggccccctatttccatccgaagtcacaaaacaggacagtcaccaccccacttgaaaccgaaggagaaagttgggccagggaccttccagggacttcttggagactgcccagttcctgagtcacccacacagaggggtggtagacaggcaggggtggggcccataaagctgagtcacccctcggctagactgagctgggcaggagatcagctcagggtggaatcccaggatagtatagagtgcaggacggagatactcagaggggcaaagccgcccactcaccctttatttctgtctcttctagaagacatgtaacatcctaagcttcaccctgtcaccagcttgctcagggtccttggggtgttccaggaaggaaggacagaacaccaagacctccctggaaaactccacccagggttgtgactatcagttcagggaccactcagctgcttcctctaggggaggaggagatggctaccttttcatttccagagagcatcttggacagaagaataagcactagacagaggagagtatggtagtaggccttctcgacggtcacctccccaggacctcagggacggagccaagccttactcaaaggcactcactcactcagtcaaaccttcatgtactcctcacagcagccacagggcaggggtcagccacctctctttgatccacagtacccagaaagggtttattgctagtgtcaccttccaggtaaagaaactgatatggggctggagagatggctcaggggttaagagcactgactgctcttccagatgtcctgagttcaaatcccagcaaccatacagtggctcacaaccatctgtaatgagatcggatatcctcttctggtgtttgaagacagctacagtgtacttacatataataaataaataaannnnnnnnnnnnnnnnnnnnctgagttgagaaccccgagtcggtatgtggttacagaatgaaggctggagggggaggggacaaataagtggcagcttggtcattgcaggctgttggggccatgagacaacagctgccgagggcttctgggaatggaccacaccagggcctggtgctgtacaccaggagattgtggctgcctggcatttgacttggcacacgctgctgttgtccacgctgacctttatacatgggacagcctcagtagttggagcccaggcagggatccaagaggcaagcaggaaaaagttcagtcttgcaacacataggttgtcagcctcaccaccctctccttctcagtgggcaatgatgctactctgtctgtgagtcaaagcccagcctgattccaggggcaacagagcacagcacggtggcacctacaactacctaccccatggctgaatacagtgtgccccagatgggagccagtgtccagcgaggcggatgccaagagggtttctgcaagctagcataccaccggaggccctcgccacgtacaaagtaggctcccatgaagccccccaggctgggcaccagagtgaggcccacggcaggcacccaggattcaggcatggtgattgcaactgatgttctggaaagatctgaaaaagaacacagggtaggggtgagggcagttctacaaaaccttgggggtcaacccatcactgccttcagcacctctagggtcctgttccccaggaacaaccagcccacttattcctggtgggtgaggaaggagagtggagtccccattccactcacacttgtgcccctgcccagaggtgccaccagggctctacccaccttcttcctacttctgcttcaagcatctgttctgtcacctcaccctcgatctgtggtctcctggtgtgacctctactcactgcgcctctgttaggaaggctctcagttctgcttgacctcaggtcaagggtcactcggggatgctgggaggtctgtgcattgtgtttaagtgcttcagtccatcattcattcacacccttggtgattggcaattggcaaagcttggcttcctcaaatcttcccacactagtctaccataacctcagagaagtcacttcaatcctgtttccatctatgcacaaaattgacgctgcctactttagtgtccccagggggcagcatagagtattttgatcctcaggtggtgtctacctcagaggccaaacccatgcaccagaggacagcctgcccagagttccccagcactctaggtcaggctctgccctaatcacaaagtttcacacacatgaacactcaggaaaacaatcaagactgggtcccagccctctttctgtttcttacgggtggtctcaggccctttgcagccaatctctgggctgaaatcaagacccaaggagcttgagaatggggagccctggtgtagaagtccagggacagctctgcctctgcttgctataggagtgcaaagccagtcagtaccctgactgggactcagtttctccatcaaaaaatcgttcccactaacatgcatactgttagtaactggagaatcagggtgtccgcttgcattgttgaagacccctgggaaaatggctcagtatggtaaagcatttgctatgcagactgtgaaaatcggagtttggatccccccccccccaaaacaatccatatgaatgctggttgggtgtggtaatccacctgtcattccagcactgtgcagagacaggatcctcagagctaagccagctaaactagcggcaattggcaaactctgggtgcaacattctacaccactcaataaaggggacatctgatggaagccagaggtccatgccagtacaccaacatgtgcatcacacacacagagacagacacacatatacagagacacacacagaggcacacccacagacacacacaaacgcgaaggaatgaaacaaacttctacatacaattttatgggctggagatgcagctcagtggtaggtagacagagggcttcattaacaagaccctgaaatcagtctacattaccaccacgaaaacaatcccacttcctgtagtggtttgaaggagactgtcccccataggctcagtgatttgaatatttggttcctgattggtggtgctgtttgggtaggcgtatgaggtgtggcctctatcactggaggcgggcgttgaaagccaaaagccctgcctccttcagtttggtttctttgtttcacgcttatgtttgaagatgtgagctctcagagtcctgctccttgcagcatacctgctcttagccacacctgcccgctgcccgctgccgcgcctgcccaccatggtggactcttatccctctaatctctcccttctataacttgccttggttctggtgttttatcaaaataacacaaaagtagctaatactgtgctcaagaccaggggagtcccacacactccctccaagctccagaagactcatttctttgtttataaagtgcttggcatgcccgtgttctgcgatatacagctagctagcctggaagagaacttttttcttattcgttttttccttttttttcttgttggtcctgagaacactgagcctaagcctcgtgcataccaagcaagcgttctaccactgagttgcaagcccagatctctctccttttcttttttttttttaagatttatttatttattatatataagtacactgtagctgtcttcagacaccccagaagagggcatcaggtttcattacaggtggttgtgagccaccatgtggttactggggatttgaactcaggaccttcggaagggcagtcagtgctcttacccactgagccatctcaccagcccctcccagatctctttttactttttgttttgagacaagttcttgataagtgtcctaattagattgttgttgttgttaacttaatgcctccgtcagaagactgactgtaggcaagtctgaggccttcgtctgatccatgattgatgtgggagagcctagtccactgtgagtggcaccactcccgaggagatggaggtcctgggttgtatacgaaagcaggctgagcaagggaacaacccagcaagcagcacccacccatggcctctgcatcagctcctgcctccaggttcctaccctgacttccctcagtgatggactgtaatctgtaccctacataagccctttccttcaccagttgctttggtcacagtgctgtatcacagccatggacagcaaactagaatagtaagtaacgaggccggccttaaactcactctctagcccacagaccttgaactttagaacatcctgcgtaaggcatccagtcatggcttagaggacatttttaatgagttgaaaactgttttcaccatggacttttttggagggcaggagtggagacagagtttctccgatcagacctggctgtcctggaactcactctgtagaccaggctggccttgaactcagatccacctgcctctgcctcccgggtgctgggattaaagttatgcaccaacaccacccagctgttttcaacataaccttaagaccgaccaaaacatttactttcttggggagggggttggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcatcttggacagaagaataaggactagacagaggagagtatggtagtaggccttctcgatggtcaccaccccagggcctcagtaaaggagccaagccttactcaaaggcactcactcactcagtcaaaccttcatgtactccccacagcagccacagggcaggggtcagccacctctctttgatccacagtccccagaaagggtttattgctagtgtcaccttccaggtaaagaaactgatatggggctggagagatggctcaggggttaagagcactgactgctcttccagatgtcctgagttcaaatcccagcaaccatacagtggctcacaaccatctgtaatgagatcggatgccctcttctggtgtttgaagacagctaacagtgtacttacatataataaataaataaatctttaaaaaaaaaagaaggaaagaaaggaaagaaagaaagaaagaaagaaagaaactgatggggaaactgtagaacattccaggttggtatctctacatccacaatgacactcggccactctcggtcaccttcccttgggatacaatgccctgggcaaggatcaggtcc

SEQ ID NO: 1424 - DNA, 3505 bp, Mus musculus
ataaaaaaataaaaattttaaactaaaattaaaaaaaaaattcaggcgaaacaagattgcaaccagcgcaagggggagcaccttctgcctcttcccgaccccctccccatctcagcttcaccggctccttgaggacaatctctcctgattctgactctctggggcttctaagcagcgttcccagaatccctcgcggcagtcctgggatgaatggagaagacacgcccccagcgcgcgtgcgcactcttggaacctcgcaacccaggacgcaggcgcgtgcgcgccgtccgcttaaatcctgcggtgggcggcgccgtgctcttccgagcactatggagatccagtccgggccgcagcctggcagtcccggccgcgccgagaggctgaacgcgcggctgctggacgagttcgtgtcgctgcacggccctacgctgcgcgcctcgggagtcccagagcgactatggggccgccttctgcacaagctggagcacgaggttttcgatgccggggagatgtttgggataatgcaggtggaggaggtggaggaggctgaggacgaggccgccagggaggctcagaagaagcagcccaaccctgggggcgagctgtgctacaaggtcattgtgaccagtgagagcggcgtccgggctgacgaccccaacagcatcttcctcatcgaccatgcctggacgtgccgtgtggagcatgcacgcaaacagctgcagcaggtacctggactcctgcaccggatggccaacctcatgggcatcgagttccatggggaagtgcccagcccagaggttgtggccctagtgctggaggagatgtggaaattcaaccagacctatcagctggcccatgggacagccgaagagaaggtgccagtgtggtacatcatggacgagtttggctcgaggatccagcactcagacatgcccagcttcgccactgctcccttcttctacatgccccagcaggtggcatacacgctgctgtggcccctaagggacctagacacaggcgaggaggtgacccgggactttgcctacggagaggcagaccctctgatccggaaatgcatgctgctgccctgggcccccgccgacatgctggacctcagcttctctacgcctgagcctcctgccaagtactaccaggccattttggaggagaacaaggagaaactgccgctcgccattagcccagtggcacgtccccagggccacgtcttcagagtccactgcgacgtgcagcaggtgctcggccaccttacccaccctcgcttcaccttcactgatagcgaggctgatgccgacatcttcttccacttctcacacttcaaggactacatgaaactcagccaagagagcccacaggtgctactcaaccagttcccctgtgagaatctgctgactgttaaggactgtctggcctccatcgctcgccgggctgggggtcctgagggtcccccctggctaccccgaaccttcaacctgcgcactgagctgccccagtttgtcagctatttccagcaccgggagaggcggggtgaagacaaccactggatctgcaagccctggaacctggcccgcagcctggacactcacgtcaccaacaacctccacagtatcattcggcaccgagagagcacccccaaggttgtgtccaagtacatcgaaagtcccgtcttgttcctccgagaagatgtggggaacgtcaagtttgacatccgctacattgtgctgctgcgctcagtgaggccgctgaggttgtttgcttacgatgtgttttggctacgcttctccaatcggcccttcgccctcgatgacctagacgactatgagaagcatttcaccgtcatgaactatgacccggatgtggtgctgaagcaggtgcactataatgagttcatccctcagtttgagaagcagtacccagagtttccctggagtgatgttcaggctgagatcttcaaggccttcacggagctgttccaagtggcatgtgccaagccaccgcccatgggcctctgtgactacccctcatcccgggccatgtatgccattgatctcatgctcaactgggacaaccacccagatggaaagcgggtgatgcagccccaaatcctggaggtgaacttcaaccccgactgcgagcgagcctgcagataccacccctcattcttcaatgatgtcttcagcactttgtttctggacgagactgacaactgccatgtcacccgcatcatctaggtgcccagagttctgcctgttctcatagccagttccagccggttccagccggtccagcctctgctcacagaactgcctttgcagtcccaggcttctccctccctccctctctcccctccttccttcctcagccagagccttggcctaagttatactcaaccctcctgagccgtgttcctgcttcatatgtgggatatcaggtccatgtgtggcagagctggacagtgagtggtgtcccaagggctgggctccgaccagctgtacctggtctctgtacctcttaacgccctctcttctctgaagagtctgcagctcagctaagggcttttctcctggcatccagaaagttcgcagaccaagaaatgttctgcagaaacagggttcgacgagggaagtgtttgggaacccggtatccacaagggccagggagtactctcagaatctctgccctcctgtcccatggctgctgcaagcagggtacgggaaccctgtgttgcacccacaggccccagaacagccaaggggaaacatttgccaacccggccttatgcctcggcatcctccgccagagccttcaccagcagacttctcagccatgcctaccctgggtgtttcccttctgggaagctgggctatgcagagtcccatggtctctgcatgttggtacctcaccaagtcccactgtgctcttgtggtagacagggtgctaggttgctctagggctgtgacatttcatggcagaatccaagcaggagtggctgtggaaatgccagagcggctaagatggctctggagagaacttcatgtgggaatcaggctgcctcttgccaaagttcagagtcctagtgttaaggttttgggtttggttttccttcaacctgcaggaaagacaatgttacgtggagttcctaattttgttgctggaatttgaagtcagccaccattgcttctgtaactgctgggcgctgggatcctgcccccaggaagttagagtgggcaggagctccttccagatgtcctactgttcgggtgggacactgtggtggctgttgtacttgtgaaggtaaaagtgaccttctcttagcatgactggacatggttcttcctgctcatctctgggcttgtaggccacctgttagggagcctgcccccgccaccatcagggtcagggtagagacacttgtggtggtcgcacccctggaaagcggctggcatctgcccttttatactgcagtaaaatacgcctcctttcc

SEQ ID NO: 1425 - protein, 739 aa, Mus musculus
KKNSGETRLQPAQGGAPSASSRPPPHLSFTGSLRTISPDSDSLGLLSSVPRIPRGSPGMNGEDTPPARVRTLGTSQPRTQARARRPLKSCGGRRRALPSTMEIQSGPQPGSPGRAERLNARLLDEFVSLHGPTLRASGVPERLWGRLLHKLEHEVFDAGEMFGIMQVEEVEEAEDEAAREAQKKQPNPGGELCYKVIVTSESGVRADDPNSIFLIDHAWTCRVEHARKQLQQVPGLLHRMANLMGIEFHGEVPSPEVVALVLEEMWKFNQTYQLAHGTAEEKVPVWYIMDEFGSRIQHSDMPSFATAPFFYMPQQVAYTLLWPLRDLDTGEEVTRDFAYGEADPLIRKCMLLPWAPADMLDLSFSTPEPPAKYYQAILEENKEKLPLAISPVARPQGHVFRVHCDVQQVLGHLTHPRFTFTDSEADADIFFHFSHFKDYMKLSQESPQVLLNQFPCENLLTVKDCLASIARRAGGPEGPPWLPRTFNLRTELPQFVSYFQHRERRGEDNHWICKPWNLARSLDTHVTNNLHSIIRHRESTPKVVSKYIESPVLFLREDVGNVKFDIRYIVLLRSVRPLRLFAYDVFWLRFSNRPFALDDLDDYEKHFTVMNYDPDVVLKQVHYNEFIPQFEKQYPEFPWSDVQAEIFKAFTELFQVACAKPPPMGLCDYPSSRAMYAIDLMLNWDNHPDGKRVMQPQILEVNFNPDCERACRYHPSFFNDVFSTLFLDETDNCHVTRII

SEQ ID NO: 1426 - DNA, 40491 bp, Homo sapiens
aataaagcagcgaggtggagatctacgtacagacgcagggggcgcccacatttagggaacagacatgcttctaactggcagaaggcaaaatgtccatatttcaaatcccatttccccgcataactcatgatgaaatgagagttttgtttttgtttttttttttttcagacaagagtctcactgttgcccaggctagagtagtggcgtgatctcggctcactgcaagctccgcctcctgagctcacgccattctccttcctcagcctcccgggtagctgggactacaggcgcccgccaccacgcctggctaattttttgtatttttagtagagacggggtttctccgtgttagccaggatggtctcgatctctgacctcgtgatccgcccgcctcagcctcccaaagttctgggattacaggcgtgagccaccgtgtccggccaagagttgttctttgacactggggctttaatctggaagtcatggtcacagtgagcctcagggaatctatgactcattgaaattcggcacgcaatgctgtgtgtgtgtgtgtgtgtgtgtgtgtgtgtgtgtgtacacatgcatgtacagatacacatttctatttctctgggaatatggcccacagctttcctcaggttctaaaagaaatctagggtcaggtgcagtggctcacacctataatcccagcactttgggaagccaaagcaggaggattgcatgtgtccaggagttcgagaccagcctgggcaacatggcaagactcccccatctctacaaaaaatgaaaaataaaaaataaaaactgacaaaagatatatacatgcatttcgcagaagaagaaacaggacagccaattaccatttgaaaaggtgctcaatctcattaataataatggaaatacaggctgctctgcctaggagtagccatgcttttgtttctttacttctctaataaacttgctttcacacacacacaaatggaaatataaattgagacaacaaaaatatgccatgttagcactaggttggcaaaaaaacaataataagtgtgataaaatcagaatcagagaggatatggatcaacttactgtatacaaatagggaatctcttttttacatatatgttccaggaaatatacaaaactattcatagcctcatgtttattagagcaaaaagcttaagataacctaagtctcttcgtggaaaactgcatcatagtcacgtaattaaatattatgtagctatgacaattaattaacatcctgcaacaaaagggatatatcttaaaagcaacatgtgcaggaacaagaccaggatgcgtgcctgcaccgctctgctggaggtctagccaggacaattaggcaggaaaaaaatataaacagcatccagattggaacggaaacaaaattatccatttcacatgtcctgatcttctatatggaagatacttaaggaatccacaaataattactagagctgatgaaattcacaaggttacagaacataagatcaatatataaaaatcagttgtacggtgggcacagtggctcacccctgtaatcccagcactttgggaggccaaggtgggtggagagcctgagctcaggagttcaagaccaaccagtgcaacatggagaagccttgtctctaccaaaaatacaaaaaattagccaggcatggtggcacgcacctgtggtcgtagctactcggtaggccgaggtgagaggatcgcttgagcctaggaggcagaggttgcagtgagccgagatccagccactgcactccaccctgggtgacaaagtaagaccccatctcaaaaaaagagaaaagaaattaaagaagatctgtactcttggattggaagacagtattgtcaagatgacagtactccccaaattggtctagagattcagtgcaatccccatcaacatccaggctggcttcgtgcacaaactgacatgcgaatcctaaaattcatatagaaatgcaagagacccatagtagccaaacagtcttgaaaaagaacaaaattggaggattcacgcttctcatttttaaaacttactacaagcttacattaatcaagattttgtggtactagcagaaggacagacctacagatcaatggaatagaattcagagtccagaaatgaacccttaaatttatcatccatcagttggttttcaacgagagtgccaaaaccatttaatggggaaaaaatagtctcttcaacaaatggtactaggacaactggatatctacatgcaaaagaaaggaagttggacccctacctcctatacaaaaaatcaactcaaagtgatcaacgactgaaatgtaacagctaaaactataaaactcttagaaactaagacagataaataagtctttggaatcttgaattaggcaatggcttcttttttttttaacttcaatttttgtatttccgttaagttttgggggaacaggtggtgtttggttacatgaataagttctttagtggtgatttctgaaaccttggtgcacccatcacctgagcagtacaccctctacccaggcaatgccttcttaaatgtaacacacaaataataaggcaccaaagaaaaaatatataaattggacttcaccaaaattgaaaacttgtacttcaaagggctctgtgaagaaagtgaaaagataacagaataggaaaaaaacctttacaaatcacatatctgataagactccagtatccaggatatgtaaagaactcttacaactcaacaataagacaaataacctaatttaaaaatgaacaggcggccaggcatggtggctcacacctgtaatcccagcactttgggaggccgaggcgggcggatcacgaggtcaggagatcaagaccatcttggctaacacagtgaaaccctgtctctactaaaaatacaaaaaactagccgggtgtggaggcaggcgcctgtagtcccagctactcgggaggctgaggcaggagaatggtgtgaatccaggaggtggaggttgcagtgagccgagatcgggccactgcactccagcctgggtaacagagcaagactccgtctcaaaaaaaaaaaaaaagaaaagaaaaaaaaaaaagaacaggctgggagcagtggctgtaatcccagcattttgggaggccaaggaaggcgaatcacctgaggtcaggagtttgagaccagcctgaccaacatgatgaaaccgcatgtctactaaaaatacaaaaaattaaccaggcgtggtggcatgcacctgtaatcccagctacataggaagctgaggcaggagaatcacttgaacccaggaggaggaggttgcagtgagccaatatcacaccattgcactccaacctgggtgacaagagggaaactacgtctcaaaaaaacaacaacaaaaaacaaaagaacaaagaaggccaggcacagaggctcatgcctgtaatcccagcattttgggaggccaagataagaggatcacttgaggccaggagttcaagaccagcctgggcaacaaagcaagaccctgtctctatatcaacaacaaaaaaatggacaaagaggctgggcacagtggctcacacctgtaatccagcactctggcaagccaaggccagcatatcgcttgaggtcaggaattcaagaccggcctggccaaaatggtgaaaccccatctctactaaaaatacaaaatttagccgtgggcacctgtaatcccagctactagggaggctgaggcaagagaatcacttgaactcaggaggcagaggttgcagtgagccgagatcacgccactgcactccagcctgggcgacagagaaagactctgtctcaaaaaaaaaaggacaaagaatgtgaataaacatttctcctaaaaagatatgcaattggccaataagcacatgaaaagatgattgacatcattagtcattagggaaaatacaaatgaaaactgtaagataccacttcacaaccactagaactataatcaagagtcagggaataacaagtgctggcaggaaaactagaaccctcggccaggcacaacggctcatgcttatcctaatattttgggaggcgaaggcaggaggatcaggtgaggtcaataatttgagaccagcctgggcaactagcgaaacctcatctctattaaaaataaaacttaaaaaattagccatggcccaggcacagtggctcacacctgtaatcccagcactttgggaggtcgacacctgtggatcacttgaggccaggagttcaagaccagccttcacaacatgacgaaacccagtctctacaaaaaatacaaaaattagccagacgtggtggcatatgcctgtaatcccagatacttgggaggctgaggcaggagaattgcttgaatccaggtggcagaggttgcagtgaaccaagatcgcaccactgcactccagcctgggcaacagagcgagacaccatctcaaaaaaaaaaaaaaaaaaaaaaatatatatatatatatgtatatatatatatacatgtatatatatacacacatatatatatacacgtatatatatatactcatatatatatatacttaccagtttataaaaaacagttgaatccaaattatttttctgacaaaatggggtaagattaaactttaagaatttttaaaatacgccaccttataaaggttgtgagccaaattttgggtaacacagcctaagtcagttaccaatatactgtgttggacaaagaatagttaactgtgaaaacatgactgcattatgtgatgaggcccaaaagataggagtgactctaaccagtctttacagtattcttttggactcaattttttgtccttgaagaaaagagtgttgccctttcttttagtataaggaggaagtctttccatgagaatttcatcttttccttttaagaaacagcatgaagttcataatgattttctttttgtatctcctggttgtcaagtgtttttacttaaatagtcagtattccagaatagccatttagaggataaaaaggaggaattgtaaggattggggaggctccagaaaggaacagtttcagctagctttgactcagtgttttgtaggaaggcaatctttgagtcctgaatggacttgttttttagcctcaaggtatcaatgagaaatgcatacttagagtgtatgattttataaccatggtcttttaatttaaagaataaactgaatgatccctataatgtttgaatatattactagctggagtcctagaaaatttggcatgcctttgaactttgagacctcattttaactaaatatatctaggtgactgagattggttttttccctttttttttttttttttagtggcttatccagcaagtaaggtgatttagtttaatgttgagtacacaaaggccaaagaaacacaaacagacagaaaatataagtatgtactcaccaggaagaataatagtcatcttcaaatgaggggaaaaaaatcccctcatccaaacctcaagatccagacctcacagctgagatcaacaggaggaaaataaccctccccaacagcagatatcccacacaggacagggaaagtcacctccccagccatttcccaaataagagagaactcaaaccaaattcaggagttctgtccaagagagacttaccaggtgggagaagaggtgactcacaaaggtagaagggtgtcagagggccccagtgtgagattctccccaaagtggttcagtgcttggtcccactgctgacaccatgtatgtcaaaatcaaaaatgtagagacagctctgtaaacttaatgtgtgtagttttttgtttttttgtttgtttttttgagacagggcttcactgtgttgctcaggctggaatgcagtgacacagtcatggctcactgcagcctcaacctccagggctccagcaatcctcccgcctcagcctcccgaatatctgggactacaggcacccacgaccatacctggctaatttttgtattttttgtacagatggggtttcactgtgttgctcaggctgatctcaaactcctgggctcaaccaatctgcccaccttgacctcccaaagtgttgggattacaggcatgaactaccatgcctggcctaaatgtaatgttttatttgtgaagaaggaactgccattcagggtgcacctacagaccaggtggtctttgctttgtccgaagaacaaagagaaggttagaagttttatttaaaacagagaaatgggccaggcacagttgctcatgcctacaatcccagtgctctgggctaaggcagaaggatcacttgaggccaggagtttgagaccagcctaagcaacacaatgagacccctgtctccacagaaaacttaaaaattagccaggcatagtggcacatgcttgtagtcctagctactcaggaggctgaggtgggaggattgcttgagcccaggagttcaaggctgcagtgagctatgattgcgtcactggccactgcactctagcctgggcaacaaagtgagacccttcctcaaaaagaaaaaaaagaagaagaaatgttacatattgctctttgagaaagttcactggtacttgtaagggtttggggagttagtaagctcagcttggtgagccttattagtcctagagttgcagtcagttatctcagaagttatcaataaatggttttaggttaccacaagcagtttcagcagtcgggcttacagagaattacattttgggaacaatgccttgcaccccaaatgctttttccctcttggcttctcaactctgttttaattatgacaagaatgacccaattttttttttttttttttttttttttgtgagttggagtctcactctgtggcccaggctggagtgcagtggtacgatctcggctcactgaaacctctgccaccagggatcaagcaattctcctgcctcagccttccaagtagctggggttacaggcaccgcaccaaggctaatttttgtagttttagcagagacgggggtttcaccatcttggccaggctggtcttgaactcctgacctagtgatctacccacctcggcctcccaaagtgctgagattacaggggtgagcaaccacgcctggtgacccaattcttatgatcaactttcacaaagtcattgtattgggtttaggctccatgttgtatgaaaaacccattttgtatgagtacccttggcaaagctctcagaacaaaaagctatcagggaccaaaggtcaacctgggcttggattttcaggatggaagggccttttttatttttagacggagtttcccccaggctggagtgagttgatgcgatcttggctcactgcaacctccatacccccacccctgggttcaagcaattctcctgcctcagcctcctgagtagctgggattgtaggtgcccaccaccatgctcggctaaattttgtatttttagtagagatggggtttcaccatgttggtcaacctggtttcgaactcctgatctcaggtgatccacccgccttggcctcccaaagtgctaggattacaggcatgagccactgtgcccggctatggaagggacttttaaactctttttttttttccctctttctctctctcctttttttcaattgtctggagggggagggggttggtggcagtaatgggagcagagcagtaattttatgttgattaaatacacattcttcagtgcctctttagaagacaacatttcagctgagaagaatgagtcaggatttacaaagtgagcatggggagaaaggctttctggcagaagacagagcacaatgctttccaggagctgaagacaaccagagatacagggactcacagtgtgaggggaagagtgtaatgaaaagaggctggaaaagttggcagtgccagctcacacagagccttggagctcaggtgaagagttgaaccacaaagggttccaagtagggatctgatacaactgggtttacatttggggaggagcatgtgaaagaggactgccctgtcagagcctcacattctcctggtcaaaggggctgggtcaggaatgttcacataatctgaccagtacctgacacaactgagactcagtctgtcttccccagcgggaccgatggaagggttgtggaagcgggaggtgcactaggtgtgtaccactatacctggctaattaaaaatttctttttgtagggtcgaggtcttgctttgttgcccagcctggtctcaaactccttatttcaagtgatcctcctgtcttggcctcccaaagtgctggaattacaggtgtgagccagcatgccccatcctagcattgtgatgctgttttactatattatttattttgagatggagtctcgctatgttgaccaggttggagtgcaatggtacaatctcagccttggcttccacaacaaaaaccgaggaatcagggttttcctctggccatggtgaaaccctgtctctactgaatacaaaaaattagccaggcgtggtggcacacacctgtagccccagctacttgggaggctgaggcaggagaatcacttgaacccgggaggcagaggttgcagtgaaccgagactgcaccattgcactccagcctgggcaacaagagcaaaactccatcccaaaataaataaataaataaaatgtttttctctgcagccctcaccaacttgagtttggaaatttttgcctttgcagacccacctgcttcctacaatggaattgaacaagtccgtgaattggtgcattttattcaaactcagttcaaaaatgttatcaaaatagcatctgaagctccaaaaaattttcagcctttgttttttagcaaattacaattcttacaaaattgcaaaaaggaagacattgaaatgtatccctatggagcaataaaactcaatgagagttcaaaagagaatgtcttttgaaattctataactgaactgttttcttttaaagagggagtctggctatgttgccgaggctggacttgaattcttgggctcaagctatcctcccgcctcagcctcccgagtaactgggactacagacgcggccaccacgcccagctcaactgcacttcgaaacatcccgacatgtaggagtaaattcctctgacgggtacacttggtcttaattggatcaactgacattccgaatccaaatataagtaattgagaagggccacgattttgcagcatccaaatctggtgaaacgctcacaagaatcgagagctcccaaggcagggggcctgcgagctctgtgtgcccggtgcaggcacagaagcgccgcctcaccgggttcgggccccaggacaccttccgggccgtcggtggggccttttccggtcctgacagcgccctatacgtaggcaccccgccctcccggcattccccggggtcgccgcgcgctgagcgagaaaagctcagccaccatcaggtgcgcgtgcgcacacggcggcagccaaaccacaggcgcggtcgcagacgcgcgccccctcctggcaagctcgcgcgctctcgcacgcaccccgccgatgcgcagggcctgcccgggggccgcggcaaaccgggctggaggcggactgggggcggggcgggacggggtgagggggcgagaagagggcggggcaggggaggggtcgggggggccgggaggaggacggggcggtggggaggggggcagggggcgggggcagggggcgcggcaggggcggggggctggggggaggacggggcggtgggcggggggctgggaggaggacggggcgggggtgctgggaggcgggcggggcggggggcggaggcggggggggctgggaggagggcggggcgggggggggctgggaggagggcggggcgggggggggctgggaggagggcggggcgggggggggggcgctgggaggagggcggggcggggcagggggcggaggcgggagggcagggccgacggacggcgggcggcggcggcggtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggtgcggggaagggcggcgggcacgtgcggcggccggggtgggagcgcggcgggagcccgcggcgcgggacagggaagagcgctcccgggcggcgggagccgcggtgagccacccagagcgcgtcctgggcagctctggagcggcgtggagttgggggccgaagagtgacagcaggagaccggggtacctgcggccctgatctgcccgggcccgagaccggctgagggctgcgttgggaactttaggtcctccacacacccgagcctgacacagccctgcgaggagtgaaactcatcacccccacttcacagatgagaacactgcggctccgagagtcccttcagagggattctttcagccgctgcctcacagggacaacgggaaccccgtgaatttgtgtagctgtaactgttgggttcacagaattcggtgttttttcatttgatttgagcctcggggtcccctcatcttgcaggttaaagaaaacaggctgtgagaggtggaggagaaatctaaagaaaaatggaaaagattgagaagcctctaggttctctccctttttgtgaggacggcccatccggctcacctgcctcctccactccaaagcgttccccactgtcctggctggggatgagccctggatttttattgcgtgcccagaggctgaggccacagcaccttcccgggctggcgggggggggggtgttttctttagctgggacccgacatctcctccaggtgctgtctcccggacggagatgagcctagtggcgcaggtgatgaagtggaaaccccagagccaagaacagggacccgggccgggaactaggagtccctgagcctggctgctggccagactctacggtctctgagccagtttttctctgtgtaatcctgattggactaggaaccttcctgctggaaacgtgcagtgagtggcacctccttatgctacagtgtaacagagagtttcctctgcccctcacttctgccatatgctttccgaggaccactctggtcccaggcctgtgctgggtggaagggaccttggtttgttcatgaggacaaaaaggttcccatgggctgcgtggaaggagcacagtgggaatgaccagctcctgcccagccagcctccacggcagcacgccctccctcgggcggtcactcgcccgtctgagacctgttctccatctgggaaggggatggtgagacaccatctggctcccacagtattggaaggatgggaggtggcatgagaaatatgcctggcacacagagggtggtcgccaccgtgccacgtcccctgcccaggccgccttgcctgctgttgccctactaaggggcagccagtgtttttccgtgacccttccccagccgttaaggacagagctgaatcactgctttaccattcacaaacttgcagctcttcctgagtgaagcctcctgctgctgctggcccaggtgtggaggaggccgccagcagcagcagcacctgccagcgctgtgggcccttacacccctggccatcagccctcctgcctcaccttaggccggctgccctggaaaggatggggaaacttgaagatacatacatatatatatatatatatatatatatatatatatatatatatatatatatataatttttttctttttttaattgagacggagtcttgctctgtcacacaggctggagtgcagtggcatgatctcggctcactgcaagctctgcctcccgggttcaaatgattctcctgcctcagcctcccgagtagctgggattacagacgtgcgccaccacacccagctaatttttgtatttttagtagagatggggcttcaccatgttggtcaggctgatctcgaattcctgacctcgtgatccgcccgctttggcctcccgaagtgttgggattacagacgtgagccgccacggccggccgaagagatgtttttaaaatgtctactcttctgtctgcacaagcttcccagttgcaaaaccactccccttatctcctggggagctcttccagtcctgccatgaaggggttgtggtgaaggagaaacccagcaccccatttcacagctgggttgaatccaggccaggcttgagacaggctctctgaccctcagcctcacgctgtcccctagggatttggagtactggggcggaagcccgaggtctggattccagccctctgagcctccccccagccctaaactggagaaggcagtagcctccccagacccaccttgagggctaaaggagaactggatggctcttgtctcaggtgccttgtctctcatgtgacccctggtttgctccaccctgggctatctgcctccaggccttcgctcttactcttccctctgcgtggagttcctttccatcctcaccccgtagcctcatgtttaaatcttccccttcttcaaagctggcctctggttatggttcctcatccataaagtcttcccaggccctccaggccccagagcaatttacctgatactcttaggtggcctagaccttactcagcctgagcttcctgagcgagaccttgagtgattcatcctcacgccaccaaagggcaagtcctgcccagtgcacaaaagctgcctgcacctgagtacttagctagtttccaactgccgtttttaatcgagtagtgggaaatacgttttagggaggaactggcctttgttgagcctccactgtgcgccaggactttatgcacgctgtttgatttcattccatcagtgtcctgaaaggtggatgacaccccctctcacaagtgaagaaacagtctcagaagtgtaacaatggcgccacatgtttatagagcatttgctgtggccaggctccactctgagttctgggtatgaatcacctaatcctcccagtagccctcagagggaggttctgttattcccattgtgtggatgaggaaacacgcatgggatagttaagtaacttgttcaaggtcacttgtctaggaagtggtgaaaccaagatttgaacccacacagcctggctccagaatctgcccagaagccccccttgccggcttgtggcagacagggcgtgagtgtggctgtgccagggacccctctgctccacacacaccagaagaggtcacttgcctgcttgactagccgcacaaggcaggaccaaggcccttatctccccgtcccaccttgacctggggcctcgcttcctgttggcctggattgggtggggctgggctggaggaggcttctctgtgagttgactcagctgtcctagtgttgaggggttcttctggtgaggggggcattggggtgtgcccccagccaccaagatcctgactcttccattgacctccagtgtaattggagccaccctctctgcctttggggcctctctttctgtgtaatgtgagtggggtggactacagatacctccagcaagtcctcaaggtcccatctccatgcacagcatcctgtgggacgaggctctggatgacagctcaggtgacggtggggtacattaggtccctgttccgagcctgaaatctccaggagcttcagtctccccgcccgtaagactgtgtggttgcattaaacaggtcccacacctctgaaggagacaagtttgtccttgaggcctgggtgtggcacctcgggtggctttctggagtggtgaaggcattggggtggggtctcctgcccacacccctgctgacgggaactctggcccccaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacaggtaggagcctggccagagacaccaccacaaccttcacttggtgaaaggtgggagatgcagtaatgcagattctcctgggccctgcaccgccgctggacatcttccttaggacagctttgtggcaagcacgtgtggccagcggtgtgtccatcagggcttcagagtactgtccgtggcaacacagcgttcctggggtgaccggatggaccgcggcctgagagcctctcccagcggtctcattgtcacagtggtcctgctacaggggattagaagttccagttttgctcgaggtcaccctccaggttaagggtgcaggtcagccttactcctccccagtcacagcccctctctggtcctgctaaattggaatctggggtgggccctggaacacctgaggacctgagacccagagcaggcctggccttgccaaggaccacggtgtagttagggcagagctgagactgtaccccaggcttcctgcccccagggaccaagagtggctatccctaggtcaggcctgcaggcccatctgccaaaggttttgtggaccctcagagaaacttgctgggcccctgtgtccacgcacagctctttgggcaggggtctggtctcttctgcagagcttctcccgcctcctcctccagctgggagtgggcagtagcaagccaccccggaaatacggacagcccagcacccccgcccatgcgtgcttgggctcaccgtccccttcaggttcagtgaagtgagttctcctgtgcggctcaggcccaggaacaggtgaattcagtgcagtggctgccctgggagctcccagctcatgttctctctcgggcctacaaccacataccccgctgccagccttgttttgggtggtggggaggctagggatccagagtcttggatttggagcctgagtgtttgtttcagccccacctgcttccgggcctttctgcttccgggccttcgtccccctgagtctcccctgattgccaggccctaacaagctctccatcctcatccccatagctatctttgtacaacaccccttgttgcacttgcccagggtcaccccgaaggcctggctctgccctgcatcacgtggtcacccactctaacacaagtgcaagagtaaacccacttattttaggacaggccaacaaaactcatataagcacaataagataaatactcctgaacttgccccccagcctaagaactggaacactggctgtccctttcattttaaaaggggaacagagacgggggcaagctgggggcggctttgtctattaggcacctgtgtgtttggtgcctcctgatccggcagagctctgggaggattatggtcagccctgtgtcctacagggtagggacagttgatcctgtgccacagccccagcatgcttctgtagcagctcagctgcaggggtcctgtgtgtggggactggaagcctctcccacacaaaggccttggtgcttccagaagacctggctgcgtgggtgaggcctgtgtggtagcccttgtgccgtctgtgtgcgttggcctctggcgtgtagggcctttgcttttgttgagcagctgtggtgtgccaggcctgcaggccacaagatgggcagcatgggcctgccctgcagtggcccgaggtccagttgaggacttcacgctagtgactgctggtgtgtttattacaagtgcttggtggacagtaggtgtaccacatatctggtctcatttgctgcttgtgacagccaggtgacaggcggtagagacccctgctgccctgtttgagaagcttgaagaggaggaggtgcttgctcaggatcacacagggagtgagcagcagcgccagcacctgacccaggcccactggagtccaaaactaggcataactatggcacccagtagaccaaatctaaggaagcttgggccctggtcccaacacagccctgggcctcttgctcccccgacttccctttgccccatgcccacccggcagcctcacattgtggcctgtgcccgcagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatggggtgagtgggtagctgggccccggggagggggaggacaggcatgggcacagacctccgctgccctgtgccatcaggccgggtgaggggccggccagagcaagcaactcactttctcctgtggcttcctaaggagagtgctatcctggggactcggacccagctggcctctgagctcacaggacgcagccctctcagactcctaaactgaaggggcccagatgactcagccgcctctttcctggcccccctgattctgtcactctcttaaaagccctcaaccgttcctcacccacccctgctggcctctccggggactcaccccatgctccagcccctcaccactcttagtttgggaaaagacacctgcttgtttctcatgattttagcttagatgtcatctcctccagggacccttccctgagctcaaagacgactcccccgacccccccattaccctcaaacccatatacacccctacgggtgctgggctgcgtgccttgttaccaaacgcccttttaccacgagtgttcacgctgtgttacccaggcctgtgtcctggtctgcaaaggcagggctgctgtcccggagcccctagcttagctaaagggcctggggtacatgtgagagggcctccaagatcagagaaatggctgtgggctggtggtcgatgtctgggttccggaagggagttccggtgggtggatgggtgagcgagaggtgccatatgtgctctgtctgcagacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcggtaagtccagcacctgcccgccctggaggaggggcctcagcccagtgtcccgtcaccccctctgatgggcacgcatgtcttggcacagaggaggtgacccgagactttgcctacggagagacggaccccctgatccggaagtgcatgctgctgccctgggcccccaccgacatgctggacctcagctcttgcacacccgagccgcccgccgagcactaccaggtgcagccctcctccacccaccaggcctgtctgcttggtagcttccagaatgttctctgtgcacacaccaaatgttatcaaaccccagccgggtgccaggccctgagccagttaccgtgggaggcatagagttttgggagcctctgagagacgaggggctcagagagtgaacacaagctgcctgtggctgcacggtgggggctccagatcccagggtgcctggtgctggcatccgtcctcagggggtccacgctgctcccttgggaaggagggggctgtgcagttggtcttggccatgagccccactcagccccctgtcctcatctcaccgaggcatggaaacaccctgtgttcacacatcgcgtgcctccctccctctgcaggcctgcgagttaccatcatggtcactgttattgataacaaaggtgctttcagtcttggtcagggccccgagggacccagctggcccactcggtagtgcctggctggaggtaagagctcatccaggccccatacaaggaggctggcgggttagggagtcggagttgtcgaggccccagtgccgggggaggaagaggagcctgtgggagcgtagccacctccagaaccagtcagggctgggtaggaggttcctaccctgacccatctctcctccttcccctcctctcccatctgctgctgcttccgtaggctggaaccagcctacaagggagcctgtgcttagtactttgtgggcgtgtgccactcagttccttacaattttacagttctgtttttatcttcattttactgaggatgaggacattgagacacagagaggttaagtcatttgccaggggtcacacagcagggggaagagctggagtccagctgaggctgcaggcttgcccccacggcgactgaagtcatcctttttgcacaccaggcgctcactaagtgcctcggagggtttcgggaagggttagacgagttgacccatgtgagagtgggcgcgtggaggctgggcgtgggggctcatgcctgtaatcccagcactttgggaggctgaggcgggcggatcacaagatcaggagatcgagaccatcctggccaacacggtgaaaccccatctctactaaaaatataaaaaattagctgggcgtggtggcgggcacctgtagtcccagctactcgggaggctgaggcaggagaatggtgtgaacccaggaggcggagcttgcagtgagccgagatcgcgccactgcactccagcctgagaaacagagcgagactccgtctcaaaaaaaaaaaaaaaatagagcgggcgtgtgtggagtggtggcgtgtttgtgtgggcgctgctgattgcaggggtgggctgtgggtgggggggcctcctttcactttcggtctaagtcagtggtgattgaaccaaccatgccaaaaacaaggggctcagtcttgttggttcaaagggtgcttacaagcctcccagagcccctgcaccaggaaggtgcttagtacacgtttgtctgaaaaagtgaatgccttcgtggatgcaactggagggacaaacacttcctggtctcgggtttgtttgttaatggaacatgaactaaagtttgtgtttttccttgggaagctctgggctgaccaggaagaggaggagatacaaggccacgcatccttgttttttcccatttgaccctttacaatcaggtctgtgctctgggcccagggttgcctatgttgattagctatggctgggtaacaagtaactccaaaacttagcaccttaaaacagtaaacatttattatctcacacgatttctgtgggacaggagttcaggagtggctcaacggggtgcctctggcctcaagtctcccttgaggtacacaggccgcccgtcgggctgtggacccgcttctgcatggcatatgtgcatgcctgctgtgttggtgctgactgttggcagcaggcctgggctccctgccttgtgggcctctccataagagtgctcaggtgtcctcaggatgtggcacctgatttctcccagagcaagtgatccgagggagagagcagagaggaagcctcaggcttcatggccttgttgcagaagcaaccctgtcccttccacctttttcctgctcattagaagcaactcattaggcccatcccaccctcagagatggatgcggctctgcctttggaagatagtgtcaaagagtttgtaggcatgttttaatcttttttttattattattttttaaaaaagatagggtcttgcttttgtccaggctagagtacagtggcatgatcctagctaactgccatttccaattcctgggctcaggcaatcctcctgcctcagcctcccgagtagctgggattccaggcaactgctaccaagccccgctaattattcaacttttctgtagagacggggtctcactatgttgcccaggctggtcctacacacctgggctcaggtactcctccacctcagcttcccaaagtgcagggattactggcttgagccaccatgtgcagccacgtgggcatgttttaaatcatcacactgcagaagctcccgacagccctcgtggctcctaggacaaagcggctcctctcaggaggggtttggcaccttctcgccccctgcgattttgaggtagcaccgagaagatgtgcaacaatgtttaccttgttcttttgacaccaaactaggactgttcggcatccgaggggcctggagccccagaatcctggggtgaggggggtggttagaggctttggggtgttgggagggaggagcagccatgcgccccttgaggccatagaacctgatgccaggtggtgaggcttgtgtcccctccttcttttccttttttttttttttttttttttttgagatgtagtctcacactctctcccaggctggagtgcagtggcgcaatctcggctcactacaacctccgcctcccgggttcaagcgattctcctgcctcagcctcccgagtagctggaattacaggcacgcgccaccatgcctggctaatttttatattcttagtagagtggggattttgccatgttggccaggctggtctcgagctcctgacatcacgtgatccacctgcctcaccctctcaaagtgctgggattatggacatgagccaccacggccggcctttccctcccttccttgacctcatctctacttccggtgtgtttccttttaggccattctggaggaaaacaaggagaagctgccacttgacatcaaccccgtggtgcacccccacggccacatcttcaagtgcgtagcccccccccactgcttgggctgggacttgtccgcagtccccgcctcccatgcttcgtggttcccacagccccagaacagtgcttggcacgtggcacgcagcaagtcagccgcatcctgtctgggcacagcagtgacacgtgcagggagtggagttcttgggaccccagagaaaatgccgcagaaagtgagagagcgagcagggctttctggagatttttttttttttgagacagagtctgtctctgtcacccaggctggagtgcagtggcacgatctaagctcactgcaacctccacctcccaggtttcacacctcacctatgaggccaggcatagtggttcatgcctgtaatcccagcactttgggaggccaaaccaggcagatcgcctgagatcgggagttcaacaccagcctggccagcatggtgaaagcccgtctctactaaaaatacaaaaaaaaaaaaaaaaaaaattagtagggcatggtggctggcgcctgtaatcacagctactcgggaggccaaggaggaagaagaatcacttgaaacctgggaggcagagcctgcagtgaactgagatcgggccactgcactccagcctgggctacagagcaagactccttaaaaaaaaataaaataaattcatctttgaaagttaaaaataggaataggccatggaaatgctggcagtgagtgggtaaagggccccctgggcagaagcgttggccaccactggtccccatcccacccctgtcctctgggcaccaaggggtcctgttaccaaccttgcatgtcatggggctgctccgcttacctggatacgatgctcatccagtcctggaaaccgacactagccaggcctgtgcatgccagccctccccacagcagggagcctttgctggccaggaacatgctgggcacccacaacaggcacccgggctgccagtaggggcccctcccaggaggctgcaggtgtggctgttgagttaaggaaagccaggccggcaggtccaggcgggacaccttgcagaagcaggcacaggtgaggacccagagatgcagagcagattccacctcagccttcacaggagcccctccctgaggctcccagacactccccttggctgcccaaacctggtctagccaagaacaggcaggctgctccactctgccccctccaccgggcctgagggctttcctccctgctggcctctgccccagctgggcagcccaggggctcttgctgagacgtgagtcttgtggtgacctggccagggcctaaggtccctccacctcctctggggcagaggcctcacggaggcccttggtgtgcctgtctgagattggtggccccagcctcatcctcttgttttgcatgtgagaggaaagaactagcacataataaacacccaaattatgccatttaattttaatgacaaatgtgaggtggacggtgtggtccagtcctgcggatggggaaccaggggtcacaagggtacaggttgcgcccctccctcagcagattggagggagcggggtctgaacccgggctgtccagcatcatgactcgaacccaggacttgcctctgcctcattagcttcaaaacagggaagggagtccctgagccagggctagtgctggagtcccgcttggacacttgggagccgggatcacccagctcgggctctccccacagggtctacacggacgtgcagcaggtggccagcagcctcacccacccgcgcttcaccctcacccagagtgaggcggacgccgacatcctcttcaacttctcacacttcaaggactacaggtgagggcacctctggccgcaggggccctcccagtcagggcttctaggcactgccggcctccccttgagctggcgcacctgcctccgccctgcaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggtaagtcccagacacggcatcggtgtgctccatggcccttttccccggcccagcgtctgtgtccgcctgctcctccatgagcacccactgtggaaaccgtggtgcaggagccgagctgtgggccccgaacgtcacggccgtcttcacggaccgcaggacctctccaggtttttgctggggctgtcctctccaccgcagcgcagctgcctggcctctggcaaacccctccttgtttcccatgcccctgcctctgacagctctctggtgccccctcagctcccaaggagaagtgggctgccctcttctgcctctgggtcctggggtggcaccatctgggaacacaggccccaggcgccccccagacagcccttctgctccccaggggcgaggacaaccactggatctgcaagccctggaacctggcgcgcagcctggacacccacgtcaccaagagcctgcacagcatcatccggcaccgagagagcacccccaaggtgggccccgcagaccaggagccccagggctcagggccctggctggacagtgagaggtggggctaaggggaccgagcatcatggtccttatggacaggtccaggctgggcagggtggcttacacctgtaatctcagcactctgggaagtggaggaggatcacttgagcccagaagtttggaaccaacctgagcaacatagggagacctcgtttctacaagggaaaaaactttaaaaattatctgggcatgttggcacacacctgtagtcccagcttctcaggaggctaaggcaggaggatcacttgagcccgggaggttgaggctgcagtgagctgtgatcgcgtcactgcactccgccctgggcgacagagcaagacccagtctttaaaaaaagaactgtcctgggtgcgtctaatcgcaaagttcctaccacatagtgtgccaggtatggctgcccagcagggtgaggtggctgagcctggacaaggagcctctcagagccgtggtaaagattcatagtgaggggacatccagaagcagtattgggattgcaggacacaggatctgcctggactgtgtacatagtcagaggctggcgggaaatgcatcatgaggacgattgtcgtggagacttcaggccatgggatgggggtggatggaattatgggtgagaatttatatttcatttcaattaaaaatggatataaagactttgcttcagggtgcggtggctcacacctgtaatcccagcactttgggaggccaaggtgggcggatcacctgaggtcaagagttcgaaaccagcctggccaacatggagaaaccccttctctactaaaaatacagaaattagctgggggtggtggcgggcacctgtaatcccagctactcaggaggctgaggcaggagaatcgcttgaacccgggaggcagaggttgcagtgagccaacattgtgccaccgcactccagcttgggcaacagaacaaaactctgtctcaaaaaaaaaaaaaagactttgcagcaacttaggcaggtttgaaaaggcagaaggaggagtaaagtgcagccatgtctgtgccccctgcgtggctttgtgtgctcgggagccccagggggctctgtcctggccaccagcgagcttgcacctgtgtcctccaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccggtaagtggagggccggctgggtccagggtcggggagctgggtgaccgggtggaggtagcgggtgggtgatgggccctttttggaatcagaaaatgttgttggaaggcaccctccatcactcacccagctagcggcccttggagcccatctcccttggtgttaattggcggtgacttgccctgcccacctcagagttctggtgttgcccacagtaatggatgtgaacattctttgtaaaatgggcaccaacatgagaaccaggtgccatttttatggacctgcagaggcttcacagctagcacctcactcacctccaccccagctcagtggggctgtggggctcccccagccacacagacaagggaacaggctcccgcctgagcagcaggtggtcctgccctgagccctgaacccctagttgggaaggctgagtgggtggcacctccctcgcagggacaaggccgctcaagaacccatatgtgtctgcacacttgtcttccagggcctttgcactcaacgacctggatgactacgagaagcacttcacggtcatgaactatgacccggatgtggtgctgaagcaggtagggcctgagggaggtgcagagcaggttcacacagaggccagggcacacccgaccccaccccgcccacactgcctcctaggaggactggcacacaggccagtcccaggagccgcctcctgagttcctgctatggaaggcgattgttagcgctgccatcatgagccaggctgggttctgtgttgtctcaggtaggtctccccacggcacagagggccactggctgtgtttgagataatgtggacacagagggggatgggtccagcagcaggttgagacagtgtgttcccagccggggcttactcctcaccaccacttcaaccggaaaagcagaccaccctgtgagtgccagggcaggcgggggcggggaggccccacctggtccggctggctgctggcccgtgaccctgcccgggtctaggacctcctgtcctccctggtgcacagtgttgagcggtgccccatgcagtgggcactcagtgaatggcagctgcaccatctgagcacctggagctcaggggcatctggacaaaggcccttccaaggtgggggcgagaaaccagagctggccagccagtgtacgtggacaggtaggcacagcctgcacagaagcaggaggccagctctgggtacaggaaggaagaaaggaagtcctggaaggcctctgtggcctggctggttaatgagtgtttcagatgcacagaacacctaccccaccctgcctgtcgccagccttgcaggtgccgcggactccccatgcagccagccccaacgctccccgacccctgaacgtgtggctgtcattcccaggcatgtctttggttcttttcagcaggagtatgttcctgaccattcaagctgctgttttgcttacttaggttttttgttttgttttgtttttttgagagacaatgtctcacgctgtcacccaggctggagtgcggaggcatgatctgggctcactgcaacctcaatctcctgggcccaagccatccttctgcctcagccccctaaagtagctgggactacgggcacgtgcctccacgcccggctaatttttttgtatttttagtagagacggggtttcgccatgttgcccaggcttgtctgaaactcctggactcaagcgctccgcctgcctcagcctcctaaagtgctgggattacaggcgtgagccaccatgcccggcctcctacttaggtttttatgtaaatatcatcttattcaacggatccttctgcagcttgctttgttggctgagtggcgtgttttgaggttttgaggttcgggcttgttgctaactgtggcggcgattggtcatctgaggtcttcactaatgataaatcatggcgcgtgaacatgcgtggaggcacctggccatgcccatgtccgaggagtcctctaggaggacttggagaaagggccctgccatgcactggtgactataccagcacacactccccacaggggccgagtggtcctgttgcttctgtctgtcttatccttgcctgtgttgaagcctactccctaggacccagaccccccagcagggccccaggacattgttggaagtcgccctcaggttctgagcccctcccttctgtactgtgggggtcatcccgggagtcctctcctggagctctgtgcctggggaggtacgtccagcatggcatggatggcgggcttccataggggcctttcctggcttgttcttttctgggagaaacctgagccgactgccaccttcctcgggtgtgttttgggtaaagtcttgaggccagaaagatcttgcatccctcaagcactcttgagctggtgctgaaccagggcacaggcaggtcccgcggcggagtcttgagctctgcctccttcgcactgtactgagctgagtgtgaggatggtgccagcccaggccctgcagtttctggagccctcgatgttcattgtctcgcgtgagcctcacagctgcgtggcaaagtcagtttactgggcagagcacattttcccatttcacagaggaggaaacaggctcagagaagttaatccgttggtccagagtcacacagtaagacctggagcccagactccatctcctgcctcctgtttggaccctgagggttcggggttggctgcctgctcctggaacccccacccagtgtcagaagctcctggtccaggcagtagcaggctgcctgctcccggcccagcggaggcctgtacagagcgtgatgggccctgtgtctgttgcaggtgcactgtgaagagttcatccccgagtttgagaagcaatacccagaatttccctggacggacgtccaggtaattcctgtcctgcacaccatcgcaggccggtggggcgggtcccgggctgggggcctgcaggagctgctcccttccctctctgctggcatgggctgggagggacctttgtcccctgcagttggtcattctccccagaggctggcaagacagcgtgggctcccctcccttccaccctgggcatttgtgggtgctcctgagagggagggagctggaggggcatgtggggcacccctgggacagccagagggtggcggcactgcctgaccctagattcccagtcatatggagacgttggctgggcctccatgtccagcagcggcattctgggtgctgtgttgagctccttggggcagtggggagcaacggggtctgcggcaggagatgggcagatttgcagaaggtgggcgtcaggagtaagagggcaggtgctgggcggaggtggccatggtgaggtctagagacgtgaagatgtgggagggggtgacttgggccacgtggggcccgggacttgggcaggggcagcagaccccctcttgagaggctgttctgagcaggcctcgtaactcaggctccccggtccccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggtaagaggggctccccatctcctgatccaaaccagcaggcgccccctccgccagccagccacagcctggagaaggcaggcagctgccccaggctgtcctctggcttgaatcagccaggaatctgggttggggaaagccctggcttggcccacaggaagtgcctgcggtgcagagtctggaggggaaaggctgcgggttgggcctctgagtcgggggagagctcacaggacaggagacccgtgtgaaaggcaccctgaccccaacccacaccaccctggctggccttccctgtgccagacccccacacagtacactgctgctgcatatctacttttttttttttttactaaactgaacatccaagcttaaagggccaggctgtcatccctagggctggaggcagccctggcctctcctagagaagcagatgtcaggccaggcctccccagcaaagtcaagagacccaagttctaggcccggccttgtcctgctcatcccctgggaatcagggcccaggttcatggcctcccagcctttgctggatccccaggccactgtccctgcagagtggaggccaacgagccttcacactctgctgcgctctttgccatcaggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggctttgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctcttatttctgccctcctttctctttggaccctggagccacaggctcagcctggcctgtcgccccggctgtcactgaaaagccccggataccaagaagtcacccacaaaaagtgggagaagaaataagatggcctttatatcgcaggcctccaccccacagtctgatttccatgtgctggatctgtttccaagtcggccgggagcctcggtcctcgagtggccccgcagctctagtggccctggagatagcggcctccccacacttgcctccttgtcctggggtggggacggtgagaaaccctggctgctggggcgtctgcagggcccctcgggccactgctgagcaggtgcatggacaccgtcagtgggtggaagcagcgccacatggtgaccaaggaggttaagactcagaaggcaggccaggcatggtggctcatgcctataatcccagcattttgggaggccgaggcaggacagagaacaggtcacacaaagtcaagagatcgagacagacagcatgataaaaccctgtctctactaaaaatacaaaaaaaaaaaaacaaaaaaacattagccgggtatggtggtgcgcgcctgtagtcccagctactcaggaggctgagacaggagaaacgcttgaacccaggaggcggaggttgcagtgagccaagatcacaccactgcactccagcctgacgacagagtgagactccgtctcaaaaaaaaaaaaaaaaaaaaaaagcggaaggcagagcggccctgaggcaggctgcctgtggactgtgctgcttctctccttagcctcccttccagggcaggtctcaggactgatgctcacacggactctgtccagaagcttaacagctggtgctctcactggttcccagctcacttaaaacctggtgcccaggagatagtcctgcccagggagcagctgggacagcccccagaatcaagaccacatggtccaggctttccatgattgtagatggctattctctgtccccacatgtccttgcacctctgctcactgcaaatggacacccccaaggaaggccaagagccagggacttcatgagccggaagaccagccggctccaggtgctgaggcagttgccgggagatgtttatcccactaaatacttcttcctggtactcatttgcaccctcatcactgtgttaagaagccatccaaagccggaattgaccaggcacagtggctcacgcctgtaatcccagcactgtgggaggctgaggcgagcggatcacttgaggtcaggagttggagaccaggctgcccaatgtgttgaaatcccatcctactaaaaatacaaaaattagccaggcatggtggtacacacctgtaatcccagctactctggaagctgaggcaggagaatcacttgaacctgggaggcagaggttgcagtgagccaagatggcgtcactgcactccagcctgggcgatagagcaagactgtctcaaaaaaaaataataaataaacccactcagaaagcatcaaaaccttaagttcccagtggatgacagcagcttagaaaaggagagaatgctgtctgttacgagcatttcctggggaaacgtcgccaggctgttaaaaggaagccggcagacgaaatgctaaatgcgttctcctctcgcccatttttccagggcgttttgtggcagtgcgtgttttgtggccagcaggagctatgtgggacatttgttacagatgaacaaccccacgagttgcggagatggcagaagtctgggttgcactttctccaatccctaagtgtctggcacggactcaggtgtcccttgacacttcaaaggatacccctgtgccctgcggggacggtgcatgctcaccggcatgctggagcaggagacagcctggcctgtaagtttcttgctagcaaggacctctctgccatccgctgcttggactgtctgcacagagctctggaggaattcaactctgggcgtcttggagaacttcagaaataagttaataaaaaggatacacagaggctccccagctggctcctctgcaccggtgagcatcgggaaagccatgagggctgagggctcagctgagtgcccgtggccgcagagtttttggatcctgcagagcgtgatctgttgggcatcaaactctgccagagtcaagggagcgggaggctgagggtcagggtggagtagctcagcccctgggcgggagccatcccttctgtcagaagaatgcagtcgactgtctacccatttccctgagctgttcgttctttcgtgtgtttgtgtgtgtgtgtgtgtgtgtgtgtgtgtgtgttgtgcgtgcaccagagtggatggtatagacaagagtctccctatgttgcccaggctggtctcaaacacctggcctcaagcaatcctcccgcctcagcctcccaaagtgctgggattacaggtgtgagccactgtgtccaagcttttgtgaacgtcaggttgtgtctgagcgtacaggtcgggagaggacacaggagcagggggagaaaagaggaagcagcagccgcgggctgttgagtgatgacgagctgtctatgaacattttgccaatttgaatgaacttagctgccaaaaacaaaaaacaaaaagcccggcaggtcaggcctggccgaggggagggagccgcgggctgtgttgctgagtgctgcatgggtgtggtgaccgagagcaagacggaggagtgctgcgtatgggactcggctcatttactccaaacagctgcctggagaggccatgggtcacccagttcgaagccggggtgagggagtgagtggctgtgacacctccaatcctggccgctctgggccagcaaggaggccctgtctgctggagtcgggacctaacctttcctgcctctgactccccctcgagccaactgggtgtttgcggggctatccctggtgcagtgaggctgccataagcctgggcccccgggggacagggcagtcagcacccccaactctgtcctgggtaaaagcagctgagggccacgcactgggcaggaccaggcgtcgaacagtggttgtgggcccggccattaaagggcccgggctgagcatcccggaagccatgggaagcggacaggaccccctccctctgctgaagcccacggccccagctgggtctgcgccagtgtgggccccagggtggcacccagggctgctctgttcatctcctgcagggcttcgggagcgtcccaggaagcgtggggcagccccagctggatccagccctgtctggagaaggcagcccaggcagatcctgcagagacgagctccagtgcagccccagctccccctcttccctgtggccaggggtcccacccaagcaaaaaggccatggtaaaggaagtcaaaaactttattcagcttataaaattccatgttccaagaacatgctctaagcatgcagaaagcacaggacactgctcccgggtgggggctcaggtggggccacctctgaagctctgctgacccctgggccaaggccctgacagactagcaggcccagtggtcatgaaagcgtgacggccaccacatcacaagcgtgatggcacctgctggtgcagctgcagtccctggtgggccgggcactcactctggcagccgccgtcccccacgccagccatggttgtcccgccatacgcagtagttgagtgtggtcgtgaaggccagccaggccaggtaggggtagagcaggcgggcggccagcgggctcacctggtaccaggccacggtagtggctgccgccgccccactgaccagcaggagatccaccaaggcctgcagagattgggggacggaggatggggaggcctgaggcaccgcgttcacccaagtgcctgtcccactgcccaactcccactggatttgggagtcaggagcctcactcacccccactccacccttgagtgacctggccaagcccctcccccatcgcagcctcagtttcctcatctgtaaaatgggaacagtcatgccacctgacccatgccttgtgtggggtgcacatgacatgcctgaagtgaactcggtttgttcaagggtgcggtggtggcttaggaggtcttgcacgtcccttcccctctctgagcttagagcctccactgagagcgatgctgacctcccagcattactacaaggcccaaacaaaaacttgctatttgtcaggtgcagtggctcacgcctgtaatcccagcactttgggaggctgagacgggtggatcacctgaggtcaggagttcaagaccaacctgaccaatatggtaaaaccccgtctctactaaaaataaaaaaattagccaggcgtggtagcacgtgcctgtagtcccagctactcaggaggctgaggcaggagaattgcttgaacctgggagacggaggttgcagtgagctgagatcacgccactgcactccagcctgggcaacagagcgagactccgtctcaaaaaaaaaaaaatacagaaaattagctggacatggtgctgcatgcctgtaatcccagctactcgggaggctgagacaggagaatcacttgaacctgggaggtggagtctgcagtgagccgagatcatgccactgcactccagcctgggcaacagagtaagactctgtctcaaaaaaaaaaggctgccgggcacagtgacgtgacctggagtcccagctactcaagaggtaaaggcgggagaatcaatcgtttgagcccaggaagtcgagtctgccctgggcaacacagcgagtcttcatctcttaaaaaagtttaaaactttaaaaaagaagcagtcagccgggcgcggtggcttacacctgtaatcccagcactttgagaggccaaggcgggtagatcacctgaggtcaggagttcaagaccagcctggccaacatagtgaaaccccatctctactaaaaaaatacaaatacaaatacaaaaattagccaggagtggtggtgcacacctgtagtcccagctactcgggaggctgaggcaagggaatcacttgaacccaggaggtggaggttgcagtgggccgagatctcaccactgcactccagcctgggtgagagagtgagactctgtctcaaaaaaaaaaaagaagaagctgttatgtagaggggccagtgaccctgcccacacagtaccaggcttcgtgtgggttttcctacacagtggcccccaaacccacccctgcaaccccttctgctttaatagcttccctcaccggaggagtcagtagaggggaggctccagggtgtgggctgcttacagctagagagacatggccttttgtctcccctggccccgcctatagacactgacccagtgtcatatgtgatgccccacgtcctccaagggtcggatccagggatcagggacacatgctgtggccacacttacccagcccatttgtcgggcaccaaagaagatggggggccatgcccagttcagggccagctgcccagtgtagaggcccaggggaaccacagccttctctgtgaagcctcccagctctttccagaccaggtaggagccgtacctgaaacagaggccgcagttcagagcaccattaggaacaaggccaggagcgttgcccacctccgagtggcacagtgatggttcatacgtgacctgacactgactgctgtgtgatctcagggaagttgcttgacctctctgggccttcatttttcatagggttgctgtagagattctagttagcacattggcagtgcttcatgcgatacccagcatttaggacactcagtaaatacctgccattattatcactgtcactgctatgaaagggaagcacatggtgtgaataggtagagaggaggctcttaacctagccagggcactgcatagaggatgggacatttggcctgggccttaaatgatgaataggagttttccaggggaggaaacaggacatgcaaaggctttgaggcagatgtgagaccctgagtcagtctgtgactgcagggtgaggtccagggggaggcctgatcatgggagctgttaacacagggcaacgataacaccaccagtaacagcagccgatgccctccagcactcacaggagccaggccctaccacttcccaagcattcactcatttcagtctcatgatgatgccataaggcaggcagtatcagcaccccctttacagtgaggagactgaggcggtgaagtgactgagatctcttggcaggccatcagtggataaagtctggtcagccagggccagagccccggctgtcacctactaatgaggggttcgccttatccagagccacagggagccccaaaatttcccccgaagagaggctgggactgggtggtgtaggaaggccaagcagggtggggacactggagccagggaagtgcaggaccctggctgggcagggcctgggccaggaggggtgaggcccacgtgacacccaagttccagggccttattcccatcagagccgggcacctggcctggcctctgctatccgccccctagagtgcctggcacctgcgtccccaccctgcactgcgctggcacagaaccaggatgcagggaacatttcagaaggcagtcaattccctgcctcctgggtgtggtccccgctacagccaccaagaggcgccctgcccctcccagcacgtcctttccgggtggaattcccctggtctattcccaggggactcaggccagactgagcctgaaggggctgtggggggtccacacttgcaagccctgtgtccttgggaggcctcttattatgggggtcgttgagtatgaatgagacgagcctggcactgggcaggcgttcaacaaaggagctgctcttggggctgttgctgccgttgttaatcttagcgtccatgcctctgcccaagaccaaccttcacacactaagccggcctctgcctggagctgtgaacatggcggggatgccagggtggggtgagcatctgacccatccccccaggggcccaggaggagaaagttcagttgtgcaatcgacaggcccacagcttccccaccctggcttgccaaatggggctggggaaaccatgccatggtccatggcccgcctggagaagaccctctgtcctgggccaggcctccccttgcaaagggccaggcttatccccaggccagtgcacgcccacctaccccatggctgagtagagcgtgccccagacagggcccagcacccagtggggcgggtgccacgagggcttctgcaggccggcgtaccagcggagaccctcgccgtggacaaagcgggagcccacgaagcaccccaggctgggcgccagcgtgaagcccatggcgggcacccagggcggggccatggctgctgcagctgctgttcaggggagctctgaaagagaagacagggctgggtgagggcattcctgaggccatggggtcaggcccgtgtctcctccagcatccccgaaaggcctgtcacccacagatcaaccagtcagctgatcaggaggcgcagagatgtgcggggtgggagtggctgagtgaacgcatttccagccttgctcctgccccagctgcctcgcctcacctttgcccaccctcacctcgaccttgggtctctggcactgacccctcctctcttccaaggccagtttgggtcccctccaccaagaagccttcccagcctgcctccctgggtcaagtccccgtcctgggagctctgccaggccagtgctttacgttccagcacttcacattcacctttcactcactcactcactcactcattcatttggtgactggtatcagacagagtttgggtctaatccccttcctcactgcctcactgtgacctcaggcaaatcacatcaactcagggcctcagtttccccctcggtagagtgggatatcaatgctcacctaccttgagcacagctcagtgcacagcagcaaggaaggtctctacacagctgtttcagcaccccacacgggccccagtaaaaccaccgccccttccccatgcaccggagacagagagcagcctgcctggggccacactgcactctggcccaggctctgccctggtggcaatatggctcccaccctgacctcatccaaaaacaaagggctaagctcccactcactctgattctaggtggagaatcaggagtcgtctgctcttgtctgagacaagaagccacacaacccgattcagttctgccaacttgcagcaaggcctgctggggcgagggctaggacccaggggggcacagggctggggaggccctgagtgggcacagactggtgctgagggagcctggacctcagaaagggaccctctgaccagggaccagggaggagatgccacaggaagaatactgagcactttcgtcccaggggaacacgagagacaagcagtccaggggacatggaggcagccaagcgggggtagaggggtgtcagcagagactgtgctgaacttgggctttggcaggggcaaagggcaaagggcaaatctggccccagggagaaggggcggctgctggcctgggatccatggagctgggtgagcacagaagcaacctcagtgcccagcagccagggactattaaagactggccccccacaaaccaagcttctgaaggctttctagtaacgagaaagttgttctcaacataacacgaagaaagcagaatataacattgactacagaatgaccccaattttggcaaaaaatggataacatagatatgcgctttttttgagacagagtcttgctctgttgcccagggtggaatacaatggcgcgatctcagctcactgtaacctctgcctcccaggttcaggggattctcccgtctcagcctcctgcctcccaagtagctgggattaccagcatgtgccaccatgccgggctaatttttgtattgttagtagagacagggtttcaccatgttggccgggctggtctcaaactcctgacctgagttgatctgcctgcctcagcctcccaaagtgctgggattacaggcgtgagccaccgcgcccggcacgttttaaaggaacagagtgtcaggcatccagcagattccggtgctgccacttactatgattccctcccctccctggacctcagttttctcgcctgttgaatggggacagttaccccatcccccaaggtcgctgcacaaatgagcagtaaggatggacattctgggggggtgggcatgtgacctatgtcccggcaagaaacgttcctgtgttctccctcccgctccctcctgccccgcccctccctcctgccccgccccgccctcctgccccgccctccagcttccagggtacacgtgctcatggggtggggatgggggtctgatgtcactacacatatgaaaggccaccctccctggggcaggaggtactgctgagcactggccctgcaccaccgccaagtggatatggagctctggaccacagccctgggaccacctcccagctcagcctcccactacatcctctcaggtaagcccaggccagctcagcctactgctcatctgggcaaccaagacataaccgctgctctgctggagcctgcgtgagtccacagctgagtgacattgtgggggaaccataaggagcctcgttcagcctccactggaaacgagccggaccagggtgcctgtacgtgccttttcccaggacaccctcagttgaggcccacctgccccacactaatggcctgctctcactcacaggtgtccctgtccaggcgagcaaggttaataccaccagcataagacacgtggacatcccgaaccccttgatacgacatggaagctggtgcgctttcagtgatgttcatgccacaaatggaaacccccagtgcaggcgtgagccaccgtgcccagcctaaaattaaccgttttaaagtgcaccattcagcagcatttgtatattcccaatgttgtgc

SEQ ID NO: 1427 - DNA, 3380 bp, Homo sapiens
gacggacggcgggcggcggcggcggtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggctttgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacatgatgatgctgcctctcctctctgtgttgtctgggcccttgtttacaagcacgcgttacccttcctgaggggagccatgctctagcccctggagggcctgttgcaggggcagggcgggcccgttgcctttggcagctcctggagagctgtggacatgcagtccccctcagttcgtgctgcaataaaggccatcttctctta

SEQ ID NO: 1428 - protein, 644 aa, Homo sapiens
MEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYQLAHGTAEEKMPVWYIMDEFGSRIQHADVPSFATAPFFYMPQQVAYTLLWPLRDLDTGEEVTRDFAYGETDPLIRKCMLLPWAPTDMLDLSSCTPEPPAEHYQAILEENKEKLPLDINPVVHPHGHIFKVYTDVQQVASSLTHPRFTLTQSEADADILFNFSHFKDYRKLSQERPGVLLNQFPCENLLTVKDCLASIARRAGGPEGPPWLPRTFNLRTELPQFVSYFQQRERWGEDNHWICKPWNLARSLDTHVTKSLHSIIRHRESTPKVVSKYIESPVLFLREDVGKVKFDIRYIVLLRSVRPLRLFVYDVFWLRFSNRAFALNDLDDYEKHFTVMNYDPDVVLKQVHCEEFIPEFEKQYPEFPWTDVQAEIFRAFTELFQVACAKPPPLGLCDYPSSRAMYAVDLMLKWDNGPDGRRVMQPQILEVNFNPDCERACRYHPTFFNDVFSTLFLDQPGGCHVTCLV

SEQ ID NO: 1429 - DNA, 23745 bp, Mus musculus
  misc_feature (1)...(23745): n = A,T,C or G
cctgcgcgcccccgccgccatggcgctggcgctgtccagtcagccgcgggtggtggcggcgacttcccctcaggaagtcaggtctccgcctcctccccccctcccaccccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgaccagtgtgagagtggcgagaagcaagattttattccaaccctactgactaggagcagaactgagctgtgttctggagtgctccgagtgactttggcctttaaaaaaaagtgtaaggagagaaggcctgaagtagacaggagaggtgaaaactccccaagggttaggcattgcttctgccggctgagaactaggaagttaggcgcctccttcatcccagttacatttcaaagaattgcttctatagactctgaaagaccgctgagctgtgggaaataagcttaaaatgaggggatagttagagtctttgttgggcgtggtgctgagcgccttaaatccctagcagtggaggggcagaggccatcctggtctacatgagaattcctagccagcacgagctatagagtgaaacactacctcaggaaaaaaaacaaaaatggcctgggaccgggcagaatttgttagctttttaagagtgagctctactgtgggtagaactccttagaccccagcatcacaaacacggaggcgtgtcatctgttgagggctaaaataaacagtaaacctgacagccagagcttttccttaaagtgtggcaggggtgtcccaggcacttgacactgggcaccgtgttaaattgtgatttaagtcgctttttatggatggaggtttggagagttttgacattctcaccaacacatttaccaaaacacaaaagctgtagactaccccagtagatgtgtgtgtgtgtgtgtgttataggtactacacacctgagacagcctgcacctgtgagataaatctttaaagcagttttggaaataattttatatcgtggcatttgattccccactgcagaagagttcagtaaaacaccaagaaacagaaaaactatttttagtacttttaccttatattgctccttgtctccagtgtgaaagataatggaagccagactatcacaggataatttagattccttttctatatataatacctgtaaatataacactaaaagtaacttttttcatgatatctgtattttatgtcctttcacaatttggagaagtagcacaggagtaaaatagtatccttaaaacatttttatgaacacttccatgtagtaagaatgttataaaaatttattacaatcaaataagtatcttcaatcaaccgagaatatcctgagaaaattttttatctgaatttgtgtgtgttaaaatttctgtctgtcaccaagtatgccagaatagtttttaggtgtcaacatgcaatttttttagttctatggtcagatcacaatcaactcttcatggaaaaaacaaaaccaacctttctgccagtttccacatcactttttttccccagtgattctaatatgtgcaaaagacagagtgatagtccatatagtaataactgctgtaccacttatagttagtgaaaatgagactagtgagatgggagtcttgatgaccctgggaaagtcccacacttggtcttgggttgtgtcatctactgaatggggtaattggactagcccagtgcttctcaaccaaggatgtgtctgacccaggcttcccatcttccgttcatttggaatgtccagagacatttttgcttgtagccactggacaaaggaacatagtaagcaaatgctttaggtgatctatttggtataggacagagatgctgcaacactctaaagacagcccccttatatacaacatatgattatcctactgagaaaacatcagtattgtcaagtttagaaaccttacaataagcaaacttctgaagggctgtgtaaattagatttatagttttggactgacttccgggtagtctggtattccttctgtggtgtggctgtgtgctgggacagtaatagaacatggaagtttggacttataatagtcatttgaacatttggcaatattcaaaaaatgaaaaaacagcagtttaaaaagttacctagtcactgatatgggacttttggaatgttttcccaactcctcctaccttgcaagtgttgggattataggtatgtgccaccctacctggtttaggactctgtatgttttattttcaatggttacaaaaggttgggtggagccaggtatggtggttcatacctgtaaccccagtacttgagaggcagaggcaaacagatctctgagttttaggccagcttggtctacatagactgctcccccacccccccaaaaagttagagtggacatgtcacacatgcctataatttcagtgtttaaagactgaggcatgaggctcaggagttcaaggctcgcctgggctgcactgtgagaccctgtctaaggaaaaaaaaaaaaaggacctcactagttacagaaagacttgtgatttccagttatgcttgtagataagacatgattggaagtgtgtgtgtgtgtgtgtgtatgtgtgtgtgtgtgttttaggctgtgttagaaaactcctccaaaaaaaaaaaaaaaaaagaattaaagtaccagttccattgtcaccttcaaaataggacaagtaaaacttttttgaagcaggaagcagatgaataggatcacatgagtccaggagtttgaggctaacctgaacatatcctgtcccaagaagagtcagtatcactgtggtcggtttgtgtgcactaatttgaaatcaagggaagttgtgaaaactacataatttaacccttctaccttactgtagctaaactacatatttttaaacaattcaaaatgattacaaaacactatatttacattctttctaaactttctgatttaacagttcttttaaacacatttttaagcagaaaagctatatactggtgctgaaatcaggcttagtttcaagataaccagcataaatacagacttaaatttttgcaaaagttaaaactatagtgtagatacatgtagcaaactccaagtcagtgtatgtctttttcagttattttcaataaaatttatctaacaatattgagctacaaatcagactcccatgaattagcagtgtaatacagtataaagactgagtaattatttcacagataagtaatttagaaacccagatgaaacaaagaagtgtctggtaagtgaaagatttttcagaccttgtttcaaatatgcatctttagtgagattcactgggtcacactgaaggttatgaatatatccacatacaattatataagttaaaattataggaaattatataagttttatggcattattcagggtgctatgcctcctagatatggcagtatttactgtcagtaatccttggccagggatagcttaaggtaaaaattagtttcttccaagcaaatacattcaggtaccaccttccttctactatcacccccatccctgggaaaggaagtgaatggatcatgagtcagccacagtaatttactctcttaaattattttagcttgtatagattggcttgttgatactaaaattggatcataccattttacaacataacatcacaattccaatttatttaagtagctacataggaggtggacattttaatatataatcctagcactttggaggcaaagactggatgtttacaagtttgaggctattctcttctacatagtatcaggttaacaagggctaagtggtgagaccatgtctcaaaacaacagaaataacctaagaaataaagacggtgacacaaagctttaatccttcaaaaggcagaagccagcctggtctacagagctagttccaggacagccaggaatacacacagaaaccctgtcttgaaaaaatgcataaatacgtgaatataatgtacaatattagtgctaaatggcatatgtcttcagtctactttatgttgatataatggaatgccacacttttaaaagatttcttacagttctagaggctagtgatttttaagatgccaccatctagcgaaggtcaacttcatggaagaaggcaagagtatgtttgtggagagatatcaaacttgcagtcataagttctcttttaactaacattaatcaactcttaaggtggctacctcgtgacctaagtagttcccattagacttcacctaatgcttgtactttgatagtttccagcatcccaacaccggctttgggggatatattatcaaactgtagcattcttgctcataaacagataagcatctgtaaaataaattttagcagttgggccaggcagtggtggtgcacacctttaatcccagcatttgggaggcagaggcaggcggatttctgagttccaggacagcctggtctacaaagagttccaggacagcctggagaaaccctgtcttgaaaaacaaaacaaaaatttagcagttgagtgccttagatttaactgtagaccatgtaaatatagtgatttgggtaagattaattataaagggagaaaagtttgcccaagtcctaaaagttaatatacaacatgactagcttcatgtttgtatggtcttgcatatttagtgaaatttttgtggtcacatttttaccaactgggaaaaggttgcctgctacaggtaaagttggtttatggttcttcccagtgattttcacagaacattaatagtatacagtcatacttaattatctgcaggggattagttccagaccccctaccttatgtaacaaaacctacaaaagtctggctcagtgtagccgtatatagccttgacgtgagtacagtataaatgttatgtaaatagttgttatactttattgtttagggaatgatgacaaggaaaagtcttcttactctgtaaacatgatttttttatttttatcaatagttgattgagtccaaaaaaatggaacacagagatacaaacccaaggtttacctaggtttgaatccatgactcagaaaattgactgtattttttttttttgagattgttcactaccaaaaaatgcctaggttcagtgtcttagtccatatttcaatattgtgacccagatcacttccatcatcagttctcaggaaccttctcatttacagagatattttctggaccacagaaaaatgttaagttgaggtgtgatgtcacacatctataattccaggtacttatgaggctgagggaaagaggattacaaatttgaggctataaggcctgagagatggccacttctaagtccaagagcctgaattcaatctctgtgacccaatagtagaaggagaaagaactgactctagttagttacccctgacttccacatgcctcctctggcacatacaccagatacatacacaataaacaaacttttttaagcttgaaagattaccatattaaatattaagcttactagatgttttcctattataatggggtttcttatgagcaaaatgctgtaactatagccttgtaagcagttttaaaattcgaggtggtgtttgaaatggtattgctaaatgaagattgaaaatacaacctccagtgtttttaattttctctgtagatatcaggaatgaatgcagacaggtttttttaaaaggcatctgtggagtgctgctgtttaataaaagatttttttaaattatgagataggctggaaataagagactatcttttgcaagctttgaaatatagcagataaatttcatccatgccattttgtttaattgttttaagaaccctttgtggttggtggtattgcccttttagtgcgtgaagatgtgggctcagaaaagaaataataagctgacatatttggggaaataggtttctaactctgaaactcatttctgccccctccccccacctcttagactgaattcacacagcaacgtaagtccctagtaatttagctaccatgttcatacagtaactagaagagacattcaggaaatgataaatctgtatcaaaaggagtttttgtttgtttgttttgcatcagtggcatttactgcagtaaaagtgatatacagtagttttaccttcgacaaccctttataaagaggcttcagttcactgtgaactgtctagtggtcttgcctctagatcatagatgaagatactgacctgagtagttgtgactctcagctagacataagtgtgggcaggtaggtattccagtaccttaagtctgaggtcctgttcagtgttcattctttaatatggtgtggcttccattctgtatctttcctgtatactggtgtcatggagagagggggtaggtagccattaataatactatcaatacataatcatcttttctactctcgtctcttaatgttcagagacctggagaaacttgatctctttagctctgccatcttggatgcaaaagtactaagtacatttgttttaatgagtcataaaagtcagttgtactgtttagatctcatctaagtaattcccacatacacgtgtgtgtgtgtgtgtgtgtgtgtgtgtgtaggtttatacctgccacagcactgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttacaagattgtaaagtaatactcaatttagaaagtaaaaaataacttccaataaaattaaaaaaataattcatgactattcacaaaatgctaacttctctgttttccctgtatcaacatttcagttattaccatgtggacagtttcacttattcagagattattttctgttagatcctctcttacaaggagtttggaggttaaaaaaaaaaaagcaaagctgttagcacatattcataatgtgaatagaaaggacccgtgcatctttctttgtctttgctctgagtcactggctcacttcctcatgttctgtgatggctgaaatccacctatggcatcattccagcaacagcaaagtgatgtcatcttgtagccccacacatttaagcactttttttatttttaaagattgatttattttatgtgtatgagtacaccattgctctcttcagaaacaccagaagagggcatcacatcccattaccaattgctgtgagccaccatgtggttgctgggaattgaactcatgacccctggaagagcagtcagtgctcttaaccgctgaaccatctctccagcccacatttaagcacttaagggttgttttgtttttgttttacgtgaagttattcacatagcaatgttttgcctaataatggccagaaacgtatattttaaaagattttgtgtgtttatgtgccttcatatgttcaatctaagatctacaactaagaaaaaaaaaaaacaatatttacctaagagcctggcttatttcacttgatctctaacaaacaacataatttcatcatttttttaagtggctgaataaaattctgttgtatagtgtataccacattttctttatccatatgtttgaataacttgattctgtaacctagctataatgaatagtgctataataaattgtgtatgtttacttgaatggtaaaggtttatacccataactagtaaagctgggctatgcagtagttctattttcagattgtttgaggagccttcatacacatttccatagtgtctggtcaattttatattcctattggtagtgcataactcccacacacccaaagtccttggtagcatgtattgttttcttaatgttagacattctggctggggtggaactctcattatagttacagctgtcttgattaatatattatggaaatgtgctagagtacctgcctttacgtgcgtttgggggatctgaactctgggtctttgtaattgtgtgacaaacagacccactgaaccaacatcataattggggggccaaagggggtacatgccatggtgtgagcatgtgaaagttacagagaattcaacaggaatcagttctcttctaccatgtgagttaatcaaactcagatctttattatcaggcatctcaccattgttagaatgcatttaaaatttttactaaaattatattttgaccatgttcttcttccctttccccaacctctcccagatcttcccttccctaactacccaacttcatgtgtgctctctctctctctttttctttctctttcacacacacacacacacacacacacacacacacacacacgacaaaaaaatgccaaaacagcatgacctctgtgtgtgtgtgtgtgtgtgtgtgtgtgtgtgtgtgtgtgtgtgtgtgtgtactcctgattataggactgccctggagtgtcgttgatatgcttagtgacacttaattggagaagactaattttttattttccagcaggtatcaattacacatagcttcttggttagggatgaggctttgtgttaagaccctgtctggcttgaagctatacagatcttgtacagatccacagtctgaattcataatgtgcatcagtcctgctgtgtttagcaaacactatttccttggagtcatccatcacttctgactcttacgatctgtcttctcttctatattgatccctgagtttaatgaaggcattttatttagggctgagttcttcaaagattgtcatgctctacacattgtccagctttaggtgtctgttgatactcatctactataagaagcagcttctctgaggagagtagaacaatgcactggtctgagaacccaacctactgtgaccactgtggtggtggagggggagtccctaattagagagtgtttctgcaggtcattaggtatcaaaagggaatggagatatactagaaggaatgtttgaaatgggcaagtggcagaatagaatgaggtagatcctaggttagcatcaagaggtccctagtggatggaagtggactggtaagaggggctcctgcaagactatgtaagactgagaaaccagaagggagaacacgaatccattctttaaaaaacttttttgggggtgtttaaaatacaatacttattgggtgtagtggcatacacctttaatcccagcatttgggagacagaagcaaatggtcttggtgagtttgaagccagcctggtctacatagttccaggacaaccagggctctgtagagagaccctgtctcaaaaaagaaaacaacaaaaaactaagttttagtggctggcaagatggttcagtaggtaaagatgcttgcctctggagcctaacaacttgagtttgatccccagaaccaacatggtagaaggagaaaattgatgcctgcaagttgccttctgacctctatacatgtatacacctctatacatacaataaatggttttttaaagttttcagattgacagcaaaatttaaagatttggtctgtgctggttgtgtaggtataaacttttaatctttgtgacaaaattgtgcttggtttcaggtgaatgagagttgagtattagacaaaaatagatataatctctactccatggtttagctccctgattgttgtagtcttcactttgtggagcattcatgctgaaaaactgaagcaataaatggttgaatatgatcagatttcaccatcaagttctcagcctgataacggtaagattttactcatgtgtgccatctgagctatttagggactgggttgttttacttagcataatgtgtctccaagattgatccactttttccagttgtcactagacagatgctaggactgtttctactttctatagatgtttattccattaggtagttagaccatcatttgctttacccatttacctattgatttatatttgtttttggaaggtttgtactgttatgaacactgatgtttaaatcttgtaaagacatatatcctttgcggtaaatgcctctgagtggtatgactaaatcattattacataggtgtgtatgtaacttgataaagaagttgccaaactgttttctgagtgattatcccttttaccattctttccagaaaggtcagagttatggttgttccacctcttcactaagcactgtcagtcttttagtcattccagtgaatgtgtagtgatccctcactgtggttttaattcatacttattttatatctaatgatctgcaacatcttttcctgtgtttactgaccatttgtgtgcatgttcttttgaagtatcaaaatggtatgactttctttcagcattgttaatgtggctgtcctaatcagatcttttatgcttctcaaattattaagatatttactttttctaattcaccaaagtaggtttcagttagaccattttcctattttcagaataatcactgaccattcatgactctggaatgctttgttggatcatacttctcaaagggaagaaatattcagttgtacatggggttttgctgctgtatcctaataaataaatccccaaaaatgtattttgatgtgggggaaaaaagataatcaggaatggctgttgctcttctgaaactttctgtgtgagttcttatccctattatgtccatctctgcctcctcctcctcagtttccacctcatacttctcttctggaagagaacaaaccagaaggcattctagaatgctgttatagcagtcaagtaatagaggggaatccaagtgctatatagatgctgcagaactccattctgttccttcacttattctcataccctattcccatgagtagtagctcatcttgtagctgaatttatcatttccagcattccaaaatttacaaacatcacattctttcattagtaagccttagagtactgtagtcaggtaagtatgtacatttactttatttgagtagacaggattttaaagattaaattacttaattgcggttctgttacttgtcttagaaaacaataatacaggtgattaagttgtcacaactttaaaattatctaacattagatcaggccactgccacagacatgattcacacacccctgttgccatacatgttttgtttttagtcttataaaaacatctcatgttccatttcctttctattcttttttcctcccaagttagaatatcaaagttactataaatggtttatgagatatttgaccatcgtgatatttctctttgacataagttatcaaaatatttaacagttaatgtaggttttaatttgggtttccatttgttattttaacctttgtaagagcaaagaatttttcagaatagaagaatctagcttttttttttctccattttctctacagataatccctttctgtcaacctaatgaagcattcaaacaagccatatgactcttttcaagatgaacttgaagattatattaaagtacagaaagccagaggcttagagccaaagacttgtttcagaaggatgagaggggagtatttggaaagctgtgggtacagagaagagtttgattccaggcccaggtatagaatgtttgatcagagactcccatctggaaccaaccattcctacccaagatcatgcagtagttcacagacagaagaccgggtaccccagtggttaccagctcatgacaagataagactaaactctctgagctactgtcaattcaccagggatggcttctcagaaaaaccagtccccttgaaccttagtcagcaagaatacaattgtggctcatatagtgtagaatctgtagttcacaagcgcctctgctcagaacacagtaccatcgaccctcaagtcagtcatagacaaatgcaccagaagaggaaaaaacatgtagaagagggcagagaaaagcaggaagaacggcccaaacatgagaggaaaaggagttctgaggaaatggatttaaataaacatagaagcatccaaagaaagaaaacaaaggcagaaacagaaactgtacaggatggtacagaaaagcttaagaatcgaaaagagaaaaaaacccgagatgtatcatctaagaaagaggaccgtaagcgtaggaaggaaaaaaaggaacaaggtgaagaaaggacagaggaggagatgctttgggaccagtctattcttggattttgaggctccttagatctcctgaggctccactgaaataacagtcaaggagcttggttttatgtgcattcatattcatgtcacttgcatatgtggacagaagtttcaacttctaacaaagtgaacatgaaatatttagtgtgctttccaacatggagattacttttctattttctaaaagatttattaacttttcttacatatggtagaatttccctttaagagagtggctctgcttttattgaccaaattgctgtggtagtggacttattttcccttgggagatcatttatttaaaattggaggattaactgatggcttttgtggaatctatttcttggttgggtttcttttagttttgagtcacatatttttatgctcactgtctttctctatgaagcaatttagatttcctttttttagatctaacttgcaatatattttctgggttggaaagtgaaataacataataattttatcttacatatagttttaaaagtttcagagacttcacacaaaatcagtttatattctgaaaatgtttataataaagtatcttaatttctggatgtttctttgtgtcagtgctctgttctagtgattctcttttggaaagagaaaagcaataaccactttatattaaagattttagaggttagaacacactaaatggttgtaaaaattctttacctactgaattaggctcacaatttataataaagagctttgattcatgataatttttccaaatgattgaaacaaagaaggaatttacaaaagaaaatgttattactctttcctggcaatgctgtactttctttaaaatgactcaaagccgacagttcgtgtgatacaactgaacattaactgacactaaatacatcatgcaacttcttttaaatattttaattaaaatcatagctattgagcaagagaaggctataaatatgtggtattgatcatattgaggccactgtggctagcacaatttttaaaaaattttaggacagaagattttttcctaaaatgttctctgttctccaacttcaagttgaatggtagaagctaagccttatacatgcctgggacagcctccactacaaagaaacttctgaaccaaaatagcagaggtggaaaagccctggtcaaaagttaggaagatatcttaagtatgttaaaaaacaaaactaacctaatccaaagagcaaggtagggggtagtatccttcatgcatctgcaagtgagaataatcagcaatgaagagaacaagaagaggtctgggaaatcaaaagtggagaagcctaaataccatggagaagtgcaaagaagtacaaagcaattggcaatttagttccttgctccccaagccacggaggaagggagaactaaagactataagcgaataagaataaggcaggccagagagtgccagcatagtcctaactgcaggaaagaaacccatgtttcttagcagctttaagtctatccatgggattagcctgaaactgtcccccagacaacccagctttggagaagaaattcatgtcccagcaaaagctcagagtaatatgcagtcttgagaagtgccgatcaggagtacctcatcattcagaactgctctgaggatcagaaaataatgagcaatcacaaatcatggtccctacagaggaccttgctgccctgacagggtgggagaaggtccctgaggacaaatacagataagaaggaatatctctcacaaatccaatggagtatactggcttcgggaaggagggaaataagggacgtggttatcaatgttccttttgtcacaagaatcaagactggtcacatggttttacacaggggaggaatgggcagagggagcctaggagtctgagagcataagaccagaattggcaaagagtttgactcccatcaactgtcctccgtcaaagaagttggtttgattacttccttcactctgaggcattccaggtatataccacatttgtgtaatgccacagactgaagaccgctggaatgagtgccatgtctgctacacataccaataaacgttctgtacagtgagacaacttctgccttcacagtgtctgcaggtatagacaaagtttccagaagtaaatatagatgttctgggcacataaattacctcattttacctagagagaaatacagggcaggttgtagattgtctgctgcaacttagtcctacttggactttggtgaatccttcaacttaaagagtagagaacagaggagttagagagatggttcaacagttaagagtactagttgctcttgcaaaggacctgggtttgatttccagtcatggtagttcacaacagtctgtaactctagtctcagagaatccaatgccctcttctgacctctgcaggtaccaagaatacatgcagtataccagcaaaacattcatttacaaaataatgagaagacaaaaacctgcagccattgacccagctccaaacaagtataacctgagggcccacaccagacatatccttagcatcaataggcaaaatggtgtggacacatacacctatcaggatcttcacaggttgcttttatattctttctcgccccatacacaaaaagatagatagatgatagatagatagatagatagatagatagatagatagatagatagaatttaaaaaaaaaatagaagggctggagagatggctcagcggttaagagcactgactgctctaccagaggtcctgagttcaattcccagcaaccacatggtggctcacaaccatgtgtaatgggacctgatgccctcttctagtgtgcctgaagagagcaatggtggacccattaaataaataaatcttttttaaaaaggaaaacaatagaagagaataaagggtctcagtccaggttgcctaaagatgaccttaaacacctgatattctgcctccacttcccaagtgctagaattgcaggcatgcttcactatgcctaaccaatcgtgtgtctttatcaggttttggtaggtttagtattggtgttatagaattaatttgaggggagtttcacaaaatagttggagaagtactcatagtaattctttaaaagcctggtaaaatttaatagtgagtcaatatgtcccatgcaggcttggggcaggtggatttctgagtttgaggccagcgtggtctgagttccaggatagccagggctagacagagaaaccctgtctcaataaaaaaacaaaacaaaaagaaagaaaaatgtcccaagctttctttgttaggaggcaaaattatgtctctgtagggttgtacctaccaaaacataagtgattaaaaacaaacaaacaaaaaacccactataggctaagcatggtggcacacacatttgatcccagcactcaataggcagcatcttagatttctgtgatttccaggccaggctagcctatgtggtaagctctggtatactcaggctatgtagaaagaccttatctaagaaaagaaagaagaaagtaagctataaagtggtattgctgataaatataaatgcaaaaattttaaaaaaaaggttgcaaattaaattgaacagcatacttaaatgtacaccatgatcaagttggttttgattagaagtgcaaggatggttcaatatacacaaattaacatagtacaattaaatagaatttatgataagggaaaattatgtaattgagcatgatggagctaacccaaaaacttgtgaggtagaggcagaggaccagaagaataaagtatctctgtctgctttctggaaaatggttctaggatgagtcagtggatgacagatgaacaaggggctaggtaggcttgagagtacatataattgtgtcacctgggtaatgaaggcaggaggattaggaggtcaatgtgagctttgggtacagggtaaattcaaagccagcttgggctacatgagacatttcaaataagtagcaagtagttgttaagtatatgcttataatctcaatacttgggagtctaaggcaggaggaatatgagttctagtcaaacctaagatacacagcaagaacatgccatcttaagaaacagcattcaaaaataagtctttttttttaaatgtatcaacaatgagcaaccaaaaaaggacgataattctattcaaaatatcctttaaaataggaatacatttgaaagaaagtaaagacctttacaataaaacttgtaaatagagttgataagatggccttgccagtaagggacttgccaatatgcttgacaacctgtgtttgaacccctgaacccataagacagaatgaaagaatcaatttcgataagttgttctctgactttcaaatgcacaccataggggacacacacactcacagagaaatgtgtgaggagagtttattttttccaaaactgtttttataccattttaattacatgcaagtaataaggtcaattctaggttaaggaaataacacacaataaatccaaatagttaagggataggcaaggcaataaaagtcccatgatcacacctgtgatcaatgttactaaaggcttattaggatgaccaagatatctaagcctacttccctgttctagcccaaaatcagaatcttgcctgaagcctacttctttgttctagtctaaaattagactcctgcctgagcttacttccttgtcatagcgagatgtcagattcctgcctgacgcccatttccttgtcattggccaaagtcggactcctgccaagaggccctcaaagctctccacagagatgtaaaaataaatttaaaaaatttttttaaagattttattggggctggcgagatggctcagcgggtaacagcactgactgctcttccgaaggtcctgagttcaaatcccagcaaccacatggtggtggcacacaaccacccttaatgagatctgatgccctcttccggtgcgtttgaagtcagctacagtgtacttacgtataataaataaataaatctttttaaaaaaaaaaaaacaatcagtgctcttaaccgttgagccatctctccagcccataaagataagttttaataaaaaaaaaaaccaaaaaaaaaaacccaaaaaaaaaaaaaaaggcccgggcagtggtggcacacacctttaatcccagtgcttgggaggcagaggcaggcagatttttgagttcgaggccagcctggtttacagagtaagttccaggacagctagggctacacagagaaaccctgtctcaaaaaaaaaaaaaaaaaaaaaaaaaaaaagagggctggtaagaatggctcagtgggtaagagcacccgactgctcttccgaaggtccaaagttcaaattccagcaaccacatggtggctcacaaccatccataatgagaactgactccctcttctcgggtgtctgaagacagctacagtgtacttacatataataaaaataaataaaagaaagaaagaaagaaagaaagaaagagagagagagagagagagagaaagagaaaaaaaaacccactaggttaggattttttctactgtgaacagataccatgaccaaggcaactcttataataacaatatttaatttgggctagcttatagattcagtccattatcatcaaagtaggagcatggcagcatccaggcaggcatggtgtaggaggagctctggcatctctaacatcttagggtatccaaggaaacttgaatgctacagcttcttattccaataattggaatccacacatgattatctgagctccttcacaggtcttgggtcacttctccagctctgccatctgtaggactctaagcactggttgactccactctactgctgttgctgatcttggtggtcatcacatggtactggcatttccaataggcttccaggtctcttctgctgcaactatgcttcatcaatatcctctcataggctcccttcatggtgccaagcctcaagcatgactccttcagtcctagaccatcaattgtaactgaggctacaccaccgtgccaagactcagctgcattctatgacccctcatgccttccaaaccactacctgggtgattcttacacattaccaagcctggctgaagcaaaaggtacaaccttagctatctctggaacacactctcagaaaatacttcccagaagatttcacctcaggaatcctggtctcttcttaatcaccactaatttcttagctccagctagtcagtatcaattgtcccagtagtcccttctattcttgactctaaagccagagccacgtgaccaaagctgccaagttttgctgcttgctagagctggagcatgacccccttgttctattacattatcaccagctttctgttttccaactccttcactgcctaagctttactgtcctgaaacttgctctgtagattgaccttgaactcagatctgcatggctgtatctatctcctaaatgctaggattaaaggcttgtaccatcatccttggatttaagactttgtatcaggctgggtttgaactcattggacctacttgcctctgtcttctgggattaaaggcatgtgctaccatgcctgaacctaagcttttcaaggccactatgcttcaagatctagatcaaaagtttgtgtcatcccacgcatcaagatctgggtaaaaagcctgtgtcttctggcctcataatatggatctaggtgtgccctccatttctagaatgaatgtagttcattccagatgtagtcaagttggcgaccaggaatagccgtcacagtgacccctgcatattatctgacttctacaagcacactgtggtatctgtgcactctcattctcacacaagtaaatataataaactttaaatattatttttaatttctgaaattttattaaatagaagttgaaaaaattcaccagacacaaacactataaactcataaacttctatataactggcgtagccatttggaacagaagctttgcaagatcacaatagaatttatactttcacaatcaaatatatttttatacacttatcctccatcaaaagcaacaacaaaaagatcacagtagagttagaactagaaaaacaactacccttatatcctcttttgtaacttgtgtcttactacctgaattcagtatttttttttcttcaaagaaacaaaaagaaagataacttgaaaacccaaggactattacaaaaaaggaaaggggatgagtgaagagcaaaagtggggagttccaaaagggggatattgccatgcagggacagcagcaaggggccagagacatgggctatgtgtgaattcatggaagacagaagaactccagagtcgagttcattagctgtactgtgggacagtcacagtggagaaaagagctgcttttggtagactgggaggggaactctagactggtcagtgtttcagtgtcaccatgtcctggaatagttgcagttgagttttactgtggctagcagtagtctatccccgaggcaatgacagtctcaccctgtgtcagaaatatcccagcatgacccatcctacaccagcatctacattttacagctgggtttgttaggattaacgcttttgacaagaaaacgatcttgcctgaagacagtggtgcctttgtcctgagcatgagacaccagatcttgggttcagactccaacttaaagaacccaacctaaggctgtactctctagctcctgtttccagattattccccaacaaacctgtgtctagcaccaggttacaagcctgtccctggaactttatttcctaacacccaccaatcatgaggaaagccgaggttaagtttatggtttggctcccagcaccagccaaatattttaaagggcaacaaaactccatagtagccctccaatcagatgtgtgccaggctagaaacccccttgcttgcctgcttgctatttcctataaaaccttgtcctgctgagggctcgttgcttcatccacccagagatggcggtgtggcccaagcttgagcttgaataaagaaagaccttagtgcgattgctccttggtggtcttttggggttcatcaaccagacacaacaagcacagccttgttttgagatcagagtctcaacacagccatccccagaatggcatccacagttaagattggatcagattatgatacatgcgtaaatgacaatgtcaccatgaaagccactagttttaaatagttggtaattataattcaaacgatgaatttttaaaaattagctgtaagtttaattgctgaattagataatattttttaaatattagggattgtagctcaattggtaagaatgcttatctgccacgctagctctgggttccatccccagtgtcacataaatccacatgttggctcaggccactaatccccaatacccaataagtggagtctggctgggcggtggtggcgcacgcctttaatcccagcacttgggaggcagaggcaggcagatttctgagttcgaggccagcctggtctacagagtgagttccagaacagccagggctatacagagaaactctgtctcgaaaaatcaaaagaaaaagaaaaaagaaaaagtggagtcagaaagatccaggagttcaaggtcaccctccatcctccgtagtgaatttaaagcccactaaggctatgagactgtctcaaaatggagaaagatgagaaggggaggtgcttggcaggggtagggactgaaaactggataattgatttaccttttcatgataaactcccggcaggattgactagtactgatctcactacattctggcttttgttcgcaggcagtgaactcaattgagggcgttccccaatccctttaagtgtaagattggatttatctccctggcgagctagaactcctggttgagaaagcagaaacaaccagaactcagacagaggaaggggcgtgacttcctacttccggcatccaggccataagagccattagcagagccgcagagcggcggagcagctgggaacctgggattgttctggagctcgccggaactcaccggaactcgccgccctgtgtgaggccctgtgcagaggttctagccaggtagacactggtgctttgtagtacccacgggtctttcatgttcaagaccccaaagactcataaacataagaaggccggggatccccctgtgtgtggcagtgtgtcctcagttaactatgcaaagtgatggttctagataagaactgacccaaacgcgtttctcacctaaacgcgtttctcatccactctgacatttggtagcattttggagcactagtaaggaccatggctcaggtacaaagggagactgggactggaagggagggctccttggatctgggatatctggtggatttaacaatgcatggagaaatcagggccgctcgtcactggtttctttgtgaaggcctagttgacaccaggcacagttggattgggtgctgagacagcagtgaatagagaatccctgttcatgagaactttgcatgcacgtgtggaaacataccagatctggaaaagtgttagttattgctgctccctgtggactgtgtgggagaggcaccattcaacagcagcagagagcggggtagaaaggaaaagctggaatcagctgtttgtgattttagccactgctgacctagaactcattagccagcttaagccttaaactcgaaatcctgcttcagcctccctggtgctggggtcacaggtctgcaccatcatacttgatttagagtctgcactttaaacacctgaaagcatgcattgaacatgggaaagctttggggatgataattcaggggacagcagacaggtgtcagaggtcatcaaaacaggtagctttccaaacaagccctactgggtgagaaattttttggtgtgtctgtttaagggctttgagcacgaagacacaaaggctcagagacctgtgtgcctacatatgcccttccatgagagaccaatgtggctggaaggtcagaacttgagtaaccaccagggctgtaggtgactagtgggcatctgagcttccctctgccccagagaagcctggtggtttccagcagatgagagaaagctaaggactcttctgggtgtgggtttgggttactcggcaatccaagtaagaggtagtgtccccagtctagaagtttgtggcaacctgaccctaggaggaacgttttggatgctaaaaatggagccaggacatagggtgtggcacagttggtagaatgtttgtctgccctgctctgaggccccaggccaccataaaactggatgtggtggagtgtgcatgtagtcccagtacagggggcgggggtgcggggagggggggttagagatcagcaaaggtcatcaaggaggtcaaagccagttttagatttatgaaacctgtctcaaaaagaaaaaataatgccagcactgatggtgttgcctcctaggtagggagaaaacaaagagcaatggacagctctcactgtgggaggactgaggaggacagtgttgttttgttttgtttttgttgttgtttgtttgtttaaacagggtttctctgtatagccctggctgtcctggaactctagaccaggctgtcctcgaactcagaaatccacttgcctctgcctcctgagtgctgggattaaaggcgtacgccaccacacccagcgaggaggacagttttaatctgtgtgtctgtgtagggatcacctatagctcaccctagtggtgagcatgacccggattcttctgggtcagagggagaactctgaatagaaggaaatgtttggtctcttcctttccctcctttccttttttttcaacaaagcattttctgcggctttctttttttcctttctagtgtacatatagtagtacacttagtacatatagtatatcactttgatatattacaagaagactagaaggaaggggatgacagcccagctcatcttgactaggcaaacactgcgggtaggaattgagttcatttctcatgagcagtgagaggaagtctggatcccaaactgagcgaatataatgagtgctatagatgaggagagagacttgggaggcctgagacttaaaccaaagacaaac

SEQ ID NO: 1430 - DNA, 2099 bp, Mus musculus
ggtgaatgagagttgagtattagacaaaaatagatataatctctactccatggtttagctccctgattgttgtagtcttcactttgtggagcattcatgctgaaaaactgaagcaataaatggttgaatatgatcagatttcaccatcaagttctcagcctgataacgataatccctttctgtcaacctaatgaagcattcaaacaagccatatgactcttttcaagatgaacttgaagattatattaaagtacagaaagccagaggcttagagccaaagacttgtttcagaaggatgagaggggagtatttggaaagctgtgggtacagagaagagtttgattccaggcccaggtatagaatgtttgatcagagactcccatctggaaccaaccattcctacccaagatcatgcagtagttcacagacagaagaccgggtaccccagtggttaccagctcatgacaagataagactaaactctctgagctactgtcaattcaccagggatggcttctcagaaaaaccagtccccttgaaccttagtcagcaagaatacaattgtggctcatatagtgtagaatctgtagttcacaagcgcctctgctcagaacacagtaccatcgaccctcaagtcagtcatagacaaatgcaccagaagaggaaaaaacatgtagaagagggcagagaaaagcaggaagaacggcccaaacatgagaggaaaaggagttctgaggaaatggatttaaataaacatagaagcatccaaagaaagaaaacaaaggcagaaacagaaactgtacaggatggtacagaaaagcttaagaatcgaaaagagaaaaaaacccgagatgtatcatctaagaaagaggaccgtaagcgtaggaaggaaaaaaaggaacaaggtgaagaaaggacagaggaggagatgctttgggaccagtctattcttggattttgaggctccttagatctcctgaggctccactgaaataacagtcaaggagcttggttttatgtgcattcatattcatgtcacttgcatatgtggacagaagtttcaacttctaacaaagtgaacatgaaatatttagtgtgctttccaacatggagattacttttctattttctaaaagatttattaacttttcttacatatggtagaatttccctttaagagagtggctctgcttttattgaccaaattgctgtggtagtggacttattttcccttgggagatcatttatttaaaattggaggattaactgatggcttttgtggaatctatttcttggttgggtttcttttagttttgagtcacatatttttatgctcactgtctttctctatgaagcaatttagatttcctttttttagatctaacttgcaatatattttctgggttggaaagtgaaataacataataattttatcttacatatagttttaaaagtttcagagacttcacacaaaatcagtttatattctgaaaatgtttataataaagtatcttaatttctggatgtttctttgtgtcagtgctctgttctagtgattctcttttggaaagagaaaagcaataaccactttatattaaagattttagaggttagaacacactaaatggttgtaaaaattctttacctactgaattaggctcacaatttataataaagagctttgattcatgataatttttccaaatgattgaaacaaagaaggaatttacaaaagaaaatgttattactctttcctggcaatgctgtactttctttaaaatgactcaaagccgacagttcgtgtgatacaactgaacattaactgacactaaatacatcatgcaacttcttttaaatattttaattaaaatcatagctattgagcaagagaaggctataaatatgtggtattgatcatattgaggccactgtggctagcacaatttttaaaaaattttaggacagaagattttttcctaaaatgttctctgttctccaacttcaagttgaatggtagaagctaagccttatacatgcctgggacagcctccactacaaagaaacttctgaaccaaaatagcagaggtggaaaagccctg

SEQ ID NO: 1431 - protein, 262 aa, Mus musculus
SLSVNLMKHSNKPYDSFQDELEDYIKVQKARGLEPKTCFRRMRGEYLESCGYREEFDSRPRYRMFDQRLPSGTNHSYPRSCSSSQTEDRVPQWLPAHDKIRLNSLSYCQFTRDGFSEKPVPLNLSQQEYNCGSYSVESVVHKRLCSEHSTIDPQVSHRQMHQKRKKHVEEGREKQEERPKHERKRSSEEMDLNKHRSIQRKKTKAETETVQDGTEKLKNRKEKKTRDVSSKKEDRKRRKEKKEQGEERTEEEMLWDQSILGF

SEQ ID NO: 1432 - DNA, 48469 bp, Homo sapiens
  misc_feature (1)...(48469): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagggagggaagggaagggaggggaggggaggggagggaagggaaggaaagcgaagtgaaggggaggggaggggttttcaggaaaggagaggagaggagaggaaatattaaaaaggttttttccctgtaatcccagcactttgagaggccaaggcaggcagatcacgaggccaggagattgaaaccatcctgcctaacatggtgaaaccgcgtctctactaaaaatacaaaaattagctgggcgtagtggcacacgcctgtagtcccagctactcaggaggctgaggcaggagaatcacttgaacccaggaggcggaggttgcagtgagccgagatcatgccactgcactctagcctgggtgacagagcgatactccatctcaaaaaaaaaaaaaaaaaaaggtttttttcaatccaggttgactcccaatgaataccctgtatccacattgcctggcaactcagggtcttgcaataacttgtctgccctcaggggccaggggctcagcctggctcagatgagcttgttccctagactaggcactcttggagcaggttcagcccaagccatggacaaggaagaaatttaccagccccaagaccatatggagagaggaagcccaggactttaattatacctgtgggcctcaaccttatcagaacaatggttattatattattaaagggtggtagacagaataacaggccccaaagatgtgcagattctaatacttagatctgtgaatatgttaccttatatggcaaaagggactttgtgaatgtgatcaagttaaggagcttgagatgagaagattatcctagattatcctggtaggaccaatgtaatcatgaggatccttataggaggaaggcaggagggccagggtcagaggagatgcgacaatgcaaccaagagggtcagagtcagagagatattgaaggggctgtgttgctgactttaaagatggaagaatcggccatgagccaagaaactggaaaaggccagggaacagattcttaccctagaacctccagagggaacacagccctgcggaccttgatttcagccatgtaaagtccatttctggcttctgaccaccagaactgtaagataataaatttatgttctttaaagtctctaaatttgtcatattttgtcacagcagcaatagtaaatatagtaaatatttactatattagtctcattatagtaaatattatgtaacatgctttttgttactttaaagtgaaattcttacataatataatttattcgttcttatacctaagaaaaatgactagtctaatctaacaaaggtgaaagaaaatcaaagttaatttgtagtaatatctatttattgtaaattaaatgtgtaaatgtgctcactatgcatatgcttgggtacaactatattagaagatgagataaaatggctagatgtttgtacctctaagtggaatcactatgatagtgagaacaaaaatgcagattgattttgaggacacaaataccatattgttgcctgtgaccataattttctgaaatggtgagcgactcttaggggagttctaaacaaaataaagtttgatctttctttggttaacaagaagttgcattgctggaaaattcagcatatattaaaactttacaaaaactactttacgattacttacaaaatggatttccagactcagacaatcataaactggctttttgcctacctgaagagcacatacagatatttgaggctgtgcggggtgggcagagagtcttcattgtaccaggctgtcccctgcttctcaggggatctagcatctctggccaggattaaggacacagagttgacagtagttcccagactgttggtggggaagggggcataaggccttcatatgtcacgtatcaacatcaatcctatgtaaaagttttttgcccatctgcctttgctgcagcccttcccagtttgtttttccccctactgaaatccaacccttttttgatgactttggtgctgccgagaatatgcctgtagcatcctgcaatcattgtgacaaacaaaagttcttcccacatttctaaaatgcttcctatgtagtagatttgcctccattgagaactactggtctttgtcttgagaaaaagcacatctagagttttgaaaagatttcttattgatacaggagatagaaaaattatttaggccgggcacagtggctcacacctgtaaccccagcactttgggaggccaaggtgggtggatcacttgaagtcagcagttcgagatcagcttggccaacatggtaaaaccccgtctctactaaaaatacaaaaactagccaggagtggtggtgcatgcctgtaatcccagctactagggaagctgaggcatgagaatcacttgaacctgggaggtggaggttgcagtgagccgagatcatgccactgcactccagcctgggtgacagagcaaaactctgtctcaaaaaaaaaaaaaaaaaaaaaaaactgtttaggcagagagtgagggcaaaagagtgcgcagcagaacttcccttctaacaaaaagcagccctagaaatcatttccttctagcaaagaacagcctggaagaccgaactgcaaacatagataaggaagctggaagcttgcacaggggatgctggcagctgcaccaatagaaaagggctacctgggggccaggcatgtcgaacatggggctctgccttcccttttttgttagcatgtgtacagtaaaaaagaaatgggccacaaagagaagctcaggtagaaaacccacctgcataataaaagattggggtgggggctgtcagagattcgagccctgtgcagatgacacacctggtcctaacccatttttcacatcctatgtagatcagacaccacctccccactagctcgtctataaaaccctcttcatttcagcgtggatcaacaacccatttttctgggacccctctctgtagcagaaagctattctctttattttgcctgttgaatttttgctgttaacctcactctttgtgtgtccacattcttaatctccatggctgtgagacaacaaacctcagatgtcaccccagacaattaggctgcttcattattgacctattggagatgactgggcagagaagaaaagattaaggaagcaggccgggcacggtggctctcatgcctgtaatcctagcactttgggaggccaaagcaggtggatcacccgaggtcagaagttccagaccagcctggccaacatggcgaaaccgtgtctctactaaaaacacaaaaattagctgggcatggtggtgggcacctataatgccagctactagggagactgaggcaggagaatcacttgaacccggggtggaggacagaggttgcagtgagtcgagatcacaccacttcactccagcctggacaaaagagcaaaactccatctcggagaaaaaaaaaattcaggaaacacatgacagccattgttgatgtcttacatcttgaaatacggaaaaagtagatccattctgcatctcctaagagatcaatctaggggccagggtggacataactgtgtgaccatgtgatatagtgattaggatcgtagacttgagcttcacagaccttcacagtcatgtttctgtagataagcccttctccactccaggaagatgtcaatttttccattgttagtggttttagtaagcatccaggcaccttctttttttgtatctgaataaagaaggctagtgagaaagggagaagaatgaaatagctcaagccaaagagctcctggtccaggaaagaggctgagctgggagatttcagacaaggggatgacaaaaattaccactaaggaacaagatgtccaggccatcgctctgtctctatttcagctgaactcccccctccccaacacacacatacacacacaagccaagaacattcctatggatacccagcattccctcaccctaaagaatgtgagaggcaattgatgcaggatttacgaagcaagggtcatgctgggtccctaatcaaaggtagctcaaaggtagaagaaagggacatgatgaggccaggagtaggggctgttttgggagagttatcagtgtatcatcaaaaggctaggcatggcttcaagtatcctcttaatgtaagaaggggctctacttgttaaattgcatcataggtagaatctgttcccagatgccactttgcagcccccaaatctttaactgtagtctgtgtttgtactactgctctgagcctttgagctaataacctcagaggccttgagagagtgagtacatttcccctgtatgttgcaattcagggaatatgtacaaataagtgtgaaagagtgtagatagcaatcaaatccatgtggtttgtgatacgtcttgaatcattgggacagcttgtgtgtctgtattaatactgtagctgttaatctatctatcatacctggaagagctccagtcatctctttgaaagacccactggctgagccacacacctgcaatgatcaccatctagtggcagatcaaaggagctgcaagattttatatctgaagactactttagttaaaggacagcccttatccctggatttgacctcctttgtacccagagctaaggttcaattagaccaaggtcaaggttccttaacctccaaactaagaatggtttgtaccttctttaatggttgggaaaaaaatcaaaagactattttggccaggtgccgtggctcatgcctgtaataccaacacttcaggaggacaaagcaagaggatagcttgagcccaggagtttgagaccagcctgggcagcatagtgagacctaatctctataaaaaataaacaaaattatccaggcaagttgttgcacgactgtagtctcagctactcgggaggctgatgtggaaagatcacttgagccccagaggtcaaggctgcagtgagacgaaattgtgccactgcactaagcctgggtgacagagtgagatcctacttcagaaaaaaaaaaaaacaaactattttgtgacacatgaaaattacatgaaattcagatttcagtgaccataaataaaagtgtattagaaaacagctgcactcattttttttgcgtattttctatggctcctttcacagtgcaacagcagagttggataattgcaacagagaacatatggcccacaaagctgaaaatatttactatctgaccttttatacaaaacgtttgccaacccatgcttagattaataatagcttaatacctggcaatgtcacataggcccagagttggggagaagctcactgctttcaagtacattcactgactgattcattcattcatttcatacactgtgtgagggacctgatcaaggaagaagttcttgtgcacaactaccattcacattccagggtgacaggaacaggtgtcctccttgattatccatgatatcctgcataattgcatccttgacaaaacttcacactctctagtccatgtgttcttactaaaaaagcatgcttgcttccctctttctccctctggctccaagaaatccttagttgtgcaatcctttcctcccaagaattcctaaattcactcatcctgcatgcatttatcagcccgtgtatcaggcaccgtgcccactgccccagatataaagatgagtaaggctgggcatggtggctcacacctgtaatcctaccattttgagatgccaaggcaggaggatcactttagtccaggagttcgagaccagccttgtccacatactgagagccccgtctctacaaaaaatacaaaaattagctgggtgtggtggagcacacctgtagccccagctactcaggaggctgaggctgggggatgacttgagcccaggagaaggctgcagttagccacgatcatactcctgcactccagcctgggtgacagagcaagaccctctctcaaaaaataaagtaaaataggcgcggtggctcatgtctgtaatcccaggactttgggaggccgaggcgggcggatcacaaggtcaggagatcgagatgatcctggccaacatggtgaaaccctgtctctactaaaaatacaaaaattaactgggcatggtggcacgtgcctgtaatcccagctactcaggaggctgaggcaggataatcacttgaaccaggaagtcagaggttgcagtgagccgagatcacgccactgaactccatcctggcaacagagcaacactctgtctcaaaaaataataaaataaaataaaataaagatgtgtaaaatgtaggccctgtcttcaagacattgacctttaaaggggattatggaagagcatgtaagggtggtgagagataggaggctaaggggaagggtatccagggctctgaggaaccaacgaaagcttcggagaagagacagacaagagaagtagggagggtgaccagaatctcagaaccagaggagatcacttcagacccaaggacatggcagcatgtgcagagacatgaaggccaagaaacagcgtgacaggtgcaacaactgcaattgggaggctactgcgggagctacagatgcataagtagtatacttctctttaccatctggcaccagactactgcattttatgtcccagtgtttcatatacatttgaaagctattctaacagcaacatctcttcgaatgtgtgacattgttctttgcttacgttaccacaagtttcatggcaccctttgaggtggatattgtggccattttgaagatgaaaaaaatggaggttcagagaagtaagaaatatgtctgaggcctccttgtgaaaaacatctccaaagtataaaacctggaaaaactttgatccacacgcacaaggagactgcacaagaaggttaaagcagcaccaactggaggagcaaaaataggaaacaaactcagtgtctaccgaaaacgtgtaggagaaagggtaagtagtggtgcattcataaaatggaatattattgaacggtgaaagtgaatgagaacctcacatatcagcatgagttaatataaaaaaggccatgtaaaaaacattgcagatgaataaacagtatgtataataacacttacgtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaattcgtgaggaagtggagaagagggcattccagaaagagggagaagcgtatacagtactgtgagttgagttttgcaatagtgtggtatttacaggaatcagtataggtttaatgttgctgaatcacaagtaatagcagggtggggaggtaagggcagtggaaagataatgagatcagggaggtgcacagaaacctcatagtactcagtttgaccttttccaacagacactggggagccagtaatgacttttagagagaaccctttggcagcaatatggagagtagactggagcagttgaagtcagagggagatcttagcacgtttctagcaagagttgatgagaatctgaaataaggcaacggcaatgtgacaggaaagtagagaatacccaaaataaactcttccacagtataccaggagacgtgcccatcaacaggaaaatcagtggagtcgtgtccagcagtgaaatgaacaaattacagctgtcttcaacagcttagacgaaattcaaaatattaagtgaaacaaacgagtcccagcgtactgcataaaggtgtaaatcttataacgtttaaaaacaatctaaatgtgttttagccatgcctatgtgtgataataaatagagaaaggaaatgatgaatacaaaccaggttagtgatttctttgggaaacaggggatgagatgatgagatatacacatacatacatatttgtgtgtataatgtatattatagatgtacatgctgaaagagcaacagggagagagagaaaaaggtcatttatggaccaatgatgacgacgtatgatgacaaaggattgtgcttaatctactctgtgtatttagggcataataaaggaaagattataactgaggctttattgtaaagatcataaaatgttttgttttacttatattccttttctttgtctttttcttcctccatgcatgcttgcttgcacgtagtcatttcagtagagggtagtcactagtgattgattaacttcatatcctaaccccagagtgcaggcaagattgatgaacttgtttttcttttaaagaacaatggacctggcacggtggctcacgcctgtaatcccagcactttgggaggccgaggttagtggatcacttgagcccagaagttcaagaccagcctgggcaacatagtgagacatccccaccccctgcccaatctctataaaaaatgaacaaaaatcacccgggcatgtgtgcatgcctgcggtcccagctacttgggaggctgaggtgagaggatcgcttgagcctgggaggtcgaggctgcagtgagtggtgatcccaccactgcactccagcctgggcgacaacgcgagaccctatcacaaacaaaacaaccatgacccttaggtcacgcagacctccttgatggtccagatggggcatcatctaatggggcagatgagacctagagtcccagggaggaaacagctttgatcatgggggatcccaccctctgtattcttaccttactcataaaggccccccagttacgttctaaggcatgtcagtatttgagagacttcttctcccgctctctcgctttggccaaacggaataaaccttcccccgctcctaagcactgaatatatcggtgtttggcttactgcgcatttgttacacgaacctatattgtaggttctgttgataaggcaacagatcatgtatttttgagatactttgagggtggaactgtaaatttccagtttttttttttttaatcagttggctttatattcattctcccaaggcgagcgagcgacccccacgaacttttccttgccccaaaaaggagggcagacggacaggatcaaaaccagtcgcgccagcaagacattagagccgcgccgggaactgccaggccaagcgggcgaagcaagcagcaaggcggggctcaagaggcttcctgggcgctgggctggccgcgcaagcgcagtagcgcgtctcgccgccatggcgtctgtgctgtccagtcataagccggtagtggcggcgacttcccctcaggaagccgggtctccgcctcctcctcccatccagcctgctcggcggcggaggcggcggtggcggcagcggttgttcctgcctctccgccacctccaccgcggcttatcccctggctggcggcgttggcggggcgggggacagtagttgtagacgcccgcccctgcctcagagaaggtgagttcccgccccggcggcgggggcggcccggtcttcagcccctcaactcctgcgctccaggacaggcctcgcgcgcccagcccgccgggcgcgccccgagtgtgcgaaatggccgaccagggcgcggcccgagtcccgcgcacccctcaccggccgccgcccccggaaagagacgccagggcttccgagtggagtgcggagggaaggggcgctcggcttgcggaggaagccgaggtcggagtgggaaactaggggcgaccaagaggaaatctagacccggaggaaatctagacccggagcgtcagggaaagggaagtggggtgaggaaactcgaaaattgaggggacagggataaatagagaaaagcccaaacgtggaagagagtaagcttccgtttggtgaagttcagcatcctggaaagtagagactttgacgtaggacgcttagggagaggtggatttaggaatcggggaaagcaggaagtagcggggcccttgggggaagagaagaggggatgaggtttagggggggatcactttggagttatcctaggcttttgaggatatggccctataagacaagcttctaagatttataggcccgtcttgatagtgatctggggttttatgtgtgtgtgcttttaatcctctaatttagagacggaggtctcgctgtgcccaggctggagtgcagtggcgcgatcatagctcgctgcagcctccagctcctgggcttaagcgatccttctgcctcagcctccggagtagctgggactacgggcgcgagctaccgcgcccagctgagttttaatatgtacctaccaatgtcagagatacacgaagctggacgttaaagcgttgaaaaaggattttattccgcaactcctgacagaggggaaagactgagctccattcctattttcaccgagatgactgcgagttttaaagggagatgaagggagtagggagtgggaagagagggctcaagtagagtcagggaggtgaaaaattacaaagtgctgatcattgtaaaaacgcaagtaggccagctgtgtctcctatctgggaattatctaagataaaatactatcctcccacagagactgggagtcaggcccagtccttcctggttacatttcagagcgatggctttcaggtccttgagaaagacactcctgagttgtaagaggtacaaacacatctcaaaggaacagaggaggattcgtagttgtgagccctttttagtaaatgccttttaaaagggaagtcagggagctgttattaggtgttggctagaacaaacagtaaaaatttttttgacagcctggcttttccaacaggaactcaaaagagggctggattgccctcatggacgtgggcttaggcttctagaggccatgttaaattttggtcgactctccaaggatggggagagcttttgcagttctccaacacattgcccctaacacaaaatgctatttcttatccatcttaatctaagagatgtttgagttcttactataatagttctatatgtctgcaaacagcctgctggttgcaaatcatgagataaggcttaaagcagttttgggaatgattttagttgatagtgcttgatcccactgcagaagacctaagtaaaacattcagccatgttcagtatcaaattttttagtgtttgctgtgttgccttatgttgctttttgtcttcagagtgaaagatgatgggagccagaatattgtagaataatttagattcctttttccaagagagacacctataaatataaccccataaaaatactgatttcttctttatcctttttcatgatgagatattgtattttgtgtgttatcccataatattttacacaattgactttgtgtctattgactttggagaactggcggaggagtaaaatactgcagatttcttaaaacatttttgtaagcactttttctgttcactaaaaatggggattagtcattgcaaccaaatgatgagactattaagttctcttagtgaaggcagttttggaagactagatttagtgtcttcagtcagcctggattattttgcttttataacacatttcctgcctctcactaataaataagcctgagcagttaaaagactacaattcagtttggctcacatggccagaccacaggaagatttggaaacaacttgtcgtggaaaaaagctttttggcagactcagcatgtgtttttgtttttgattttgcaatgactttaaatatgtgcaaaagactttaaaagatgtcagttcacacagtactagcagtaacctttctattccacttcagggtggtaaaatgagaatactggaataggagtctgactagttataggttctagtgctagtttctcctacagctaaatgaccctgagtaagtcccacactttctggatttgagtttggtcatctgtcggtgggggaattggactagcccagtgactctcatctaggaatgatcgtacccccgagaagacctctgataatgcggagatattttaggttgtcatcattgagcagagagggagaagagccaatcataattccaagagacagaatcctgaatgttgaaatcctgaaagatgaaaatccctaaagtctaaaatcctcaaaatcacagtcacaaaagactaaaatgttgaaaataataaatgtgggaaaagtactttttttacttctttaaaatatgtttgtttacatttttaaagggggatttatttaagaaacaaaaacatgacaacactttgtaggtcatttcacgcaatgaaaggcaatagtaacattttgcagacacaagtatactaacagtcacaacatgcatgtaacagttatgagcagatgaactgtattcatgaagaagtagatcaaaaagggaaatgtataaaagcatgtcacgatggttggtagtcgtgtgcacctagctttataactggtcatctgaaatactgtgacaagtcttttgatgagatagatcaaaaactataatgggtcactcactattcacttacgcagttgcccaaagggctgaaacctcaagaaattaaactataatgggtcactcactattcacttatgcagttgcccaaaggggtgaaacctcaaggaatttttatctttcacaaatgcagatatgcaaaagacatttcttatctcttcatttattgaggaagtttcagcgtttttaggtacatgcacagtgcttacacacaaagtcagtgttctgataatgtactttcatgaagtcaaatttgcaaaaaatgcataagacaaattagaactctcagtctctgcagtttacacttccagtattggacatgatgcaaagatgaaatacatagcatggtgaattatttttttaaaaaaaagtctgacagtttaagatagtggaaaaaaataatttggcaaatgagaaaatgtattacaggaatagattatgggcagttgcacagagatagtccatgaaagctgccctaacatgcagctatcctgcaattgggattttggccttttgggatttcaacatttgggattatcttctaaacccacgaggaacatggtgagcaagtgcaggtgctaccagcacctacttggcataggccagagatgccacaaatatcctaaaatacacaagacagttcccacactcacacagcaatggattatcctactcataatgccagaagtgtcgaggttgaagaaccctgcaccaaccaaactcagttcttttacagctttaaaattgtgaactgatttaacacatctgtgttggtattctttccatggcttgacatggctgggtactaaaattgtaattcataaagcatatgaaactttgacctataatggctgacattcaaaaagtaatctcagatgacattcagagtaatctctgttaaggttgagactattcactagaatttcaaaaacaatataattgttacctaaaaaattacctattgtcactttacttccggtaaatatctttcattaaaatttcagttactgccacttgacaattggcaaatatttgatatgtcacactatctaaaacatggctaggactcaatatatttttattttaggtatgtataagagttaattgccaatggaaaaaaggttgcttgcacttagctagaatttttttaagactttgttagcagattcctccaaaggtatcaaagaattgtcatgtttccagttattaaaattctactctcactttcaaaattccgataggaccattaaaactgatttgaagagcatctgctaatccattttcacctataccgatccttctgaggaactcctctgtattggtctggataaagagcaaatatcagtaaggattaaaaattggcaaaggttgttcatggtggtttacgcctgtgatcccaacactttgagaggtcaaggccagaggattgcttgagcccaggagtttgaaatcagcttgggcaaaatagtgagaccctgtctacaaaaaaaaaaaataaaaattagccaggcatggccctgcatgcttgtagtcccagcgacttgggaggctgaggtaggaggactgcttgaatccaggaggtcgaggctacggtgagctgtgatcacaccactacacttcagcctgggtgacagagcaagaccctgtctcaaaaaaaaaaaaagcaagtaaggaagatatagaaggcataaggttacaaataggaaatggaaaaaattaatcacaaaaatccaaagaaacaccatgtttccatagttaaaagaaatagacatacttagaatttattattgtggtgtcaagattttccaggacactttgtaatttatttggtgaagtttctcaaacacttttgacagttaaaaaaagtttcactaaataatggtattcctgagtaatcatagtaaaaacaaaactacaacaaaaattcttggttatctacctgtttttattttttatttatttattttttgagacggagtctctgtcatccaggctagagtgcagtggtacaatcttggctcactgcaacctctccctccctggttcaagtgattctcttgcctctgcctcccacgtagctgggattacaggcatgcaccaccatgcccagctaatttttgtgttttattagtagagacaggatttcaccgtgttggctgggctggttttggactcctgacttcaagtgatctgcctacctcagcctcctgaagtgctgggattacaggtgtgaaccaccgcacccagctctacctgtttttaagaaaaagaaaaaaaattgacttggttttggagtgaaggacatttctggctacttattgagtaattaactcatttacatagtaattgcctaaaaatattttcgtttgtttccatgatattaagcggagactcaagttaaacaacataaagaaaatctagctaataacccttcttaagtttattcagaaaacatttttgagttcctgttatgtgccagatattatacttggtactaagggtatacagatgaattaggccagcccttttaaagagctcaatagttgtatttattaatgaaattagggagaaaaataaagagcaattggagaaaatgtagttttaaatatggattagtcagactcctgagatatcaggagtagttcattgttttgcataaatatgtgctctgcacatgacatgtttgttacaggcacaccagagcacattatgttaatgtaaatctgaagttggcagcctggaagaatgattagagtgtgtctggagaaacattaatgattatttgttagtttcagacttgctgcctttattaggtgtcagtaagtgaaaatattaactaagcatgttaaaatgactaagaattgcccctactacattcaccacatatgttaggacagaagtgttgatctcagtttttgtttgtttttgtttttcttttgagacagggtctcactccgattgcccaggctggagtgcagaggcacaatttcagctcactgcagcctcgacttccccaggctcaggtgattctcccacctcagcctcctaagtaggtgggactatgggcacatgccaccatgcccagctagtttttttgtatttttagtagagacggggtttcaccatgttgcctaggctggtctggaactctggactcaaacgatccacctacttcagcttcccaaggacgtaagcattgatacgcttcccccttcttacaaacccattcacattaactaacccattagaaggaatggcgcatgtttgatgttctttgatgtaggatatctgccttggatccaagtaaaactaacttcacaagcatgatccctgaggtagctagccatagagtacttatgattattggcattcaaagacttactttaaataaaaagataaatttgatactaaacatgtactcccaattaatgactttgttacttcatttgtattttgtcattgggaatatgccataataaacccttagttatttttgtaattgttgtattaatgtaaagtagctagaacatggcaaactgtagatcagacactagtctcatttcctgaaaaagcaagattaacaatgagcattatattatagcaaagagtattcatgctgttgacaggtattgggctgcattgttaccccaattaagttctctgaaaacactttaaataggatttgacctctggggaaaaaaggaatcaaacaacatgttttggcaaagataacagaatcagttgcctagtctcccaaaatttagtgctgtgctctgcgtggtctttactaagattaagatagtattggattacagaactccctaagagcaggcataaaacaaggatgtccattctcaccgcttctattcattattgtactagagcgcctagccagtacattcaggcaagaaaaataaaaggtttacagattggcaagaaataatactgtctttatttgcagagtatatgatcatctatgtaaaaagccccatagaatctaggaaaaggcaactagaatagtgagttcagcaggggagtaaagtacaagttctatatatgtaatcaatagtatttctaaatgccagcaaaaagctattagaaacatttttttaaaaatactatttactgttatatcaaaaaacaaaactgcattcataggccttctcataaaacataagatacttttagataacttcaataaaatacgttgaggccaggcccaatacacctgtaatcccagcactttgggaggccaaggcaggtggatcacttgaggtcaggagttagagaccagcttgaccaacatggtgaaaccctgtctctactaaaaatacaaaattagccagccatggtagcgcacgcctgtaatcccagctactcaggaggctgaggcaggagaattgcttgaacccaggaggtgaaggttgctgtgagccgagatcccaccactgcaccccagcctgcgcaacaagagtgaaactcccatctcaaaaaaaaaaaaaatacactgaaaatgacataacattgctgacagaaaaaaaggtgcaaatgatggagagatataaaatgtctcctaatatatgttagtgagttagattgaaaagtctaggaccatgtcagtaatttggtgtatttattagagaggaagaagtaagctactgacacctaaaatataaccaaattagcatcctaattttgctcataaaattttttcctcaaagattaaagatatttagtaaccatttaaaaacctattatgctggccaaacatggtggctcatgcctgtaatcccagcactttgagaggccaaggcggcagatcacttgagctcatgagtttgataccagcctgggcaacatggtgaaaccccggttctactaaaaatacaaacaattagccaggcgtggtggtgtgtgcctgtagtcccagctactcgggaggctgaggtgtgaggatcacttgagcctgggaggcggaggctgcagtgagccaagatcacgccaccgcactctagcctgggagacagtgagaccctgtctcaaaaaaacacaaacctattatgctgttatgattaaatgccattatcacaacaggtcacgctgtgaggcatgaaaatttttattacattttttattcaaattcagttgatttattcatcaaacatgagatgtctgaaaaacatttcatatggtgcaagagttaaattaggcagggcacagtggctcatgcctgtaatcccagcacttgggaggccgaggcaggaggatcgcttgagcccaggagtttgagaccagcctaggcaacatagcaaggccctgttctttaaataaataaataaataaataattcagcgtcaagttgcgttttgtgagaaagatgttcaaaaagttaaattcaggttttgctgtttctaaaaggtaggtagaatgtaacagattggtaaatctagaattaagaaaagtagaacgattcctagtatttaagatatgaagctctttttagacagttttgaattatgagtcatgtgtttcatatttaatacagtagttgatgtgcagtttttgttactttaactttcacagtggttttacatatttttactgaaataaagacctggctgggcatggcggctcatgcccatagtcccactgctttgggaggctgaggcaggtggattccttcagcccagaggttcgagaccaacctgggcaacaaagcaagacctcatgtctgcaaaaaaaatataaaaaataagctgggcttagtggcagatgcctgtagtcccagctactggggaggctgaggcaggaggatcaattgagcctgggaggttgaggctgctgtgagtcgagattgcaccactgcactctaacctgggtgacagaatgagaccatgtctcaaaaaaaccaaacagaaagttggttcaaaatcagagcaattagaaaagagagtaaggatcaggtccatccttcaacttccataaatacagtccctctaaaacatcagttagcttgaaatacaaagaattaggtactcctttcagatacttctgccttgtttatgggtaaccatatttgtctttctgtagttactagactaattggttgggagaacatctcactatgtcagttaaatagacaaaatcctgaaccacaatacaaatagttcatccatacagcacttaccttgttccatgcattcttctaagtgctttgcatgtattaatttctataaggaccacaactttttgaggtatatgttatgtctctattttagaggtaaggaacctaaggcggagaggttaagaagcttgaccagggttacataacttaataagtggcagaactgattccaggcttcctatatctgtttcactcaaaggagcaatggagctaagtaacagtattacagtcactagttcttagtagtgcctgaagtgacttaacctttgttgggtggatgatctttctggaaacaaagccaacatttcaaaatcagtttaaggtagaattatctcttattccaaaaaaagtttaaactcctttagttactttattgaggtacattttacttataataaactccacacatataacatgtacaattcaggccgggcacggtggctcacgcctgtaatcctggcactttgggaggccgaggtgggtgggtcacctgaaatcaggagtttgagaccagcctggccaacatggtgaaaccctgtctctactaaaaatacaaaaattaggcatggtgtctcatgcctgtaatcccagctactcgggaggcttagacacaaaaattgattgaacccaggaggcagaggttgcggtgagccaagattgcaccactacactccagcctgagcgacagagtgagactctgtctcaaaaaaaaaaaagtacaattcaatgaatttgtgataggtgtatgctcccatgaaaccactatcataagcaaaatgtcaaacatttccatcaaccccaaaagtacttatgcccctttacaatccattcgcccctctacctctatccctgggcaaccattgatctgctgctattactagagattagtttgcatttctagaactttttataaatagaatcatacagtagatactctttcatgtctgtctttcgctcagcgtgatggttttgagattcatccgtgttgcatgtgttgctgttttgttcctttttatgtctgaataattgtatgggtatatatcacattttgcttatctgttcagctgtggatggacattagagttgtttcaggttttggctgttacaaataaagctgctgtgaacattcatagacaaatctgcatggatatgttttcatgtcaaatacacagttgtagaatggctaggtcatatggtagctatgtatttaactttataaaaaattaagctgggtggctgataattttttacagtggctcacacctgtaaacccagcactttgggaggccaagatggccagattgcttgagcccaggagttagagaccagcctgggcaacatggcaaaacctcatctctacaaaaaaaaaaagtacaaaaaattagccaggcatgatggcatgaacccatagtccatctactcaggaggctgagatggaaggataatttgagcccaggaggtcaaggctgcagtaagttatgatcatgccactgcactctagcatgagctactccatctccaaaaaaaaaaaaaaaaaaaaattatcaaactcctttgtaaaattattgtaccatttgacattttagccagcaatgtatgggagttctagttatttaacatctttaccagcacttgttattcttagtcctttaattttaatcattctagtgagagtgtagtggtatctcatttatttttatttttatttttttactagacagcatggctcttttcagtttattgcatgaagaagttacgttagtccaagttaaaagcagacccctcattgtggtttaattcatatttacttagtcattagtatatattcttttctgaagtatctgttcagaccttttgccctttttaaattgagtttgtcctataattgagtcataaaaagtctttgtatcttctagatgtaagtcccttgtctgatacgttagttgagaatatttatcctatattctgtggcttgattttcttttttctttttttgttttcttttgtagagacaaggtcttggtacattgcccaggctggtcttgaactcctggactcaagtgatccctgctgcattgtccccctaaagtgctgagactgcaggcgttagccactgtgcccagccagtttccatttttttaatggagagatatgtaaaacatggagatcagaaaatgtttcagatttttaaggaggagaaatggattccagaatgtagactgagaagttttacatcagttaggaaggcagcatgccacaagtcagtaacagattatggagccagactgccttgtcatttactaactgcaaccatggacatgttccttaacctttctgtgcttcagtttcctcttctataagatatagaaagtaattgtactgagcccatagagttcttatgaggataaaattagtaacgtgaggccgggcgcagtggctcatgcctgtaatcccagcactttgggaggctgaggtgggtggatcacctgaggtcaggagttggagagcagcctgaccaacgtggagaagccccatctctacttaaaaaaatacaaaaaaattagctgggcttgctggcacatgcctgtaatcccagctactcgggaggctgaggcaggagaaccgcttgaacccgggaggcagagattgcagtgcgccaagatggtgccattgcactccagcctaggcagcaagagcaaaacttcatctccataaaaaagttactatgtataagtgcttggaacagtacctaatacattgtaagggcgatgctgtaaaagtgttacaggacaggttattaataggtcgcttgtgaatgtgatactttgaaataaacattaaaaggcaatatgcatttattgaaaacacaagtcatgccatgcctagtttcttttatgaaagattactaataaatcaaaagaatgttgcaggaccatatttctttagtgagcataatgagattccctgaggtttctgagatacaagattgtgccaggaatatacttgaagtttaattggcataatttattcagagattaaataatgactttttatatgaaatggaagttttaagactagagttcaagaagttcatgagttgttaaggtaaaccatgaaacttgaaatacttctgctgtgtgtgtgattgatctctttaagctgtaacccctagacctcctgactacaagagtttactcctatctgcctatagattgttttggtcaaaatgattgagattgagaaccactgctgtagaaaggatggttacaattttagaagggcatttcctgtatttcaaatatcaacaaaatggaaaaataagacttcagtgtagtacaaacagatcagacccgtaagaaggagagtagtagggagtagagtggagaagcatagtgttaaaaaagatgctgaatttgattttgaaataaactcagatgttatcaagttattaatatctttctaattaaacccatagattgctaataaatagataaatcctagatgcaagaagagagtagattctttgtagcatgccataggtattatcttgcccttatcctgcttaaagttttcaccagtaatgtgaatgaagtcatagactgaatgcatataaaaagtatgtgtgggagccatagcaaataccaagattaagatcatttgaattttaaaaaattctcaggtggctgcggtggctcacaactgtaatctcagccttggggagaccaagggaggaggatcgcttgaggccaggagatcaagaccagcttgggcaacataatgagattcctgtttctacaaaatattatttaaaattagctgggcatgctagcacatgcctatagtcctagctattctggtggctgaggcgagaggatcacttgagcccgggagttaaggctgcagcgagctatgatcatgcctctgcactccagcctcagggactctggttttttaaagaaagaaagagagaggtggggtgggggtgggcagtcaaagaaaagaaacaaagagaaacctcatttaggaatagtggtctaggccgggtgcagtggctcacgcctgtaatcccaggactttgggattccgagggggttggatcatgaggtcaggagatcgagaccatcttggctaacacagtgaaacactgtctctactaaaaatacaaaaaattagccgggtgtggtggcaggtgcctgtagtcccagctactcaggaggctgagtcaggagaatggcgtgaacctgggaggcggagcttgcagtgagctgagattgtgccactgcactccagtctgggggacagagggagactacatctggaaaaaaaaaaaaaaaaaagataatggtctaaacccataacaagatgaagtattaattcctgcatttagaaaaataattcagtcaacatccatatcacatgggagaagatagccaatatcgggggggagagatgctacctccaggattttaacaattgtaaaggtcattagaaaccaataatatgatgactatttaaaaaataactaatgctaaaataaaatggtaaggatgaaaataatgtccaggttagaggaagagataatttcactttactccacaacaatcacagtctgtgttcttcaaactatataatgctgcaacctttgtaatgagtaaatatatagtaatcactatgcaagtgaaagagaggtgatgtcaaaattttctgaggaaagatttctacaaatgcctagagttcactaccgagctttctttcctctagtggttcctgttacccatcatgtgtactgaagtttgatacatatacaattagttgagggacccaactgttttaatttgtaaggaatttcaaggtacataaaacatctgcaggttgtttaaacccaacttgacatagaggtattaaacacatagaagaatggaacaggaaaggagagatgtgcaagatactatacatttgatagaatctggatttgttccaaaatcaaattcactgctttttgaatgcttaatgcttattcattccactccctacttctctccttctgggggataacaacaacagtaacaactcttcttcctcttccttactttctctgtcaaagataactttacgcaggatcaaggccttagaattgtctctgcccccactctcccgtctatctgctcttcccagctatcacaaattcctttgattccacctttagaatatctctcatattcttcccttcctttctgttagctctgctacttttttggtgcagcccaataatctcttgcctgcaacagctacctaacaatatctccattttgagtctctttttcttcccctattgactgcagaattaaatccaaatgtccaaataaggcatattatgatttagcatcattccacctttagcactgtctttcactacctttatgcatgtcttgttttatctaaagcagaaatgccttttctaatgcccttctgtcctccagaataccctttctttactcatgtttttttctctaaattttacccatctccttaagtgtccattcagaatctattctttaccacaaacccctcaccaagaacacattataccttcttatgtcttacagcactttacacatttttgtcttgcatcatagttctttgcatatcattttttacaaaattatgaattcctcaatattaacaattgtcttgttcacttattcccaatgtgtggaacagctatgtgtaatgtaagggaaagggttgagataaaccaaggtttaatatctgcctttatcaaatagcacatgtggcaacatattttaatttctttaaatcccaatatcctaatctttatgagaaattcttgcaaaagtaaaaaacagaaacaataatctgttgtttggcatacagtaggcattcgataagattcatctcttttttcctatcctttcccacagtactcaccagagtaccttgaagacaaactcaataagtagtgataaagtttaataaagtccaaaagcatggagaacttgaactaaataatgttataggtattgaaaaatgaaagaatagctttgaaaatattataaagctagaacagacatgactcaggaggaaaatggctgagattttgagcttgagaatattttgctatttaacataaaaaatgagagcttagttggcgaaggaattaaaggtaaccccaagtttcttacctcagcttacaacattgccttttagaaatgcctggttggtattaagggttgaaccaggaaggagattattgttctattttaagatatcttgagcttctaaataactagtcctcagtaagctttccatgtattctgatttgtttgtcaccaaaagacagtatttacctgttcttattaaagatttatttttgtagagacagatgtctcaatgtgttgcccaggctggtctcaaactcctggtctcaagcaatcctcccagctcagcctcccaaagtgttggtactacaggcacgaagcactacgccaaaccaagatttttaatggaaaagtcaccatcacatcaccatgtcagtttttgtacaataattctgagtcaagggaagttctgaaaacctttgtattaacctttttaccttgctgaccttagagtcaaatgtaattaagtcctttattttaaaacaactaaaaaataattgagatattatatataatatatatatattttctgagacagtctcactttgtcgcccaggctggaacgcagtggcgcaatcttggctcactgcaccttccacctcctgggttcaagagattctcgtacttcagcctcctgaatagctgggattacaggcatgtgccaacatgcccggctaattttttgtatttttagtagagacagggttttgccatgttggccaggctggtctcaaactcctgggctcaagtaatccgcccgcctctgcctcccaaaatgctgggattacaggcatgagccatcacacccagcctgagatacatttttaatactcttcaagtcctttctaaaatgtttctgatttataattatcttgagcacataatatttttaagcaaatctttttaacccatacactggcattaatattaagattagtttgaagatacccagtataacttaaatatttatggaatttttaaaagtacaaagtcctgtatattttttgcaaaaattaatacagagatgtacaaagagcaatatgttaaatgtttgaccctactcattttctgacccaatttcccatttctcaaaccccattaagtttagcatatatcttttcagatttttttctgtggatactgagctaacacacaagatcagactgtcaaatcaaacgcatcaggtttactaattatttcaaggatacaggcagtcaagagactcaactgaagcagcgtgtctaatacatgaaggatggctcctcagaccatgtaatatggttaggctttgtgtccccacccaaatctcataatgaattgtaatccccataatctccacatgtcaaggagagaccaggtggaggtaattgaatcgggggcagtttcccccatgttgttcttatgatagtgagttctcccgaaatctgatggttttataaggggcttttctcacttcactcagcacttctccttcctaccaccttgaaaggaaagtgccttgcttccccttcaccttccaccatgactgtaagtttcctaaggcctccccagctgtgcaaaactgtgagtcaattaaacctttttcctttataaattacccagtctttgttatgtctttgtaacagtgtaagaacagaccaatacaccatgttttcccctttggacatgtatctctggcccagaataaatagttaaggtttctaagtaagattcacaagatcacctcacacagtgggaatgtttaaattgtgactcatctccatgttataccctagagagttgtatagcttatgtggcattcttcagaaagagatgtctcatagattctgggtttatttactacagctaatctttagccagggacatcttgctaagagcattttagtggtaagatctcttcctcccagcaaatatcattaggctctttacttgaggtctggatgtcaccatccttgtctttttccctcttctccaggaaaggaagtgaatggattggaggccaaatgcattaattccttccttacagtaaatacatatgtatatacttaagtttgggttgtatatgttgggttgtttatactaaaattggattttatgattgagcaattgattgagttctacatattgtttttcccgttaatatatcatgggcatttctccatgacattacatatgattctaactcatccatttaaactgccgtgtagaaagtacaattttgatgttacatgattggcaccctatgtataaactggtaaacttctataaaataaattttagctgttaggaactttagattgaagtatagaccccaagtgtaaatgtagtaattttggcatagataattcattaagtgagaaacactttcagcaaaagttgtagaagctaatatgtgaatatgactgtagctttgaagggcttgtctgagctctattcagtgaaatttgtgtggttgtatttgtaccagccatggaagaaggttgcctaccacaggttaagatagtctgtgggctgggctcagtggctcatgcctgtaatcccagaactttgggaggccaaggcgggtggatcacctgagcgcgggagttcgagaccagcctgggcaacatggcgaaaccccatctctacaaaaaatacaaaaattagccaggtacagtgacatgcgcctgtactcccagctactcaggaagctgaggcaggagaatcacgctctggcctgggtgacagagccagaccctgttttaaaaaaaaaataaagatggtttgtggttcccccatgtgattctcagatgacattggtgatgtatctagaatcattagctgtcttaaaatcgactgcatttcttgagattgttagctttaaaacataaaatgccaagactggatttcttagcccaggctttcaatattggtgccccagtaacttttccttcaggatggtgttttgtagactaaaaaatatgttaatatattaaatattacagtcttactaaatattttcatattaaaattgttattctaatgagcaaaaatttattactctagccttgcaagcactcagaaaattaagatttgagatggtatatgaaatatagtagttgaagtttaaaaatattaccttaactatttaatataatcttctgtcttacctctcttttattgatagataccacattgaatgaacaaagactgaactttgtttacagataccttttataaaagatgtctgtggagtagtgttacagttcaaataacaaaggattttgcattatgaggtaggttgaaaatagaaggaatatgtcctaatgtcactttttaaatgtagtgggtaaacttcatatatgtcatcttatttaatccatacaagaaaagtattgtccttttgatgactgactcagaaaagggaaataacttcctgacttacatttggggaagtaggatttaaattcagatctttctaattctgaagctcattttcttttcctttctccattctgtcttctaccttatccagaaagccactgtatcagttcttgtggtaaatataaggaagatattatgaagcttgagcaggaaaatattaatataagtcaagagatattatagatccccagagtcttcctttactaatcaaattaatcaaaggttacaacataatatgcagcagtcttacccttgactttgccttgttttcaaggcacaggattatagaatgctagcattggaaggtaaaatgtctaatgattgtacttccttagtttatagatgaagaaactgagatccggaggagtagtgattatttttagatagtcatgggcatgactaagccaataaatgagatctgattccctgtccagtgttacttccttttatatggtatagctcctcacttgtatcatctttgctgtataatagtatcctggagaaagaatagtcttttgtatactacattacaatggcttttcccattctgctcttctcacgctctgagacctggatgagctactggatctctttaatctgtggtgtctgggataccaaaagtagtagatacatttacttaaatgaaacataaggcctgctgtggttttttagagaactcatctagttttccctcttgataatcatgtcagaaactgcattttatttcatgtgtgatggttgagattaaagtaccataattacagtcatgtcttagccttggattgagagaacttggattcaagccttgactccaccattaattgctgagcaaatcactttgacctctctaagtatgtttattcaacctgaaaaatggaagtgacaatctctgtcttgccctaattcttaatctactgtattctagtctagtatattttgggctcagtcttcagagcccagaggtctaagaaatagtcaaagggcgggctctgtgataacttgagtttcattgaaattttaaaaataactttcatgggattataaagtaatattcaatgtagaaaaatacagaaaatatacatcattcataactgtgttctgaaaatgttagtgtccttttccctacatttacattttagttactcttacatggttggctttaaatatattcagagattattttctgttatggcttgaacccataacagtttattccttgtctcatttaagagtgtggagttaggcagtacaaagctgttaggacagttccatgatcatcagagaggacccagacattttctttttattctaaggccctgacttacttcctcatgttctctgatgactgtttgatttctaaccatggcatcctcatttcagcagcagaagggaggatccctcctagaatcctacacaacacttcagctttcttcttattgaccagaattattcacatggctacatcttgctttaagaatggccagaaaatgtagtctaaaagactaaaagctagacacatttcctaaggtttgttactaaggaagaagaaaaaaatgtattggaaggcaactggtagtctctgtcacaaacagaaacataaaactttatgttagaagtaattctaatcataggattatctactgaagctgatactttgatttgaaagcaagcgaaattctattcgtaaacttttagttcagaccaaatatattaaaactcacaagtgctttttcaatttatagttcttttcaatttatagttctttggggtatatacctagggtagaataaatctggagtaatttcttcttaaataaacaaaacttatttattattccagggtaaaaaaaaattgctcaaaaagttagggctttacaagcacagagagacaaataccatatgatctcacttatacatgaaatctaaaaacttaaggaagtagagagtagaatggtggttaccagaggctgggtggtagggttggggagtggggacagagaaaggaaagacatttgccaaggggtacaaagttacaggtagataggaggaataagttctggtgttctattgcacaagaaggtgactatagttcatgtatattcaaaatgtatttattatttcaatatttttaaaagtagctgtaaaagattattttaagtgttcacgttgcaaagaaatgatcaacatttgaagtaatgactatgctaattcaccaaatttgattattccacactatatacatgtactgaactatcacattgtatttcataaatatatacaattattacttgtcagttaaaaataaaactatataaaatatattgttataaaaataaagtatgtttaaacatttttaaaagttagggtttattttcagatttataagaagcaaattaataaaatgaaggtgaattttgtgaattttcagatgattggtctatgttgatgtgattataaactttgaattatttaatctttgtaacaagattgtgtttggtttcagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataagggtaagtaaggttccattcacctctttattcatctctgtgccatctgtggtcctttggaactggcttctttcacatagcataatgtcttcaagcttcatttgtgttgtagcatatatcagtacttcattcctttttatgctgaataatattatatgaatataccatattttgtttatccatttatcagttgatgggcattggttggttatttctactttttagttgtaatgaatagtgctgctgtgaacatttgtttacaacttcttgcatggacataggttttcattcttttggctatatatgggtggaattgctaagtggaattgatgaaactgctgctaagttattttccaaagtaggtgcaccattttacattcccgcaaacaatgaatgaagtttccaatttttccacattcttgctaacacttactagtatctttttttcactatagccctcctagtagatgtaaagtaaaatctttttattaccaaaaaatttcaaacatacttaaaaataaagaaaattgtataatgaaccttcatgtatccatcacccagtttcaacaattatcaacatcttttaaatcttattagtgacttttttttttgagacggagtctctctctgtcacccaggctggagtgcaatggtgcaatctcggctcactgcaacctccacctcccgggttcaagcaattctcctgcctcagcctcccaagtagctgggactacaggcatgtgccaccacacccggctaattttttgtatttttagtagagacggaggtttcaccatgttggccaggctgatctcgaactcctgacctcaggtgatctgcctgcctcagcctcccaaagtgctgggattacaggcctgagccaccgcgcccagccattagtgactttgtaaaaacagcattattgaggtatagttagcatataataaactgtatgtatttaaggtatacaatttggtaagttttggcagatgtatatagccatgaaaggatcaccacaatcaagataatggacatacccatcaccgcccaaaaaatgcccctttagaatcttttcttcccacctctctccccaagcaaccactgttattatagtttccattttctagagttttatataaatggaatcatatcgtatgtactcttttatcagacttctatgactttttatttatttatttttagaaatgggttcttgctgtgttggccaggttggtcttgaacttctgagctcaagcagttctgccacttcagcctcccaaagtgctgggattacaggcatgagccactatgcctagtgtatcactattttaaatagtaaaaaagaattacaattattttcgttattttgagattcactcacgtcatgtgtatcaatatgatttattcctttttatcactgatagtatttcattgtatcgttataccactgtttgatttaatccattcacctgttgattgacatttgagtttcttttctttctggggctatcacaaataaaactatatgaacattcatgtctttgtatagacacccagtcatgtgtccgttaacgaccaggatacattctgagaaatgtgtcatgattttctcattgggcaaacatcatagactgatggtataacttactacacacccaggctatatgatatagcctattgctcctaggctacaaatctgtacagcatgttactatactgagtactgtagacagttgtaacacaacagtaagtgtttgtgtatctaaacctatctaaacaaaaagacacagtaaaaatgtggtatgaaagataaaaaaatagtacacttgtgtggggcatttagcatgaatggaggagcttgcaggactgcaagttgctctgagtcagtgagtggtgagttaatgggaaggcctaagatattactgtacactgctgtagactataaatactgtaaacttaggctacattaaattaattaattaattaattaattttgagacagagtatcactctgtcacccaggctacagtgcagtggcgcgatctcggcttattgcaccctccgcctcccaggttcaagcaattctcctgcctcagcctccctagtagctgggattacaggtgcccacaccacacccagctaatttttgtattattactagagatggggtttcaccatgtcggccaggctggtctccaactcctgacctcaggtgatctgcctacttcagcctcccaaagtgctgggattacaggcatgaggcaccacacccagcccattaaatttatttttaaaaatttttcttgttttagtaataaattaaccctagcttactgtaattttttcactttataaacttttaaatttttttaactttttgactattttgtaatcacacttaggttaaaacacattgtccagctgcacaaaaatattttatttctttatatctttatcctagccttttcctattttattcttaactttttttttatttttatttttttatttttttgagatggagtctcactctgttgcccaggctggagtgcagtggcacgatctcggctcaccgcaacctctgcctcctaggttcaggcgattctccagcctcagcctcccaagcagctgggattacagacatgcgccaccatgcccagctaatttttgtatttttagtagagtcggggtttcacgatattggccaggctggtctcgaactcctgacctcaagtgatccacccacctggcctcccaaagttctgggattacaggcatgggccaccacacctggccctatttttttttttcacttgttaaacttttttatgaaaagctaagacacaaacacacacattagcctaagccttcacagggttcaggatcatcatcactgtcttctccctccacatcttgtcccactggggggtcttcaggggcagtaacatgcatggagctgtcatcacctatggtgccatcttctggaataccttctgaaggacctccctgaggctgttttacagttaacttttttttttaataaggagaaagaatatactcaaataatttaaaatatagtatagtaaataaatcataaaccagttatcaaatcttatgtactgtacatagtgtatgctatacttttatatggcagtatagtagattcgtttataccagcatcactacaaacacatgaataatgaattgtgcattattcacattactgtgactttttcagctccactataattttatgggaccaccatcatatattcagtccattgttgaccaaaagattattatgcagtgcatgactgtatctccttttcctttaaggaaatacctagaagtagaataactgcatcatatggggtaaatgtatgtttaacttcttaagaaactgccaaactgtttttcaagtggttgtaccattttacattcctatcaacaatatttgagagttccagatccttatcagcactggtattgtcaatctttttcattttaatcattctggtaagtgcatagtggtatctcattgtggttttaattcacatttacttgctgatcagtgcttttaaacatcttttcatgtgcttattggccatttgcatatattcttttctgaagtataggttaaaatagtttgcccatatttaagcaagtatttgttacattattttttattatttttctagtcagaatttgtatactatttaagttgaacaagaactatattttctaacttgccaaattaggcttcatttagattttctttttaacctcaaatttccaaatttgaaaaactggctgatcattagtctcaaaaaattaggagnnnnnnnnnnnnnnnnnnnnnnnnaatgttcagtttctacatgggatatatgccctcctaattttttgagataaactgtatcaccaaaaatatatagggcaggtgggacacagtggctcacacctgtaatcccagcactttgggaggccgaggcaggcagatcacctgaggtcaggagttggagaccagcctggccaacatggtgaaaccgcatctctactaaaaatacaaaaattagccaggcgtggtggtgtgcacctgtagtcttaactactcaggaggctgaggcaggagaatcacttgaaccctggaggcggaggttgcagtgagacgagatcgtgccattgaactccagcctgggtgatagggcaagactccatctcaaaaaaaaaatatatatatatatattttttttatatatatataatattataatttcatagtaagtacattttctgctatatttgtatttattcaggatttgaggtgaggaaaagaatcaggaacagtcttgcccttccccccaaaaaagaatcaagcaaacaaaaatggtgtatctactgcaagtttcttctgaaactcttctccaaatcagtcctatcccttttcagttttcacccctgtttcttcccttattcctctcaccagtactttaagagagaacaaaccagaagacattctagaatgcttttttcaccaatcagaagtagtggaatgaaatccaagcctacacagaagatacagaactctgtgctttcatcttccctcatacctgatacctaaaagtagttttcatcttataactgaatttctgattttcagcattcccaatcaattttataaacatccttttattgttaagtcttacagtactctcgtcaggtgagtacgtttattttatcttgagtaaactgaagattttaaaaatcaaattctgtatctgtggttcctttacttctcttagaaactaatatacaggaaaccaattcatgagaacttcagaaattaattgaacattaatatcagccacccaccgtggttgtgtggttcctatccacacatccctgcttatctcacattttagccctatgacagcaacatgtgtatcggttcctttctgccctcttcgtctcacttctgagaagggtaaagttactggtacgtgacctgggaggtatctgaccatcctgatgctaccctttggcatataatgtcaagatactcagcttttatgctgaaataggttgtaatttgtttgagctgctttgtttttcaaagctctttttaagagcaaaggaggccaggtgcagtggctcatgcctgtaatcctggcactttgggaggctgaggtggatggatcacttgtggccaggagtttgagaccagcctggtcaacatggtgataccccatctctactaaaaatacaaaaattagctgggcgtggtggcacacacctgtaatcccagctactcgggaggctgaggcaggagaatcacttgaacccaagaggcagaggttgcagtgacccaagagcaaccccactgcactctagtctgggtgacagggcgagacgccatctcaagaaaaaaaaaaaaaaaaaaaaaagagcaaaggaaatgctcaggacaagatgatctggtaagaattttctcccttttttgcagaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattatgatcttaggttacataaagtttctaaagtttcaaagagtcttgatacaaaatcagtttatattctgaaaatatttataataaagtattctaatttctacatgttgttgtgtgtcagtctgttcctatttaacaatgatttttctcttgggaggaggagagaataacttggcagttcatcatacttaacaggcaagatcttttgggtaggtcacactttgaagctgtaaaaattccttatctatcataccttgcttgctcacatttgaacctggtttttaaggtagaaatctatgactgactgttacaggaccccaccacttacccaaagttagcctttgggtcgggggtttcctcactatagtcccttcactggtcgccagaatgatgttataggaaaggggtccgaatctagaccccaagagagggttcttggatctcacgcaagaaagaattcagggcaggtccatagaataaagtgaaagcaagtttattaggaaagtaaaggaatagaagaatggctactccacagacagagcagcccagagggctgctggttgcccatttttatggttatttcttgatgatgtgcatcccccttttaggccatatagggtaacttcctgacttggccatggcatttgtaaattatcacggcgatgctgggagtgtagcagtgaggaagaccagtggtcactctcggtggccatcttggttttggtgggttttgtccggcttcttttctgcaagctgttttatcggcaaggtttttatgatctgtattttgtgctgacctcttatctcatcctgtggcttacagtgccttaaccatctgggactacaagcccaataggtttcagcctcattttacccagctcctattcaagatggagttgctctggttcacatgcctctcacatgcccacagttttttcagatagttaaaactgaagagagaggagtttatcagaaataaaatgccattaaattattctgtcctaatcagtgttttcattctaataatccccttttttgtgatacgcatctcaagtatttaagcatcactattttgttgtagaaagactgatggcctgagaatctgaatcgcaggagtctagtctcagctatgccatgaagttgttatgtgactttggggaagtcaattacttcatcttcctcattatcaaatatgactagaaagactggcctctaaaaatgccttggataacaagaagactctgtgaaatgaaaattcccaagccccacttaaaaaaagaaaaaaaaattctctttgtattctacaatgttgtgcttacatgtctattataatattaacattaaaattgtcttgctaaaattatttttaccatggtagggagatggaaattcacacacaaaagttatctgcccttcccattttgtattctaaaatacaacttttagcctgaaaagataaacactggatacaatcattattacttaagcttttattagcatgcctatactcttaactcttcccatctgtgattttttttaaccatctgtgatttttaattgtgtgtgtcaccttgactgggctaaaggatgtctgagtagctggtaaacattgtttctgggtgtgtctgtgaaggtgtttccagaagagattaataatatttgaattggtgaattagtaaagcagatggccttcccaatgtgatcatccaatctgttgaggccccaaacagaacaaaagggaggaagaagggcaaatttgcctactctttttttgctgagacatccatcttctccttttcttggacattggtgctcctggttctcagggcttcacattcagctagaacttacaccatcagccctacccccccaagttcccaggccttcacactctgaattaaaccacaggctttcctagttatccatcttacagatggcagattgtgggtcttctcagcctccataatcatttcacatgagccagttcctataataaatctcaaaacacacaggccaggcgcggtggctcatgcctgtaatcccagcactttgggaggccaccagagttcaggagtttgagaccagcctggccaacatggcgaagccttgtctctactaaaaatacaaaattagccaggtgtggtggcacacgcctgtaatcccagctactcgggaggctgaggcaggagagttgcttgaacccgggaggcggaggttgcagtgagcgaagatcgtgccattgcactccagcctgggcaaaaagagttaaactccatctcaaaaaaaaaaaaaaaaaaaaaatcatcttagactgtggcctagaaggggaaaaggtgaccattagaacccaacatggaattgttataggagttattaagaaattattttaggcagctagagaggaaaagggggtccttgggaagttgtttcttttaaagcagctccagaaacatttatctagcaggaaagcccctgctcttagagctgggctggcaagctttgctatgcaaatcccggccattagaaactgggtccacccagacatggcgattccctcagtcttctcccttgccccaacatatccccatgtgtgtagaatgacatggcaccctgcatttgcatgttaaaaggctaggatgggagggccagttttttcacgggctacgtgaatgacatacctgtctaaccaatcccctgggccctatggaaaccagacaccgcctcctccagcatcccagtataagcagccacttttctgcggcacacagggttttctctttgtttgaatccctcctccctttatctctgtacaggggagctgttttcttcttctttccttctttctagcctattaaactttttgcttcttaaaaccaatccatgtgtgtccatgtcaatcctgtcagcgcgagaccaaggaccctggtgttcctccagtcatcggagctgtatcagaatcaccaagaacagaaaaattagactattcccgttccttgattacttaatcctatcaataaggaaataaacttagtgatatatttgcctataggtaaggaatataacttttttttaagatttggacaaaatgataatataggctaaaaaactatatgattaggtagatttataattgactatgtgactagtctccaagtgactgagtagatccccaaatcaactgttcttccatggcactgacagagtaagattttgtgcagtgattttactccctctgtttttaacatgtctggtctactggtcaaaagaaaaccgaagtagagcacaagcaggctgtgaattatcagtcctaaaagattccttcttctctgaaaaccccaagatagtatagtctttattgacaggtattacaaacaaggtcagctgaattatcagcatttttagagttgacaaaattcttttccacaggttattttgagtctaatgcttgggggaagttcaaaactaccgttgacccttgaacaacatggccttgaattgcacaggtccacttatacacagattttcttctgcctctgccacacttaagacagcaagaccaaggccgggcgtggtggctcacgcctgtaatctcagcactttgggagttcgaggcggacggatcacctgaggtcgggagttcgagaccagcctgaccaacatggagaaaccccgtctctactaaaaatataaaattagccgggcatggtggcgcatgtaatcccagctactcgggaggctgaggcaggagaatcacttgaacccaggagacggaggttgcagtgagctaagatcacaccattgcactccagtctaggcaactagagcgaaactccatctcaaaaaaaaaaaagacagcaagaccaaccccctcctcttctcctcctgagcctacccaactaatgttgaggatgaagatttttatgatgatccacttctacttaatagtaaatctatggtctcttccttatgatttttagtaacattttgttctctagcttactgtattgtaagaatatagcatgtaatagaggtaacatgcaaaataggtgttaatcaactgtttatgatatggtaagtcttccagtcaacagcaggccattagtaaagttttgggagagtcaaaagttatactcggattttctactgcacagggttcagagcctctaacccccacgttgttcaggagccaactacctaagaatattcagtaagataccaaagtactgtgatttcttccaaatggtttcaaaatagatgccatggttcagttgttagcagcacacaactgaactacactgagtggagcaggcagattctttttccaatttttaaattaaaaccataaaaattgagtaagggcatactacaagtacgtgataatgacagtcttgaggaagcacctatgacttgcatgatagtttttaaaaatttaggacagccaggtacgatggttcacacctgtgataaaagaaaaacttcagccaaattaaatttaaaggagtttaattgagcaataaacagttcaagaattgggcagccttcccagccagagtaggctcggacactccagcgcagtcacacggtggaaggtttgcggacagaaaatggaagtgaggtacagaaacagctgggcttggctacagcttggcatttgccttatctgaacgtggtttgaacagttggctacatttgattggccaaaactcagtgattggcacaagtgtagtctgtttacacctccacttgtcacgatatacagacaaacctttaggccaaacttaaatatataaggaggcagctttaggctaaacttgatttcaatacctgtattccaacactttgggaggccgaggcgggaggatcacttgagcctagaagttagagatcagcccaagcaacatagtgagaccttgtctctgtgaaaataaattagccaggcatggtagcatgtacctgtagtcccagctactcaggagactgaggccagaggattatctgagtccaggagttcaaggttgtagtgagctacaagagcgccactgcgctccctcctgggccccagagcaagaacctatctcaaaaagaaaaaaatcatgacataagcaattatgtggaaataaggtcacgcctgtcaaagtaatcagctgaaagcagttgcctctgaggtgctggaaagggggaaagtggagataagggaactacttttctttaaaaaaaaaaaaaagacataaaactaacacttcaggccaggtgaagtggctcatgcctgtaatcccagcactttgggaggccaaagcggttggatcacctgaggtcaggggttcgagaccagcctgactaacatggtgaaaccctgtctctactaaaaatacaaaaattagctgggcatggtgccgggcgcctgtaatcccagctactcgggaggctgaggcaggagaattgcttgaaccggggagacagaggatgcagtgagctgagattgcaccattgcactccagcctgggtgacagagcgagactgtctcaaaaaaaaaaaaaaaaaaagcaaaaacaaacaaaaaaaattaacacttcattacctctgaatggagtgacattaaaaaatgttttaataaataaaaacaatttaatacttcaaactatgggcacacaaaacgttgataaaaataaaaaatttagaaatctattattaataggacagcatgttgagagactttaaaggagtttttttttaagtattttaaaaataatctcaaatttatagaagtcttggaattaaagtacgaagaacttttgttttgctaaatgatttgaaagttcctgagctgacttcttataacccctacatactgtgtgtcttctgtaaacaaggactgaatccaataaaattgtaatatagctagcaaaaatcaggaaatcaacattactatatttctaccatccaaccaacagacctattcaagttttgccaagtcaggatccagttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcagtccccacttctgagcccataaaagccccagtacccagccacactgagagagagaccacccgacttcagatcaggggaccacccttgcatcccctctcagctgagagctgtttcatcgcttcataaaactcttctccgcccttttcacccttccattgtcagcaaagggtatgaaaaaggcagtaacaccatagccctccacatctcccccaccgtctgtgcccagtggcaaccccttgccatgagcagcagtgcagggccaggccagccagggagcctccagcaggagcaggcaacaggactgacagagttgttaacacaccccccgtttgttgttaacatgcccctgtttgtcaggctgctgacagtgggactaaaacagctgttagcatggctgtaacaccccctctggggcttcagagtcgagcgctttcctgtttgggtgccaccacgttcccttcatctggatgccagagttcaccccaggagtcgcttctgacaggcctgatccagctgcaggccccaaagggaccccactcctgtgccagcacttggagtggctggcaagatgaggcactcacttgatcacacaccccctcctactggggctgagcatgcagtctcggtggctgcaggatccccaccagagtgcaagcccaagtgggcagggcacctcctgcctggggcagagctaggcatgggcaggggcatcaccagccagaagtctgcagttggaaaattgagaaaaatcctgcgtcactttggaagcagtcttcctatcctagaatgccagagggcaagcatctgaaagatctggaaggataaggcagcaaaggccaagatgtgaaagtgcactgcccctgtcagaggcgatcgaactagagcgattccatcttgaataggcgctgggtaaaataaggctgagagctgcgaggctgcattcccactagcttaggcattctaagtcaggatgagatagaaagtccgcacaagatacaggtcacaaagaccttgctgataaaacaggatgcagtaaaggagctggccaaaaccaagatggtgatgaaagtgacctctggtcatcctcactgctcattctatgctaattataatgcatttccatgctaaatgacactcctgccactgccgtgacagtctacaaatgccatggcaacatcaggaagttaccctatagtgtctaaaaaggggaggaaccctcagttgcaggaattggctttcccggaaaactcatgaataatccaccctttgtttagcagatgatcaagaaataactgtaagtatagtcagtcgagcagctcatgccgctgctctgcctatggagtaaccattcttttattcctttactttcttaataagcttgctttcactttatggacttgccccaaattccttcttgcaggaggtccaagaaccctctcttggggtctggatagggacccttttccagtaacatccccatcacagccctaatcattaggggaccctctaggctcttccctgccctccccagactgtcttccttaaacatgctggatgcaggggtgcatcagtgactccgctggtgcctccaggaacataaagtatggacctctgtggacaacaaacaacccaaagaaaagacgacccctcacaggcaggatggatatccacttatatgtacgtcggtgtgctggggccgggaggcttctaataacaatgttaccgctgcttcacacggaacaaagctgaggctcagagagattaaggaacttgtccagggccataccggagtccaggcccgtgtgctgtcatggtctgaggtttgaactccaaccgtttaaagagctgggatagaactggggagggagtgtggtgggtggaaacagcgggcagatagatggtggctggactccaaggggcctagggtctgccagagggacaacaagtgaggaaaacaggccttggggtggatgagcgaatcctcagaggaggatgggcgcagacccggagggccgtgaaaggtgacagggttattacaatcttggtcgcataagaaagggggtaactagcggtttctcggctgaaaaagaggaggtgggctggaggttcccccctccaaccgcgcggagcacgcagcctctcagcaggctgccacacagggtcccctacctccgcagctgcggggcct

SEQ ID NO: 1433 - DNA, 1756 bp, Homo sapiens
tgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattatgatcttaggttacataaagtttctaaagtttcaaagagtcttgatacaaaatcagtttatattctgaaaatatttataataaagtattctaatttctacat

SEQ ID NO: 1434 - protein, 267 aa, Homo sapiens
GKSRFVNLMKHSKKTYDSFQDELEDYIKVQKARGLEPKTCFRKMKGDYLETCGYKGEVNSRPTYRMFDQRLPSETIQTYPRSCNIPQTVENRLPQWLPAHDSRLRLDSLSYCQFTRDCFSEKPVPLNFNQQEYICGSHGVEHRVYKHFSSDNSTSTHQASHKQIHQKRKRHPEEGREKSEEERSKHKRKKSCEEIDLDKHKSIQRKKTEVEIETVHVSTEKLKNRKEKKSRDVVSKKEERKRTKKKKEQGQERTEEEMLWDQSILGF
